United States Patent 11,001,841 (CCCTC-BINDING FACTOR (CTCF) RNA INTERACTOME) - sequence listing, part 44

SEQ ID NO: 104548 - DNA, 1966 bp, Homo sapiens
atagtctgtggtatataatcatcatttagaaaatacagcttttttttttttttaactaacacatagcaatatgatcacctttcttgatcatgctaatactaatgtgttcactttttttgttgtgtcgttttgttttgttttgagacagtctcctccctctgtcacccaggctagagtacagtggtgcagtctcaactcgctgcaacctctgcctcctgggttcaagtgattcttgtgcctccacctcctgagtaactggaactgcaggcatgcaccaccactcctgcttaatcttttttgtgtatttagtagagacagggttttgccatattggccaggctggtctcaaactcctggcttaagtgatctgcctgcctcagcctcccaaagtgctgggattataggcatgagccaccacacctggccctgtttctatttcttacaaattttaagcctcttgaaaatagaatgtatgatgaccatttttcccttcatacctagttcagtaatcagtaggtattaaatatatatacttttaactgtaaatgaataaaactgtatttttattctgagaatcaagtgagaaaggtgctttgacctaaatggtcactaaaatatttagtgtagtgacttgctttttaagtggatctaagaagtacagaaaataggattattctagtcaaaaagaatgtgaacctaattttttaatggttgggagaagtttttgtagaaatcatttcatgctttttaggtagaaaaggggctagacatggatcaaggaatcatataagaatagaaagagcttctgaaaagggacacacatatataagagatggtgaaaggaatttggatttagcatcccagtacctttagttggtgatatagcagtttagtagagggtaactgtaacacagtaacaaagacttttcagaaactcaatgtaaaagaaagaactgtagcagtggctcacgcctgtaatcccaacacttggggcgtctaaggcgggcagatcacctgaagtcaggagttgaagaccagcctggcaaacgtggtgaaatgccatctctactaaaaatacaaaaattagccaggtgtagtggtgcatgcctgtaatcccagctactcgggaggctgaggcaggtgaatcacttgaacccgggagacggaggttgcagtgagctaagtaaatgccattgcactccagccttagcgacagagcaaggctctgtctcataaataaataaatgaataaatgaaagaattttatattttgcactggtagaaattaaattagagatcagtcacatttgatttacctggagtttgggagatagaatgttttcagagttattttaagcatggtaattaaagagtttctttgggattttggttggattggaggagataacttaatgggatgaggcagaaaacagttaagagccattgtagattacagattaatggctttactgtagagccttaaattaatctgtggtttcaaactctcatccaagctttgtgtttcacagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgaggtgatttgggtttggttgctgggagtgctggatatgaaaatcatcatttgtaccttctcatttcaaatataataccattccaaatgtttctttactatctttcttccccatctcagtaagagaatgggaaacctcagggtcattgtggcctgttacctggtagcctctcatcttggcagcccctatgct

SEQ ID NO: 104549 - DNA, 1054 bp, Homo sapiens
tatactttggtcaaaataggcctctagctgcctgtagtatctgttagtaacactagcctgagagcacagatgatattgattgattgtgtcttcgtttctaggcctttaaataagtgaagtgtctttcccaggttgtttggtattttcattgtggccttagcagagatttagaaaacattggggtatggcttatggcgaatgtgggttttttccactccaggttactttccctctttgttataatgtcttaggaatcagaagtagacaagaggctagcaacatgtattcatgagacaaatttattaccttcactgttggattaagttagaaatgtctgcctcagctgtttcaaaaagtaatcttgaatcactttagtgttcaggtttgggtgacagcaggtttcaatagaatccatgtatacttttttaaaacacttcatctattgcatgttactttgatttgtaattaaaatggacactgtctcttttttccttctcagaaaaatttgttctgaccactaaacacactctgctgctctgcccccttgtttgcacttctccagatgtgttttttgagaaaggtgaacattttaaccaatcttacgtttcctattcagcttttccaagtatgaggattcagaatacttagcttttatgagtaactaagaggcagctagcaacattgaaagcagaactgtattctttcttaccctagacctctacttttggagcagacctctttctgggtgagggaaaaaacctcctggttacatatcagttatctagggaaattactctttaccagattatttatgaaattctttcagccagataataaagcagctgattcaggcctttctaacttgactttgtctacttgcaattgactttgcagtttgcacctagagctttatagtaaggtatcatgagaggaattctccctggagggcataagattataggaatagagtgtcatactttatcaatacaggttttattataaatgtggaattatgaaaattagaaggaggccgggcgcagtggctcacacctat

SEQ ID NO: 104550 - DNA, 3857 bp, Homo sapiens
gagtggaagcaacattgggaggacaagcttagttagcctctcctttctaccagaataaccctcccctcctattcttgccctgagagccatactccacccgccatttcacacatacgtgcacctagatgtacaccacccactgtccatgccaagtaaaattcacagccaaaaccctgctttgctgaagcagcctcatttcccctacctcagcatgtgcctgccacctaggccacagttattcagagtctacattaggcaccctctccttacctcagccctagcacccctgagtcattgtcacactaccaccttcactctcttcacgtgttcccatttacatctttccattaagcactcactgctcagtctctgttatgggactgctgcctcacctgaaagtcccaaggtaaagtcctaccctctgtaggatacagggacctaagtatacacatacatgctttttctgctctgttgccaaaagtacaatggattttacaaaataacattaataggggtggctcaggtctaattagattatgccaagaaccaactctagcctgtgagctagggattccatcaatcacatttcctgtaactgtcattcaagaggaactggccatctccctaaccatgtcagcccccagcacactaatgtctccccctggatagcactgggagggcctgaggcatataagagaataaagaaatgtgacaagcagaagaggcattggatgaaggaacaaggtccatgtaaggaggaataaggggtagggtgcccctcaataacaaatactgtaggttgctaaactctcatctaaaatacaaagacgtataacactaaaatttcaccagtctaactctttccttgtatgtgcttgagatgtttacttacagcatgaaacattataaccaatttatccttaaatgctttcagagataccaggaagcattttaacaagtcattctgtccattgagatgagttctgcagttaaatatttcccctatgcattcttattcaacttccccgcccccgaaaaaagttatggctaacatctatgcttgcttttattttttgttttgttttgcttcttgacttcgagtagatgaataataacaagatgcttttccctcctctagaacatatcctcccctgagagttcccctgcgcataggcccgagtccctgtcacccgaggtagttatcacaccatctcaatcacacttggaggctgagagtgagtgttcatgaatgtgttcctgagtgtgtggggagggctggggatctgagtcagtggggtgatgggctggagggcggccactcagtcacagtaagttgaatgagtcttcctgtgtgactgtgactacacaggactgtcaatgtagatggaggaaaatgaaggtaggagcgtgtgtgtttgtgtgtgtgtgtgttgtgtgtgtgtttggtggggttggtttttgccgtttgggggagggggtggctggagttctattaaagaatagaatctagaagtcaagatgctgatatgtggtaggagccttgttaaagaaaggctaataaatcaggaaagttgagtcaaaagttgtaagagctgttttttgagttgggtggtgacttatgccttgttctagggttaatctaacagctctgtaaaccagatgttttgacctttggttgatagattgagcagcttcttcaggaagggaaagtcattctgtctttcagctttcctacattttctctgcagctccttactgggtgcacaaggaaaccaagtgagtccctggctttctgtcacaggccaccattctgcaatggttaggatatggttgctatacaagtgttatctctttaggatatcagtagagtggttttctcacaaaccctactgctgtggatatgtcaaactcagattttagtgctagagtttctattataagctttcagatttagtaacattaactctgaatctattaatacatgggaccttttttctcttgaagagaaagttagagtctctcagaaatagtcaactgaactttaaccctatccccttccaataaaaaattagggcataattcagtgacagtctactaagttctgaatcagtagtagttcacaggttaatatgaaactgaaaaaggttttattccactagtatattagagattttcttggtgttttgactctagcttgttaggaaagtaaagctctctctcctcagttgttaaagattctaagataacgtaatttgaagactgatatggtatggtatctggttttctggtaccattctttgtcggttagctgtagttgacctagtgttggaagtttggaggttatgataaccaaatagtaggtggggtttatttttggtacatttcagcatttcagaatctgcagtgatgagcattagtggtcttgtggtatgttgacgtacattagaggataaagaagaattgagtggccagaaagttgtatgagaaacacagcttctttaacagtgaaagtgagtgaagaactggttggttgatgtctttaatgccatcctcctttactgaaccagtaacttaagtacttgcctttccgtctaccttctccttcctccacctttttcccttccccccaccttccatcaatattaatttagaaattgataaccccggaagccagttatcttaagacaccagtctcatctttgttttgtgcatggggctaaggtaaattcctaattataccacttgtcccttagtgtagtacaaggtgactcagcaacctgatgaaaggctaagcaggcaaaatagtcacatttagccaattacctaattctaactttcccagtatttcccatccagaaagacttgaaagcaattttggaaaggccaggattctttagtactctggcccatgtacactgttgctacgtgggacttttacagaatataatggctttatctgctctacttccgtccctcttatctttccctgttcacctgtgtccctctcccctcctttctgccctttgactttttcctttctcccctaccccatgtctccgttgatttttattctttcagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtaagtgtttcatgttatatcggcgaacttttcaagaatgttaaccaagtagtttagtagatattcataagtttctgctatgtgttccgcactactctcagacaagtgagacatagtctctgccaaatccagtgaaagacaggctgttttagtacaacttggtgaatgttgtaaatattcagcaaatgtaaatgcctgtatgtgccatatacttgctaggcaattgagaggttagaacagtgaaaaagaaattttacctattatttagtgtgtcccaagttcgaggcactgtattaagctctttaaat

SEQ ID NO: 104551 - DNA, 1115 bp, Homo sapiens
ggtggcactccattggccaggcagcaggcatgcagtatggtgcaaacagttggatgttgttgtatcaggtggaaggccgggggagccaggaggaaagtgcagagagtgctgggctgggccaggccatagagagcttgctaatgggttgggactccacttccaagtaatgcctgatcaagaagtcacaaagccaaaaatatgcttttgtataagtggttctcaactaggggtgtttgagaatgagtaggagtgttttgaattgtcccagtgacttgcatttattgagcagggccagggatgctgaatgtcctgtataggggacagtcccatgtaatggccaaacatctgtagtatcctcattgaaatgaaacctagtggtttttttatattttcattataatgatattaccagaatttattaacttctttccaaaattatttctagaaaatgcatatgcaaaactgtctatatttttgttccatttggacagaaaaatgagaaccctaaggggatagaaggaggaggaaacattggcagataatttggattaagataataattgatttcgaagattgttgcgtgaacagcattgactaccagaaacaaacatgaaaacaatctttggatttctggttttataatatttactatgtgcaaaagtcatagaaattatgatattttatttcagaaacacttctgaaatttattgggcacatttaagcataaatttaagcatatgccaaattctgtgctggatgttaaagataaaaagccagataaacttggcctttgccttcctagaacttatagtttagtcagggagcaatcaaggcatggtaataggttctacggcctgtgtaagcaatgtgccagaacaacaaagagaaggtgtactaggcagggcacggattatggtgggcagggtgggatgggaggtctgctgtcaggaaagaatgagcaagcattagggagatgaaggggaagttagggagaagttaccaagttgttttctagagctagcttgctaaaattataaactggaaataataatttcctctctttttacattaattacatctatgtgtaagacagaaacagtaataaattcctattt

SEQ ID NO: 104552 - DNA, 1245 bp, Homo sapiens
ctctcaaacagctaactctaggggttcccaaggagtacagaacagccatcagtcacctgggaggctttttaaactatacaagcttccaattctcccttctctaggtacttccattgttgcaaataactgtgatagcatgcttctgttactgtgtaatggtaacctcacaagtttttctgaaggcagaaaaaaagatggtggtctaattggcaaacattctttagagacttgcctcctagtttattatcttcctcttaccaatttccagctgccttaaatatgtagctgtgctcagatctctttcatactccccaaaaaaagttatcagggttggtgtctgctttgtttgcgtggcttggctagtggtttactaaggtaccatctttccttctttccctgttgctggtgatccactaatgatatccagatagagtaccgttttttgtttgtttgttttttcctttctaggtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggtaagtttatatttgatgttttatagttaaattgggggtgggggggagtatatatctaagatcattcccagttttacctaaaatctatgggaacacttgatgggaacatctgagacagccagccaacagtaccatctgtcctgttcagctgatttaataatgtcagctgcaaccccccagctttgcagaattaagaattaccaacatgcctgtggagcagtgctttggatgacatgtagttatggatgcagatgagctctttcatttggtgggcactaacactgcctttcctatttctcatttcacatgaaaggtgagtcaagaatccagccaagttccacatgaattaacaacagatgtctctcttccacacagctagcatatacagagcaaaaagacattctgaaaggatttgtctggtttaggggagaccacaaatttaaaaatgaataatactggtggcaaatactgagga

SEQ ID NO: 104553 - DNA, 2754 bp, Homo sapiens
ttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagattttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgagaacttctttgtccaattttgtggccctgccttgcctggttttcctaatgccatttttatctgaggagaatgtgcccttggtggagttgttttgcccatgataatggggccaggaatactgtctgatcttccttcgctttttatgattgcagtcaggacagtgtgaaggcaaacctgcagcag

SEQ ID NO: 104554 - DNA, 1022 bp, Homo sapiens
caaggacgcctgccaccaggtgtccttgccacaccttgttccccaaggacacccaccaaacctgtgccctggtgcgggggatagaactgacctttcagaggctggaggcccggggcacaggcagccaaggccgcatccttttgggaagaactggagtgaaggaagccacttcagaggacgtagtgggtccagctgacttaggagtgggtcagcgccgggtggagaggagggaggctagttccctggtggggtagcctggcaacattcccattccaccgcacctggccagctgccatcttggcagagccagggggagatgcaccagggagtttggagtcaggaaggcagagttgtgtgggctgaagtctgcgggaaccccagggtgacacaggcaaggggtagaagtcagagtggggaccaaaccatagactggggccctgggttctgcagaggtgtggatggggcaggtggcaggtgctccagtgggggccccaggtgaggccctgatggccctcctggggcaataaagacatcatgggaagggggctttgtggtttgcctctgctctcgtcgggcgatctggctttagccttcaggaggaggtaagcagaggagatcagtgcctgtttctgaccccaggagggccttgttgggctccaacctagagccttccggcttcaggtcccaagagaagtccccccctaactgtgacccccctaactgtgatcaggggtctgccattgcccgcttttctctgcctgatctggggactcaggagaggccacggcagccacagcctaggggtggttcagtccctggcccacagtctggtcagttgagtccttctgggaaccggggctatgaaaactttcgtctttggggaccggtacccatgaaggaaaactttcctgagggggtgaggaccaaagaatcaagatccttttcaggcctgatagccaagatgatgagaacttttagataaggctgtggggagagtccctggccttttgagcatcctgctt

SEQ ID NO: 104555 - DNA, 1049 bp, Homo sapiens
cttattgtgtgccaggcaccaccctggtacctggaccgcagcagagaatagaatgtgtagaatggaatggaagctggtggaccctggaggtgggaggaggcaggtagaggggtttgggggatctagaagtgagtacctttcagccttccagttgtgtgttctttttttctttttcttttttttttttttcagaccgagtctccctctgtcacctaggctggagtgcagtggtgcgatctcagctcactgcaatctctgtctcccgggttcaagcgattcttctgtctcagcctactgagtagctgggattacaggcacgtgccaccacacctggctaattttttgtatttttagtagagacagggtttcaccatgttggccaggctggtctcgaactgctgacctcaagtgatccgctggcctcggcctcccaaagtactgggattacaggtgtgagccactgcacctggcccagatgtgtgttcttaattatcagggtctctgggctaggaacctcaaccaggaactcccatcactatggcatagaatattcatctacatttctctccatttctttctttcttttcttttatttgaaactgagtctggctctgttgtccaggctggagtgcagtggtgcgatcatggcttactgtaaccctgggctcccgggcttaagaaatcctcccacctcagctccctcagtagctagaactacaggcacacaccaccatgccttgttaattattttattttattttattttatcttatttatttatttattttgagatggagtctcactctgttgcccaggctggagtgcaatggcatgatcttggctcactgcaacctccacctcctgggttcaaacaatttctagctaatttttgtattttttagtagagatggggtttcaccatgttggccaggctggtcttgaactcctgacctcaggtgatctgctcaccttggcctttattctattttttgtagagacagggtctcactatgtttcccagactgttcaactcttggccttaagtgatc

SEQ ID NO: 104556 - DNA, 1073 bp, Homo sapiens
ataagacatcatccctgtctccaaggatcttaggtctataaaatgcaattcctgctctcagggagcatactgtctagttacgtcactatattagtcagcagtttttcagtggcaaatgacagaaacccaactcgagctggcttaaataaattagaaaaaaataaagaggctagggtttatcggctcacttaatttgaaagtcaggagtatttggcttcgggcatggacagatccagatgttcaaatcacgccatgaagaatctgtctctctccatttcttggttcctctgtgctcgctcattttaaatccacttctgtcttcaaggtgacaaataaggctactagtagatctaatttacattgtttcagcttagcagtgcttgtggaaaaagaataattccagcaaacgttccagggctgagccagattggcccagcttggtcaagtgtccacctcttaattaatcatggtgactctgtctaaggcccgagccacatgcctatccctggaaccacacatggactgatagtggagaaaggccaattccctcaaagataaatcaagtgtgagcactggaagaggggtagcatgggcaagacaagcgccaacagaagttttcccctgggcagtctgagcactaatatgtgcgggctggaaatgccatggaaacccggagcagcagagggggctgccagcttagttgggaagcgaggcttgagctgggcagggtgttaccaggtgggaggtatgagagagcatcctgaatggagaggaagatcatgggcaaagacacagcggtgagaaagacacatctggcttgagtgtggcatccacataggggagcagcatgaggagaggagaggaaggaattatgggggccacagtatgctgggtcaaagaatttcgactttaatcagcagcagttggatactgctatgactgttatcattattacagaaaaatagctaacattttacatgcattatataatttgatactcacaacaatcttgtggagtaggtaccattattcatattgtataggtgagatcaagctgagcttcaaagaggaaa

SEQ ID NO: 104557 - DNA, 1046 bp, Homo sapiens
ctgcctcccgggttcaagcagttctcctgcctcagcctcctgagtagctgggattacaggcacgcgccaccacgccaggctaatttttttgtatttttagtagagatggggtttcaccatgttggccaggctggttttgaactcccaacctcaagtgatctgcccaccttggcctcccaaagtgctaggattacaggtgtgagccaccacgcctggcccctagatatattttaactaagaattcgcagtattttaaagactgtgtttttattaaccctaacagcatccagatacatttaaagaggtaccacaagtatgtgggagtcactgatttcttccttctgggataatatttgggtgcatgtgtacaagaggagctgtacgcagattcctagaaggattaggatgtggaagcaattaaattccctctaggagttggtctgaaagctcaacacttttaaggaaggaacatgagtatttttccttccttctacttggttactctgtgtagctgggaaagcttcctgctctaactttcctgcctcctgtttctgttgctaccagaagctctgactggctggggtgagctttgctaaaggttggtaggtgagtttatgagagcggacccttattttagggaagcgtgatttgatatgggtatgacttgctggagctaacttctaaacctcactctcaagttctagaagctcacttaccaagcccagtgcattaactactacacgtccctgtgtcacacatggcttctcttatgcctcctttgctctgtgcgctgttggccatatggactgtgaaagcagaggcctagagccatgtggaccaagaaacgtcatctcattctgccctctaaaacagcactccccaacctttttggcaccagggactggtttcatggaaaacaatttttccacggcagggtggagaaaatggtttcagatgaaactgttccacctcagatcatgaggcattagattctctgcaaccccagtccctcacatgcggagttcacaatagggttcgagctccta

SEQ ID NO: 104558 - DNA, 1045 bp, Homo sapiens
cacccagtacagctggtactgaggcacagggcaagggctacagtccatacataggagacatgaggtctagcctggaaggcacatttggagaccagatgtgtcacagctgcatgattggtactacacataagaagagcttggtacagaacaggagtttgagtccctataaaaggaggaaatgggctggttcacactcttgctatccgctttccaaatgtttttagaaaacaatactacaggatattttagaaaagctcctttgcatggtctgtaccacatggaaagtctttaactggtgtcaagcatctctggaatgcacacaagcaccctagttaagatcagcttcccaaatcatagttcagttcatgaaagggcatcttgctatgcccaggttctgcctgttagctctgaaagcagcggctctggcttgtgctcaagaatgtttggctcttctccctagatcaggtgacctctgcccagccaggtcaccatcttcagcatacactgttcttagcaaggaaactgctggggacaacaaagcagtgtggattaaaaaataaaaaagtaatggcgactgtttatgctttctacttctgcctgtatctgcagggctgatcaaaaggcagcagtgagatagaaaaattttatctttctctttgcttcatcggcctgctaggtagagggaatttacttgctagtatttcataatcagttgataaaatagctctaaaaactttatctgtacaagtatttcagactgctacattatgagcaagtcatgtggctaaaaatgatcataaatgggggaaaaggagggggtggaaggggatcaattctaatggaaacggaaagattctatcagccaccagcctgctgcattttagaacgctgagattattttgagtcttctggcttaatgtcaagcaatgccagaaagtccttttccatttccacctgcaaatttctcttctttgaaatacatcccagagattggggtagtctcttagaaagtcaccttccctgcaacctcgctgaaatcagttgt

SEQ ID NO: 104559 - DNA, 1739 bp, Homo sapiens
gtcctcggcagggcctgccctccccggctgctgcagtcttcccctagcccacctgacgctcactgggcttggtacagtgcagctcttacctccctctcctgcttttccttgccctgtgagaatcactgctccattggcaatggtgtgtctgacacgttgagccagatgagttgagagaccccttgtgcagctactgataatgactttattagcacagcactacagcgcctgtctctgtagtcactaaaagtgggtcagaactctccaggggcgtgggagggtcaggtaaatgaggctgttttaaattcctgggaaagccactccaattacaggtgccgtgttccccctccccctgggaagtgctgttttgctggcatgcgtcaccctctctgcacagccccagaacactgctaagcaattgtatcttaagagaacagagactgccccagctagggaaaagggtgccgcaaaactgggtcaggcccttccatggagttccaggttctgagtgggctgtttcttagagggtctggactagaccttgcacttgggctagaacagaggttctcatctctttaaagcttttgcttaattttccatctcccacctcatgggcctccttttttaaaagactttccctgccagacagactccatttattattcatcaaaagatagtatgcagtaaatagcactaaaaagcaaatgaagcatgtttgaaaaggttgatgttttagtttctgtgatgtgatggcatatgaaggaatgaatctttatgtggccatttggagacattggctacagcctcagggctcttcgtttacctttactggcttcctggacagccacaccaggagcccagcacttagaggaccctaatgtgggcagggggctctgggtcaccctggcctcagcatccgtttctgttcctcactctcacattgggtcagagccccccccccgcccccgccccccgagtagggggtccacaggctgagtggtggagggagaggtggtaggagctgctggagatggaatacgaatgtcccagattatctgggattcaaaacctatggtctgtaaccaaggaccttgtgtagttgttgccccagaataactcttggcattttattttttaaatactttaaattctaaatctgagttaatgtccatttcttctcacttttctccaacagtgttgggatctggtgcaacaaacacaaaactacctgaagctgctgctttccttagttaacagtgatggtgagtctgtctcctccagagccctcgagccactgcacccttggggagttcccagttcattctgcctcaactgtatgtttgttggagttgcacaccttacttttgtgctgtgggagaggaatttggggagttcctagaatcccagaggctgggtgggatttgtccattggtggctttattccatgtcctcaaaatcctagaaaacaaaattaagaactccttaccatctatgccgtgcacagggtattttcacactgtctcagcattgcacaacagcattgtgtgtggggccaggatgggcctctcattcagaaagatgaggcatgagatgagagaatcaatccgggctgctcagtggatgcacacagcctgtagaggccctgttctccagagtcctccacccagtttggctgttttgattggatgggcctggcttgctcaatgtctctagggcagacggactctaaatccctggta

SEQ ID NO: 104560 - DNA, 1325 bp, Homo sapiens
gcagaaactagagggtggggaaggtagtactagcatgtggttagagttggccagggatagtcagtgtcctgcaattcatgcagccctgcacactgaaaaattgcccactcccgctaccccccaaaaaaatacttgtcgtgccctctgagaaactgggtagggatgtcatccctgcctaaatgacctgggcaaagtggactgtgtaggctgcactgtgtccccagaagtacactgagaactatagtcagaaggaagaaaggaagctacaaagccagacgcctgccactcacccctttctgggactaggctggagaagagccatggggaggccactggggaagacagaagctggtggggcctggctccctccaccaggccaagctggtggtacttcctgctcatcggcccatgtctggttctctcctgggcatcctctcctgcggttcctgagtagatgacagcgggctgctggtacactgtatctcaggctgggatcggacccccctcttcatctccctcctgcgcctttccttgtgggctgtgagtatgaatcggcccctaccaagctctgctctttgggtgtgttaggattgtctccagacagagggtggagcaggggatgccatcgctcagagcagatgtgtttaaccctgtccttccgggtgttcttcagcctgcgttgtcactgggtctggttatggttcagctcctggggatgagaagagggctctgtcacatctcctgtggtctcttccaggatgggctcatccacacgtccctgaagcccactgagatcctctacctcactgtggcctatgactggttcctcttcgggtaagcctttgcaggagttgggttttggggccttagtaacagtttctatatgtgagttgtgtggtggctcccttgacaggggctggaggtaaggataattccacccctcgagaaggaccgaagctgctgatcaggccccacctgccacgctggtgccagtgacacagtctgtgtctggtgaccctgtcctcttggccttgtcatcttggtgctgctgactttgcctctctaccctccttttttcaggcacatgttggtagatcggctcagcaaaggggaggaggtgagtataccacctacgacttgtgggcacagctcagcactgaaagaggggcagtgggtagcctgtctgagttccacgtgttaggggcagctccttgccccaggtgtgcagggatgtggccccctgtcatctcctcctgaggcagcgtggcaggacaggcaccagcacagtagctctgtgttctgggcctcgcgggcctgtgctgtgg

SEQ ID NO: 104561 - DNA, 2607 bp, Homo sapiens
gcctccctgcttgttgggctggtgctccctcctgccttcgctctgaggccagggtaggggtccctgctgaaggccactggtgaagaggctcttctgcagggaaggccatgtgggggtcaacttggagtcacactagcagacaggctttgggacagacgagtggtctctcatgaccaagaaaacaggtgtgttgctgcagggagaagccagcccaggagtaggaggactcttaactcccagtgtgcccaagctgactcttgtcctccatggcctacagcaggaagtgtggctgaacactgcagccccctacaaaagggcagaagtctgcttccggcctgggaaatgcaagagtcttggctggcaactgccttaggacccctgtaagagttggggtcttgcctgagttggtttgccttcctaatccgagctacaagcatgttgggccacacttgaacgctcagggcacaagctgatgaggaggatgcagaccttgctgccctcagaaatcttcacctgtgtgttggacagagccttgcagcgtgggtcccagaagtggccctggtgtcttataacactccctaggctaggacccgtctccacaagttgccagtgaattgagctgctttccaggacaggcaggattgggaacgggggacacaataagaccccagatagatctggaatttactgctccggcttccatttctaggaggaagagtttgccagcccgggatggaggcttcaccctggaagacatctgcatgctgagtgagtcctgggccccaacagacttcccttcctccatacatcttcccgtgtacagatcaggcaggaactgtttgtgctaagaggttttttgtttttttttttttcttcccagttatgtggtatagaaaaggtgggggaccagtagtgggagaaggtaacacgctgactgatggcactggcttcttttaggacgaaaggaccgtggcagcaccaccagccttggcagcgacttctccctggtcatggagagttccccaggagccactgggagcttcacctatgaggccgtggagctggtcccagcaggagcgccaactcaggcagcttggtaaggggccagacttggaccaaggtcactcacagctgtggcccggggccatcagcaccagggagccaggctggagccccaagaacaaagcaggcccccaagagaagagctgagaggatagctccgtgctcctgctgtctctactgggcctcagaagtcagccatctggttggtgaagggcactgcctgtggtggcccaggaacataaagggctagggctccctgtgggacagagaagcagctgggcagggtagggcaggggtctggggaggctggtattggaggagctccattttatcatttgtcggggagatagggggccattttggaaaaagaaaaccaaaaggtaggtgtaagttgatggggaattgggaacttgagggtcagctcctttgagaatctcatgaaattgagaccctgatgactttcaccctggacagatggctcaagatgttgcataacaaagtcctgagtggtggcttatatttataatcccagcactttgggaggccaaggcaggaggatcacttgagcccaggagtttgagatcagtctgggcagcataatgagaccccgtcttttagagggggaaaaaagattttgcataacatatggaggtgggcagtgactgaagagtgaggaatcattttctagcacatacttcaagaccagtaggctggtgtgatttggatgccacaggccctccataaagacccagccctgctgcccatggccctgagctggagagagtgctaatgtttgccaactcatgtgatgttttcccagtggaagtaaagcctaggcctgaaattcagtgagggtgggcagagggctttgcctgcagtggcccccggctcacagccctgctccttccactgcaggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccaggtgaggagctccaaagcccttgctgttggaagtgcctagctttcccccttaataagactggagggtcgggggccagcacctgagctagggtctcaagatggggttcctaagcttgcaggcccagtatttggaggatgggttagtgtttggtaataaagcaagggctgatttgtagagtggtttgagactccttcctcgaaccctagcataatgcaggggaacccagaagtgccgtggctgttatgtgataggtggggaatagggactgcctccacttgttacctttggcagatcccagcctcctaggcgcacctcccattgtgattgaagagatagatctagattctgagtcccttctggctcccacatctaaagtctgaattggtggggcagtgagaacagtgttagggagctgagctacatgtgtgtggctgggacaaacgatggtga

SEQ ID NO: 104562 - DNA, 1150 bp, Homo sapiens
agaatgggcatgagctttggcatccatcccaggttcaagtcaagctctgccacatgtccatgtgattttcagactcagtttagtccttggtagtaataggtctgttaagaagaaaaacattctgaaacttctggaaccttcctcccatcacccctctatggtttttccctctgggcaaaaacaggcaatgaaggaagttggggaagaacatcctctgcacataggcagagcagataagcgggaggcaagtgggcgttccagactgcactgcccacaggggccccatgtgctcacccctgcgtgaactcttcagctcagaacactgcctgagtgctggagctgagcctgtgaaaccaccgccacacgccgtctggccccatgggaggtgtggtggaagtggtggggcagagatggggccagacagacaagcccatgtgccggtgccccgtcccatcctgtgtgtgcatgcctgctgccgcaccacccttgtctgtgcccagctgtcctcagggccactctgaggctgcagtggcactgtttgaccctcactgttctaggctgtggctctaggtcatggttcctgcccccttttctgcctgtccagcattgctgaacaactagggaggaaaccagaggttcctcttgtcctctgggtcctgcctcagtcttaactgcccagaatgcagtgagctcccaagctgaggcagcaccccatcacccgttaccacaccctggctctccatctcctgcctgccaaaagatcccactttccaatcctgtgatagtgtccctcagtctcacaggtgactttctgcttgcagggcgtgtctcaggctcttgtagccagtccaggatggccaccaaggccccctcttgggaggctgaggagaattggggttgtcctcctgacctcagagccctgcacatgggggcttggccaagcttgggatagctggaccaagatgggtgcaaggctttgaaaggtgtggggtgggcagctgtgaggtgtttgatctttccgctggtctgtttgggggatgcctgtctggagccagacttcttctgacttggatgcctgttggtcagaggttttgaaagtctagattactcagatttggagcattctaattatgtatttccattaccatta

SEQ ID NO: 104563 - DNA, 1106 bp, Homo sapiens
tctgatgggactcctgggttctgtgttgcccaccctgcaaatctgcatgccagcaagtatgggtgacccggctggctgctgggtcaccttcatttgggtgctagccttgctgccttcctttggtgctgttgagattgtccttgccgtgttcactcccagcgcaggcatgccctggccccaggctgtggctccgattcactcttactgccatgctttgttctcattttttgcttccacagtaagtctgcacaaaatactgtcctcacagctgagcttacctggtgatctattcttttttctcggtcactacttgtccagcttttttttttagacttttggagacagtgattgacaacagaacctagcagccagggctgcgctagtcccctagccccctccagagcctgtgtcaggcatatgactgactgcatcctctcccctctctctcctctctgccccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgtaagtgtcttgcttgagaaggcaggatgctcccctgcccatgggaaaagctggtgagcagtcaggagtgctgggtaggaatgaggctggcgctcaggagctggcctggcctcctgccctcccctctctcagctgctggacccgaggtatgaaggaggcctgtggctggtcaggaagtgcactggtttgtgtgttcactctgcagcctctaaaacccatccactggtgtctcaggtgcacccaaagggaaagctgctggactgtaactatagaagattctatttctgtataagcctttgcctgacatgagaatcgtttgaaggcagaacagtgggatagtgaaggtaggtgtatggtggaggccagagccagagtggtgctgggttagcccgaagctttgctcctgagcagaacctagggttacttgctgtctctacccgccttgtcttctgtttttgcctctgggcaggaataagaattggatgggga

SEQ ID NO: 104564 - DNA, 1020 bp, Homo sapiens
ggggctgaggtgggaggatggcttgaggctacagtgagcgctgattgtgtcactgcattccagcctgggcaatagagtgagaccttgtctcaagaaaaaaaaaaaaaaggttagtgtcccagtaaaagctcctgctctaggtgggaacagtagcctgagggcttagaggaatggtttaagggaaaacagggccagatatttggggcctgaaccacaaggatagcatggccgtaggacagacactggccttgtacagtcagaagaagcacaaggacaggtggtatggagggagggaggatgaggatactgggtcctgtcccagggtaatgtctttgttctttctcttgacctccccataggcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagccactcttgtgtcatcatttggttattgtctttgtggagctactaggaaggttctcattg

SEQ ID NO: 104565 - DNA, 1028 bp, Homo sapiens
ctcccccacccagccccaccccacaccggttccactcttttcccaggtacaacgtggactccaaaaccaacatctccaaaccggtgagcaaacgtttcctcgagggttggcggagcgcacaggaggcacttagatgtgttcaacgactctcagaactcctcccaaccctcgacccagaccccatcttcttcaggcccccaacccaccctcctggtccctctcctcctgcctgagtgtcctgcctgtgccccctactcactgttcctcttccttcttggctgccactgctgggacctgcagaaggtgaggctgaatggggctgggcagaggttgggggtgggggtggtattgtggagaacaggcttggactgatgacccactacaaggcagagattgctcgcagaccccttctttcacaccccctccattaaagcccatgtagggccgtggctcttgcaccactcattcgcctgggaactgccctggtcctgtgcaggagcatcactggggctaggctgggactcagcactcaagagcttctggtcttgctgactccttgtcctgcataggatttcctgggacaagcgttcctggccctgggagaggtgattggaggccagggcagccgagtagagcgaaccctcacgtaagctgaataggaaggggtgtgggagtggggtgggggcttccaaattctccctcccaaggatgccgctgactgatagaagtggaggctggggttgcccctggtcaggagcctgccccggctcccatcaccctcgtagaaaagtccaatttccagtgctctgcccgagtcagtatcaggcctgatatgtcttttcttttcttttttttttttctctctctctctctgtttctctctctctctcctcactctttttctaagtctgattcagcctttaaggtccacttccaagcccctctccacagggaagctcccccggactaagtcaaatcctcaggaattaccattacatccactcactaaatatgcattagcatgtttt

SEQ ID NO: 104566 - DNA, 1022 bp, Homo sapiens
tctctggcaactccagttgggagaactgacagtgcattgcttcccagcaggcatcctggggcaacagtgtatctttcggggctgcccgggctagtggcaggcggggagccttgtttcacttgttacacttccacaaaggggaaacgccgccgcatccggagagtgggctgcgggcactgccggggcccagccctatccctccggcccccgccccttacttcctccagccccctgagcttcaggggcagatgcagccgccattctccttgggccctccccacgggctttctggtctaagttctcgtctccctcgcctgtgcctctgctgccgggttccaaggggagattgctgattcgctgtgctactttgggaaccattcacccgggacccagcttggaaagaggagagcttgtttgtgcttcggttggtttatgtttaaagacacagccgcaggtaggaaatagaagagttgcagttggacgtgtagcgttactgatgtgaaaatcaggagccgttgacagtggagctggagcagcccacttgcctggttaaggcacaggtggagaggccaagaggggttattttgtcagggagctcatgatagccctgcctggctgggatggtgccaagcccctagctgaatggttgaactcaactaggccgagagaaattggggcagtctctgaccaagctgggcttcctgaggcctggtgccatctgctgtctacactcacccaggaatgttggggagcggggagggagggcccctgcggaccagcatggagctgagcatgcctagattgtcgcgttcgtgtttgtacccttagggcctggcacttggtagtcactcagttgatgtgtgagtgggtgaacagctcaaatgtaatacaagctgctgtcactgactaaatgacctcagttttcactttgtttcacagtacatctcctacccagtaccagggccaggctccccataaagacctcaaaagtaaatgaattctttctgtgatccagtgatttc

SEQ ID NO: 104567 - DNA, 2473 bp, Homo sapiens
gtaaaactgaggtttagtacagcagtgatgtcctaaaagtcataaaatggcagaggcaggatttaaatctggtttgcttagaagccaaagccccatcccttcctttgtaccctgtagtttacagtgccagagtctaggccacctatagcatgccaggcaaggagcaccttctctgtgtgacaagcaccgagagcagccctcaattccaggcctgttggcatagtaagtgatacaggttggacattaagagcactgggctggaggttgaatgcctctgcctctgccactcccttgttatgtgacctatctatgttttgattaacttctcaaagcttaagttttcttatctgcaaaatgaggacaacaagaacactaactctatggctgtggtaagaataaatgtaatagttaagcacaatgcctggctcataggaaatcctcagtaaaccttagctattataattgttatctcccaaggctatccagtgaacaaacatagcacctagagtttgacggagccttgagctgatgctgacactagctgagagaagatccatggcagctctagtcgaggccctgcccaccagtgctaaaacaacttatatgtaatttgtcaatgacatccaatgaccttccttcttccccgattcttcgtaccatcatctggaccactctaaggggtactagctgccccaccttcctccttttagaggaggctggctgagcctctgcaaccccaagaagatggtgtcacatatagcagctaggacatgagctttgcagtggcagacctgggttcacatcccagctccaccactttctcacaagtgagctggggccaggtgattaaccttccaagccttaggtttccttttcagcaaaatagaaacgatgatagtacctataatatctggagttaaggtgaggatgaaatgagacaacacatctgaagggcataggcacagagtaagtgctcaatggcaaatgacccatcatctttaagggagggaaatctcaaccatgtgatgctgagttccctgtttgtaccgtaggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggccgtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggtatgtggggagccggtggacaggcagatgagggagaaaggagcctccaggagaggagctggcagcctcctgagtggaatggcagggctgggctatcttcccaggagctgcatagaagttaaaaagaacatattttcaaaacagatagttgtctttagcaggtcacctgactttcacattaagagccagaaatgtcagcttttatctggcatagctaacaggcgttttggaactgcccttcattttgatggtgtggtttgttaagttgggatggaagaggatggaactgccactggcagcaatggaaaaaatggtctgaatatgaagaaacaaatagaatgaaaagcggggaaggggaagctcaagaagttgtgaagtggttactgctgctcatttgggctgtgatggccagggatttttttagttctcttgtgccgtttatttgatttactatatatttc

SEQ ID NO: 104568 - DNA, 1427 bp, Homo sapiens
tcaaatagtactctgggctgcagtgactagagcagtcttaggggcagaagtccctgattgctggtgtacagggttagggatctggtttagtgctgggagcttggtttcctgtctgccacggtaccactgatggcaccactctttcttccttgccttaagtccagagtcccaggccttttggacaagagatcctctcccttcatccccattcaggaactttcactggccagagacccttgctctgcttaagagaatcagggcccaacaagttttactctttgtttcctgcctcccaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttggggtactgtgtccagttccctgtgggctctgggaactagcgccagggggacgaaaaccaaaatttgcaactgtagtttccagtgtcagagggcttagactctttcctcctttaagctagccctcaaaccaggatcagcatggaatgttcaatgaaaagatgttgttcctatgtgtttatgtattcattcaacaaacacataccaagcatttattctgccaggccttggggacacacagattgaggcactaccaataaattactgtgctccctcttttggcttgacctgagtttcctgggctctcttctccctgttgacctttcctctggctttctaatcatcctctgatcttcgttttgcctctacagagagattctgaggataagaactgggcccttaaagaacagctcaagtcctggcagcggctccggcatgacttggagcgagctcggctgctcgtggaattgatccgcaagcgggaaaaactcaaaagggagacggtgagtgctcctgggccagccctattttataaaagaaaaaacaaaaaattagccaggcatggtggcaggcgcctgtagtcccagctactcgggaggctgaggcaggagaatggcgtgaacctgggaggaggggtttgcagtgagccaagatcgtgccactgtactccagcctgggcgacagagcgagactccgtctcaaaaaaaaaaaaaaaaaaaagacccaggagaaggaatagcgtgtgtaccccagccagatagcagcagggctgacgctggagtcaggtctcctggtgctcggtgtgcttttagttctgctggaagcagaatgtcacaggagcgtatgaacagaatcctcagttatgtgacataggtagctggtgctggtagttcaagaaagggggaagccagaattgttggtgcaagtttccctgggtggagcctcatagaaggtagacctgtatgagtacacc

SEQ ID NO: 104569 - DNA, 1741 bp, Homo sapiens
actaaagcctcatatagtctagaaagtatatttggctctactttcatcattttccaggagaggaaaagtaggcccagagaggttaagagacttgccaaagtcacacagcttgtgactggtaaagtcaggaccagaatccagctttcctttcccctgtgctatatgcctgcctctaactgtggtgggaggaggttgctggatgtgtttcaggggggcttgttaggagcagggttcggggcaataaggaggatatctccacttaaaacaaacctgccctgcccttccaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatggtgggtgatatatcacacacacatataagaggccaatgccggggatggacagctttccaaaagtcccctcctgggagcaggcagtgtaggcagaaagcagctaggctgagcagtggcaagctatccccaggaatgctccccaagaagccagactgggtgaatggatagcagtgcccgccattccacatcttggtgctgctattttacagctgttcctggtgagaagcccaggggggatgagtgggtttcttgctgcctgcccaggttcaaggggccctgagggctgccctgagtctgacctttcccctccaaccctacccctagcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggtctgaatcccatggcaaggtggaccccaaagcaagtcagactttggctctgcagcacacactcaacccctgccattccccaggcagaggtccctcctacacagctagctgtactttctccctcattccccaatcaggggcctcttagctgcctctctggctatttgtataagagttaatcttccaaattccaagcccctaaaatgatctccccaacgttagctggagtaatggtcctatatgcccagggcatgaccctggatatctacccttctcaaatcaggcccctcaccaactctccttctttctttctctgctccaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccc

SEQ ID NO: 104570 - DNA, 1038 bp, Homo sapiens
accccacttccaacagggaaacctacacaggcccaagagccctggaagggcatcccctgaggttggcctcgatctggagggctggtacctggtccggtctgaagcagcgctgctactgctactgctgctggactcagagtctgagctgctccggggaaggctgcagtcattacggtataccaagaaactcttcttcactggttggtttccaccgctgaagccattggctggtaagtcttggttgaagggaaggggaggagggaaggaaccggtcaggaagatgtagatcagagatgacatggaggtaagagggacttggagcttgggttccccttctgtgctggaaaattcctccaaccttggccagcagagctagctctgggcagtgtctaccacagttggccacagccctgctccaccccttgcttccctcggcagttactggctttaggacacaaatggcttaaagggcaggagatccccaaggaaggtgagaagagaaaaggtaaagtgatacaatggaggcagggggccctggatgggactttagctgggtcgtagtgtctctgggcctcagttttcccaactgtaagatgagtgagtggagttaaaggattcctaaggacccttctagctcgctcttttatgggcaaataaaggggtaactgggagtatgctgggaagaatggcagctttgctcactctcttggggggctgggtgatggtaaggctcacccattggggggtcttctgtggacttatcactgtcgctgtctgagctcgaactgggccgggggctcctaccccgcttgcgctgacgcagggaactcatgatggggagctgggggggccccacaggactgcctccgtggctgggggtcatctggctctcccggtttttggggggccggcccggcctcttgggcggtccagctgtcttcgggttctttttggagaacagaactgaggttctcctgcccacctcatgtgcgggggttgaggacatgttgggacccaggcctggagcagagaaagaaa

SEQ ID NO: 104571 - DNA, 1878 bp, Homo sapiens
cagccctgtgtggtatgggggcagactgccaggaaactccagcaacaggcagactgggctatcacaagtcagtgggggagggacttagaacagttttttgagcgaaagggttgtgtcgaccatgtgtctgagaggctgagtgggcactagtggacacagctatagctagaaaccaaaggaccatcagagacttatgacaaatatagaggtggctcccacccagactcagatggcttctagacttagttttcccacctctgcctccacagtgacaaaatgaggataaagcaggcataaacattcaggctctgaatccctgttctgtcacatttacacatgtagtctttttgttaattgtctgcagaggatattcaatgtcagtaaagtctgcctagagcctatggcacagggtagctatttctggtgaggtcagggtgcctcctttttgtacccataaataccctgtgattaccctcccgccgccaccacacagtataactgttgactgggctctttcatctctagaccatgaacagtcctttgagggcagggaccatcacagagtctggccagagtgggtgcttgggtggtgtgtttgagtgaatagaggaggaaggctggtccttgttctccctgagatgatttatttgatcttcaccttatcctataggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaattctttgttcttgccccctgccagggcaaaggggatacaaagggaggttctgtgccccagggatgatacataattgggcccaagtggttgctgactgctgtgcatgctacatttcataagacacagcaaagagagcccctgttgcccatgcatggagtgagtggcaggccctgtgttgagcacctttagacattcagctttgcgtaatccttgcaataactatagggtagtttaataatagactggttatctccacaaagatgctgaagtttcaaaaaattatcttgcctaagttcctacaactaggaaggtgcagagctagaattggaacccaggtctgtttgcaaacctggctctt

SEQ ID NO: 104572 - DNA, 1052 bp, Homo sapiens
ggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtgagtgactgagcctgagaagcctgtcccctcggactggctcctgccgcctcaacactgcctggcatggggtacaaaggaatttgggggatgatggaagaaacccggggtacaaaagaggaaacaagcacgggtagccaacctgttacctttaatatgtctgtacagtgataattgtaaggatccagcggtataaccgatgcagaagataatagcacttgtttttctttttttgagacagggtctcgctctgttgcccaggtaggaatgcagagaggcccattccagcctcgaccccccgggcgcagcctcccgagtagctgggacta

SEQ ID NO: 104573 - DNA, 1120 bp, Homo sapiens
ggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgagtacaggacctgggctggggttagggttcttggacataagtcacttctctatgactcagttttgccacctgtaaaatggggattatatctacttcataggcttttatgaggatttaaggaactaatacatgtaaagtgcttagaataatgccaggcacatagtaagtattattaccattattattatcctgctaatcaccatagtgaagtgacaaggattttgagcccattcctggttgtgtgacctagggcaagtgatttcattcattctgtaaatatatacaaagcatctgctgtgtgaccggggatacaccagtgaacaaaacagacccaaatgccagtcctcatggagcttacattgtggcctctttatctgtggaatgggatggtaactcagccctcacaagatgctatgaggaatgagaggtctggtgttgctttctctaacggtgctgactctcattctcctgggatcctcctggagttttggtacctaggatctgacctgtgggtgggaagaggccacacccaacagcaggtacctctcctaccccctgcatttctggtctccaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggtgagtaggtgggtcccctgcccccaggccttccatcagctttcaagatctgttcatttctcccctggttaccttctcaaggcttcctgccttcccaaacacttcccctatccagaaccgccctgcctggtctgatcaactccagttactcatcctccctatgcatccctaaaatgtcagcacctca

SEQ ID NO: 104574 - DNA, 1070 bp, Homo sapiens
ccacagcaggcctagcacactgcctggtgcgttgcagacgcttcacaaaccttagctgttcattaccatcattgagtgttaatcatttctcttctgtgttcctttttcttcacatcagtacgaaaataaaagggatttctagaatgatcaaagcaatttgggattggtatgggaaggcttcccacggtaggtgggatgggaaagataaaaggatatttctggtgtttgaagactgtcagtgtaggtcagaaaggagcaggaaagtggaacagctatttttccttccactcatttttgtggtcttctaggaaaatattatttcccctatggaggattctcctattcctgacatgtctgggaaagaatcaggggctgacggggcaagcacctcccctcgcaatcagaacaagcccttcaggtgagtggtgtcctatccacaacccacagtctggcccccgcttctgttggcttctctccatctcaacctggggaagtcctcatcagtaagaggctgggggcagttaggtgaagcctaatagcagtctcaagtgtgagtgatgacccagcgtgtctgcatgcacagactgagtgcagggttgttcagcacagaactgttcataccataaataacccaaatgtcctgctgaaggggaatggttggctaaattggcataactccatatgatgaaataacttggggctattaatcatatagctgcaagtatagagaaatatagttaaatgacatgaaaagatgtaaattatagagtgacaagtggagaaaatattagttgtagcccagtatggatggtataatactatttttacttaaaatatatttctttttttctttttctttttttttttttgagatggagtctcgctcttgtcgtttaggttggagcgcaatggcgcaatcttggctcactgcaacctccgcctcccaggttcaagcgattctcctgcctcagccaccaagtagctgtgattacaggcgcctgccaccatgtatggctcatttttgtatttttagtagagacggggtttcaccatcttggccgggctggtct

SEQ ID NO: 104575 - DNA, 1043 bp, Homo sapiens
atgtggctttgccgcaggggcgcggggccgagggatgtccgggggttgtggggacacgatgagggtgggaaaaagagacggggcgggggcccgaggtgaggaaggggcgagtgggggtactccctggtatgaagtgggccttgtggcttcacggtcagccttcgaagcaggtaggggcttttcctgagccctgtaggaacccggaagtggggtctcctaggctctttggagcatttcgagggtacgtagtcggcctcttagcctctgaggcatgaagcaagtccacctgcctatccacagtggaacttcacgacatacgccctttgtcctcttctgccttcctgaccctacagttgcttaaggcaggcggccacacttccttatcccattcttggtacctccagccctgcttccaccccattggaggatctctcgtgttgcttccattcaggcccttcctggtcagaactgaactgtgtcagccttagtgtatgttagctgtgatactgctcatccctcccttcctggaagtcctccctttttcatacatgtgggcctttttcatacatgtgggcctttttcatacgtgtgggcattcctgggagttgtgactttggatgaccatctccctcttcgtcacaccttccctggtgataccgatctagtctcctggcttcgataactttcttcattctgatgactcctaatctggcttctcagctctctttcaaggtttgcctggatatcttgaagagaccttgaaattagacctctagttcaaaactcatattctattctaaatttgttcttcctcctgggttccctatcctggcaaacttttgtgacctcatgtctctgctaaaaatctgtattttttttttctagtggggcacatgcctcttgatttttaaaagttcaagtttattgaggtattacatgagactacatctgttttattcatgaaaggacaggcgtcacggagccagtcaccctttttaggtttactttctataactgttgacaaaggccaggcgtggtggctc

SEQ ID NO: 104576 - DNA, 1103 bp, Homo sapiens
acaatcatgcattcactggtgtgtctctagatcactttctcaaccttagcactattgatatttgagtctcgataattctttgtagtgcattgtagtatgtttagtggatatctgtccactgaatgcctgcagttccccttcttgccaagtcatgacaattgaaaatgtctcagcattcctctggtctgaccccaggttaaaaaagaaagaaaggaaatgtctcgacattaccaaatgtaccctggcaggcaaaattgtctcctgttgaaaactaccactctacaccttggaaggcgtctcgaaggcctagtctgttctgttcacagtagtgtcttaagagccttgcaccctcagtgctacctggcttcatgggagctggaataggggatcggtgggtttggcgtgacagattttgatcttccctttcctctgtgttatttcctatagactgccactctccgcccctacctgagtgccgtgcgggccacattgcaggctgccctctgcctggagaacttctcctcccaggttgtggaacgacacaacaagccggaagtggaagtcaggtagggaaggacaagtcaaggtggggatgaggggtgcagcacacagagatggctgctgtctagaaggtgccatgaacttatgtcctgcagtagtcaggaaagctgcagttgacattttgtcttgctgccagctgaatggtgattcccaatttggagttaagaaaatagggtcagtgggttggcaggacagaacccaggggaaaagacaagattggttaacacaaggtatgacttctcagagcagggctgttgatgaagtctctcctgtggcattgttgaaaacactggtagtttaaggaatggtcagataattgttatctgagattccatctccatacttttcttttttttttttttttttcccatctccatacttttctaatgtaatgatcagggattttttttttacctaccagcctagacactctgaccccctaatccaaatacttcatattttgaatgattttctcttatctagtttccatttcataaatatctttttcccctttaaaatttaatctggaggcctggtgcagt

SEQ ID NO: 104577 - DNA, 1388 bp, Homo sapiens
ggtgttaagggcatgctagcaaccagcagcaataatcttcctttagaaatgttgagagttcagggccaggcacagtggctcatgcctgtaatcccagcactttgggagaccaaggcgggtggatcacttgatgtcaggagttcaagaccagcctggccaacatggtaaaaccctgtctctactaaaaatacagaaattagccaggcgtggtggcacgcgcctgtaatcccagctacttgggaggctgaggcaggagaatcgcttgaacccgggaggcagagcttacagtgagtcaaaatcgtaccactgcactccagcctgggtgacagagcgagattccatctcagaaaaaaaaaaaaaaaaaaaaaaaaagaaatgttgagcattcagaagggagaaacttcagggattgttggatgttcagtgttattaaagcagagaccacctaaggttatctctgatagcccaggtgatgctgcaaaacaccctgggaaatgtgacactagtgaaatgagaatggaaagggcagcttggagtacagctgtagactctgaaagaagcaatagaagcctgtcagaattacctctctggaatgggtcgtcattaagagatgccccaaggtagacccttgtttcagttgacagccaggtcccccacttcagtgatccttccgagtaccaaacctcactgtctcctgggagccttgaaaaaactggagtcagaagaccaggctacaaggtgtttttggccttgggtgtcagctttagagaaacatttctctcttgcactccccaggctgatgagatcgagaagattttgtgccacaagttcatgcgcttcatgatgatgcgagcagagaacttctttatccttcgaaggaagcctgtggaggtgagaccctgtgacccatgagtttgcgatacccaggaccctgttacagaatggcctgggattgtttctagaaccagctactccagctgtttggcacccactgcctgaattgagagttggccttcatcttggagtgggagcaaagaggattagaagcttaggaaaagttgggtctacctcagccatagaaaaggcaaaaaagagccgggcgtggtggctcatgcctctaatcccaacactttgggaggccgaggtgggtggatcatgaggtcaggagttcaagaccagcctggccaacatggtgaaaccccatctctattaaaaatacaaaaattagctgggcatggtggtgggcgcctgtaatcctagctactcaggaggctgaggcagagaactggttgaacctgggaggcggaggttgtagtgagccaagatcgtgccactgtactgcagcctgggcgacagagcaagactccgtctcaaaaaaaaaaaaaaaa

SEQ ID NO: 104578 - DNA, 2294 bp, Homo sapiens
ttgagtcagctattatcgccatgttagagattaataaactggggctttagaagtaaaagcacctgtccaaagtccctcagccagtaagaggaggaaccagaatgtggagctgggttttcggactcagaggtctaagaaagtaccatagcctttgtcaagggtcacaaattcaggtgcatccaaaggtcgggtagctatggagtgggctgagtatggagtgggcagggtgaggagctgctgagcgcatgcctcatgtgcaggggctggctcccacacagctccaggccattgaacccccaaatttggatttgtatatggcatcttccatgttttcaaggttggcaactaattcatattgttttaaacaccatgtgggccatgcagtgctcatctttgggctagtttcaggcatgggccattggttcacaacctttggtctctaaaatgtgcagggctgtcctaggcagcatgggggacccttgagggcagaaaacatttcaagggcctggcttggttggaggttcatccagagcttgacacaaaagtaccagaacctgggtccttttccacttggccctctgagtccccaggccccttgcatgagagcccccatgcctaaagaaagcaacctcagttcaccaggcaggacgctggcagggctttctagcagcctccatgccagggcacaagggagctgtggagaagctctcatggctcttaatttttctgccttatctagtgctaggcttagggccggtgcccataggtcacttctgaaagctggctgaattagagcatgaccacaaggtgtcctgggacccaactctgcccctcacagatatgagcacagtggcagctctcaggttcatgcacctccttagagcagtgccaccaggatgcaataataaccaccatgcactgcctcttggttctcttgacagttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcatgaggtctatgctgtgtgtgtgtgtgaaaggaggggaggtggggcttcttttccctgagaccagatggctggtaattgtgcctggagctccccactgggtgcagtctcatgattggtcctgccattattcctgccaggggtcccaacccagagactccattcattgcagtccaggcaccattaatttctgaaactgctctgtctgcctatacagagctttggtgcttttcacataaggaacttacttgggctaaaaagtaacctcagagaaacagtgctcccatttggtggataaggaaactgaggttccaaacatgagatgtaatagcttgccccaaatctagccagtgagcaagagagtagacttttgcctgtgccaaaacagtaatcaccatccacaagtggctatttaaattttaattattacaattaaataaagtttaaaatccagttccccagtccca

SEQ ID NO: 104579 - DNA, 1166 bp, Homo sapiens
ttgaacccaggagacggagcttgcagtgagccaagatcacgccactgcactccagcctgggcgacaagagtcagactccatctcaaaaaaaaaaaaaagccatttctgtatgtcaggaatggctgaatattggcagcttcatatgggtcaatctcatgagcccttgggcaagtcacttgccttcctgtgcctcagtttcctcatctgtaaaacagagataaccttagcccctaccacatagaattatggtgaatgaattgacgtggaaagtgcttagagcagggcccagcatgggctgacgctggttattaataattaccccacctcccagagttgtaggaaggagggagagaggtggggtccatgagagagcctgtgtcacaggctgtgtgcccatcagcttggagtcactgtcctgcccctgggcaagtcactgatgaccatgggccagaacaaagtgtgacattcagttgtgcagctttgtcactccttggggacacccttaggggccctgccccctcagcagctatctccataggtgggtctatgtctcagtctttggaatttgccatggtttgatgaggctaatgccaactccttctcacgctgccaccgcctgggggctgacaagcctcataggacaccttaagcagtgacaaagggaggcagaagagagtctttggcctccctaaggccaaaaggaggctgaaaggctggcttgctctctgcccacctgtgccctggaggaagagaaatcttcttgacttacacaaagatgatgtgtgggctagaggccaccttggaagcatcctctccttcctgttcacccaccctgctcagcagggcagggagaggctgccttaggccctgctacccacactggcctctgtgtttctgtctcctcctgtctccccagtcccgcatggtccagaatgagatcccctacttcatctggaccactcggcgggatgtgctcgactgtcgcttcctctccaaggatcagatgataaaccactacgcccgggctggctcctttaccacaaaggtgggctccctagaggagcaggcagggcagcttccgaccccctgcccttgggctggcagctctcctccctgctcaccttgttagtaagaggaagttctcaggacaaggggaagtatacaat

SEQ ID NO: 104580 - DNA, 1019 bp, Homo sapiens
ggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggtaagtactgtggttacctccactctcccacccatttatcctccacccatccgcccttccacctatctgcccttctacctatctattcatccacgcacctactggttcatccacacatctgtgtatgattcacatctacccatctatccatccatccaccagccatccatccactcatccacccacgtattcacccactctctgatctaccgattcacccacccacccttccactcatccttccatcctcccacctgtcacccattgttaatctcgtcattcatctacctgatgtcagctccatactccccatccatctatccactccctgcctacctatccttccacagatccacctacccatctatctacctgctattccattctcccatctactacctatctgttcttcaggccatccactcatccattcttctgtcccaggtacttagacacttgtcttcccatccgtttgttagttgatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattg

SEQ ID NO: 104581 - DNA, 1075 bp, Homo sapiens
accccatctctactaaaaatacaaaaaaattagctgggtgtggtggtgggtgcctgtagtcctagctactcgggaggctgaggcaggagaatggcgtgaacccagaaggcggagcttgcagtgagccgagatcgcgccactgcactccagcctgggcaacagagcgagactgtctcaaagaaaaaacaaacagccagtttttttttttttttttttttaaatcctggattttaagaactaagccagccaggttttcatcaggctgacttttcattaaaatactgttttttttttctttttgctaactataaaatcatattgtcatgtcgaatatactttttcaaattacgctcctgtgtgatattttcctgggccacatcacagattactgaaaagatacttcatgctacggaccacagaaaagtttgtcaggacataggtgtgagtactcctgggagaccttgcctagccccctgcatctggctgtccctgttcctggcactgccccagtggctgctgcctcctccttaaaaaagagaaagttctccatgactggagacactcaagatgctaagatgtcacagagttagcttcccctgaacaggaggctcccgtcctattcagtcagaaggaaagaaatgcgagagtctggatgaggcagccatctggggtattttgtgacttggtttagttcaggacattttctgtcttgtagagaacagggtccctctttgtccatgaaaccctgtccgtgcagcccagttgctgaggcaagctcctaccaaagtacttgctgagccaaccgttcattcattgagcaaacttccagggagtacctgctgagtgccaggtgtggtgcttggggatggggattatagcagagaacaactacagaaaatgttcctgctcttacggagtttacattgtagttaggggattcagacaataaccaaataagcacatgtgttaggtgggggtagatgatgggaagaaaacaagcaagaagaggtgtgatatagaagtgcttgaaaggaattaggctaacattgtttcagccaatattaggcacagatta

SEQ ID NO: 104582 - DNA, 1075 bp, Homo sapiens; identical to SEQ ID NO: 104581

SEQ ID NO: 104583 - DNA, 1075 bp, Homo sapiens; identical to SEQ ID NO: 104581

SEQ ID NO: 104584 - DNA, 1075 bp, Homo sapiens; identical to SEQ ID NO: 104581

SEQ ID NO: 104585 - DNA, 1025 bp, Homo sapiens
agccacccaagtagctggggtcacaggaacccaccacacctggctaatttttgtatttttagtagagacgggatttcaccatgttgcccaggctggtcttgaactcctgacatcaagtgatccacccacctcggcctcccaaagtgctgggattaaaggtgtgaggctgtgtgaatgatgtgtgctccagggaaagtcatagaatatatcagtttccccctctgtaaagtgtggacagaagtatcctaactgatattacagcttaagaaagtaaaagtgttcaagcggcctctgggcgccagcaaaagaggctggggattaatttcctgcgcgctccacaagaggcggggctgggcggggcgggggcgagagggaacgagggcgcctgcgcggagaggagtgaccatagagtcggtcctccagagacagaggggccggaagttctcttcacggagccgcgcggctgcgggggcgcaaatagggtcagtgggccgcttggcggtgtcgttgcggtaccaggtccgcgtgaggggttcgggggttctgggcaggcacaatggcgtctcgagcaggcccgcgagcggccggcaccgacggcagcgactttcagcaccgggagcgcgtcgccatgcactaccagatgaggtatgaagtgaggcgaggagcacggaggctttctcccccgctggagcctgcggggcttggggagcgacgccggcccggcctcagggtcttgctccccagccagcccccgctcacctgccaagtcccctcctcccgtgacggcttcgggcctgtcccccatcctggaaagccccgtggcccccgcgagctccaccccttgttccgcccggtgccttgaggggatccagccccgcgtgggctcccgccctgcgtgggctcccgagtcacgtcgatgctggccccgctgtatcaccttcgaaaccgaatttctaatttgagcctcagcttcctcatctgtagagggagagaataatctgccttttaggttttggtgaaagatt

SEQ ID NO: 104586 - DNA, 1972 bp, Homo sapiens
gcctttttattagtagtattgttgttgttttttttttttatggagatggggtctcattttgttgccaggctggtctcgaactcctgggctcaagcagtcctcctgcttcagcctaccaaagtgcttggattagagttgtgagcccagcctcttctacttttaactctcatagtctttgtgattcatatcccactacccctctccccctaacaatatgttcctgccacacataaccacttgctttcctggaacacaaatacttgggcctttttgtctgcatgctcctgcatgggatgcccatcttcactcattcctgagcctagttcagatatcacctgcctctagatagccatctctgacattccatgccaggcagagttgattcctccttcctgtgatcccatatatctgggaacatatatttactagaactttttcacttcattttctaattactttttcctcctctgttctttgtgtccggcttctaggctgttttattcaaatttgtatcccagtgtccagtacagttgtctggcatatagttggtggtaagaaaaatttgaaagatacttctccctctgctctgccccacagtgtgactctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccacactgtgccttgtgtttggggcttgatagagtgtgaaaggtgtgttgcttgaaaggtgtggccttagacactaggagatgatgggtagaagctccttgagaaacctagcagtggccatagagaagtagactgggtatggggaacctaagtcatagttgtaacctacagctgattggtaagaactatgggccagacatttaatctctccatctatgaaatagtccattctcatttatctaccttaggttatgggctcttcttttagttggatattcacatttatctttcagtgttaactgggtatcagttatgagtctactactgtataatggcatccaaaagaattttaaagtacctcggtttatagggatttacaattcagtagaaacttgttattcatgtgaaacagtgaacataatatctaatgatgtggagcaagt

SEQ ID NO: 104587 - DNA, 1060 bp, Homo sapiens
ctttggctctctgggtatgtcaggtgccaccaaattctgggcttggaacagcttcagctcccacccgctcctccacacacagacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatggtgagcaagtcatcctgtgacagtgcatgtgtacacgtgagtgtgtctggggtgggcatgagggccaggggatctctcaagcagtgctaggcatcctcagtgttctcctggaggacaccagcagaaggacccccaggccagtgtggtctccccagcccctgcttcccagcactgggctttccagaaggaagccaacgccaaagccagccagcccagagcagggggcctcacccagggccttgctcttgggtccttctagggcactgggaagagcctgaagatgaggaaaagtttggaggagcagctgactcaggggtggaggagcctaggaatggtgaggagaacctggctggcccaactgccccatgccaaggcctggcctgccgctcctgggcctgactgacccctgccctgttgcccacagcctctctccaggcccaagtcgtgctctccttccaggcctaccctactgcccgctgcgtcctgctggaggtgcaagtgcctgctgcccttgtgcagtttggtcagtctgtggtatgcaaaataataataatcaccttctaaacctaaaatctataaaactttttcacatgcattatctctttgaggattacaaaagaattaaatttattgaaacccttcagtaccaggcattacagccagtgttttacaggtatcaacttatttaattctcacaacagccatgtgaggtgggactattcttttgattctgatcagcgctgtgggcaagtcccttcagcctgttatgcctcagcttttatgtctgtaaaatggggatgagaatagttctacttcatatgcttg

SEQ ID NO: 104588 - DNA, 1022 bp, Homo sapiens
aaccccggtggcacaaaaacctggtgaggcctcccccttcccaagtccattcccactgtaggccgatgcctgtgcaaaggacgcagtgccatatcagagaggatccttgaagaggactcaccccaagcaagggaaaattggtgggggaacttctgccttcctggtttccttgactttggcctcctcctcttcctccttatcttctccaacctccttcctttatttgttccacagactggaccgcagatcattaccttgaaccacacagacctggttccctgcctctgtattcaggtaggagcagagtctagctgggtgccagaagaggagtgggaagatgatgatgggggtgatccctgccttcctggtctcaccattcttcaaacccttcattgaggtggagactgtggctccctggggtggctggccctcccttgacccttgctgtcctatgccttctgtctattacattccctgaatgctctccctgatcctccacagaactcctgcttattcttcatggccccattcaaatgtcaccttctccttgaaacctttccctactcctccagttctgtctttgtgttcccctggcgggcagagcatgtgctacgaacttggactggtttgaatcttggctcttgccatttgctagctgtgtaaccttgggcaagtcacttcacctctgtgagcctgtttctcatctgtaaaatgggaataataatagtaacagcctcatggggctgttataagaatgtgtgccacacccaggcttaaatatgctggctctttcctcttcctctgtacatttatttatttttttagacaaggtctcactctgttgcccaggctggagtgcagtggcacaatcatggcacactgcagcctcagccccatgggctcaagtgatcctgctgtctcagcctcccaagtagctggaactactggtgagcactaccatactcagctagtttttttttgttttgtgtagagacggggtcttgctatgttacccaggctgt

SEQ ID NO: 104589 - DNA, 1048 bp, Homo sapiens
cacgcttgtaatcccaacactttgggaggctgagacgggtggatcacttgaggtcaggagttcgagaccagcctgatcaatgtggtgaaaccccatctctactaaaaatacaaaaattaaccagttagccggccgttgtggcatgttcctgtaatcgcagctcctcaggagactgagatgggagaatcgcttgaacctgggaggtggaggttgtagtgagccaagattgcaccactgcactccagcctgggcgacagagcgagactctatctcaaaaaaaaaaaaaagtttgttaatgaagatgttgccagtgcccagcattatgtttgctggaagaatagatgtgagcacctccaggttttgtaaaaggcaggaagacccagcaagtgtttgtgaaatacctgctgaatgagtgcatccccactgtccagcagagggccaggcacatgcccatggaggggacctgagcagacccccatttcctttccaggtgtggcctctggaacctgactccgttaggacgaacatctgccccttcagggagggtgagccgaccggcctggggctggggttggggtgttgcgagcgatgggtacctggcctgcggtgactgtgccctttccttgcagacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtaagtgaagcagagggcacctcccgtggtgaggggagagtggggaaccgggggtccccttttgtgatcccacccattcctctctttccacagaaggttctcgagttcccattgctgaaaggccaccctaacctctgtgttcaggtcagaaaggggtgcatagtgctgggctggaggctggacctgggcagaccccccagccaagggggtcttagttcttgggccgctaaagcatag

SEQ ID NO: 104590 - DNA, 1722 bp, Homo sapiens
ctgtcctaggccgggggtgtggtgagatgcagggtaatcacaacgatgatggcagggaccatttccccagcaattactgtgtcagatgctgttctaggtgcattccccatcttaactgatttaacccctgaaacaacccgacgctggaagttgggttctcatccccactctacatatgtaaaaatgaagatgcagagagatgaagctactttcccagggctatatggcaagcaagtcgcaaagctgggatcccaatccagacagtctgaccgtggaacgagactcatacacgtaataaatgctctgcccccaacttgtccaccacatggccttggcaagtccaacccctttacctctctgagcctcactttcccatttagtgagacagggatggtaactgccccttgcagggtggttttgagcagtaaatgtagtgtgcctggcttgctgggcaggcctggtggccatgatgatcaggtgtgtgggagttctggggagactccaagaactaccaggaacagggatacgagtgccaggctgcatctcttgctcctctgcagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaggcatcagtcttactacctgtcccaccacccccaccttagggaaatgtcctagaatcctgggaaattgagggcttctttgatggtgagtggagaaaagatagaggagaaggttgcccctgaagtgctgttaggagaaggaggatagaggaatcagccttaggagggttccatgccagctgtcatttggcaaaggaccctggacagatgacttttgcctctgaacttcactcttctctttcctcaaatgggcttcataatgctttccactcaggcttaacatgagaattaaatgaggtgacaaatgtgaagacctggacagtacacaacagatattcaataaaagtgtggtcgccattatgaccagagcctccaagcctcaagcaacctttcctcggagtcctgctctccgtccaatacacaggacttagaatgactgggaggcagggcctccagtctctccttcctcctatgagtacaggatcctggcatggcc

SEQ ID NO: 104591 - DNA, 1050 bp, Homo sapiens
ggatgaacaaaatgaatctccctgttcattttgagcctacatagacatagagaccaaatatgtcaaaaccttattcaaataaactctcttcagagtgaatacccagggtcaggacagactcagcaaaccttctatatcacttaattctgcccagtgaaaatcagtgaccctgaggcactgccagattctaaagtgcctttgggatcatcagagactgtctataaataatgcaaaatcttgatctggatgtcagtgtatcaaatcttatcaaatccattgacaaatcagtggtgctatactggaaatggctactcctttggatgaaggacctcatttcccagttgcttggaacaaaagagaatttacatattgctgtaagaagggagagacggcagttgttggtagacacacagataagggtgcccaagaataattctgtctggattaaaggtcccagggaagtgacggtgccatttctgtaccaagaggtgaatataatttgcatgttgagtgcagtaattaagaacaaacgactcgactccacaaattaaaccgtcctgttttctcttctttgcctgtgaaagtgttgcctctgtaagtcactaacaaccttctgccagcagttgactgtctatcttggatcagtgcggggagtctaagacgaaagagatgtgaaccttgccctcaactcacaagagagagacacctaagagctttttaaaattttttattatttttttagagacgataccttgctatgttgcccagactggtcttgaacttgtgagctcaagccatcctcctgcctcaccctcccaaagtgctgggattacaggcatgagccactgtgcctggccaaaagagacctttttttgaggtcaccgaatctgagaatctggaatctctgaccctggcctccagagtaacatatgtggacatagatacagacatgtccctctaaaacttattcataatgacccgcagacccaagttaagaaaccctgacctttaacgatagttaaaatggctgcttataccagatagaaaagg

SEQ ID NO: 104592 - DNA, 1031 bp, Homo sapiens
catttatgtcaaagcattgtggaccatgcaccatttaaaccagatggcaagtcccttgattaaagagctgagaatctgcactaatttgtctgttgtacatctctcaagagtactgtggggcacaaaggtgcttagtgagtgtgagctgatagacgggttaagcgctggggactttgcagtcagaccacaatttaaatctcagctccattagttcctagtgccagtggccttgaacaaattatttgacctcttagtcttagtctccttatctataaattgaggggtggcaggaagagggggaggagaggattggggtagcagcatttcccttgtaggattgaatgagcttatacatgcagatagctcactccagcttttggcccagagtaagtggtcactaaaggttagccacagctgtcagtaacaattccctctcttcctgcctgggtgttctcttccattacagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgagctggcaggcatgcagcaaggcttgttcttgtctgggctgggttcccctttatgtttgaaactagaggaaataggagtatgctgggcaacttgttatttttaaaatgttgtaaatgttccttctggtgactctagtaatgaaagtcagagaaagggggaaacctcaggctactgataatatataaaatcttggccaggcgcagtggctcacgcctgtaatcccaggattttgggaggctgaggcgggtgggtcacgagatcaggagttcaagatcagcctggccaagatggtgaaaccccatctctactaaaaatacaaaaaaaaattagccgg

SEQ ID NO: 104593 - DNA, 1018 bp, Homo sapiens
tgagctgagatcatgccactgcactccagcctgggcgatagagtgagactccatctcaaaaaaaaaaaaaaaaaaaaacgctgggtgcggtggctcccgcctgtaatcccagcactttgggaggccgaagcaggcggatcacgagttcaggagatcaagaccatcctggctgacacggtgaaaccccgtctctactaaaaatacaaaaaattagccaggcgtggtggcaggcacctgtagtcccatctactcgggaggctgaggcaggagaatggtgtgaacctgggaggcggagcttgcagtgagctgagatcgcaccactgcactccagcctgggcgacagagcgggactccgtctcaaaaaaaaacagtttacagaaaatcaggagaaagtccctggcaacagaggtaaaacttagtggtttcttgtttgtgcttttgtcttagatcctactatgttgacagacatgatgaaagggaatgtaacaaatgtcctccctatgattcttattggtggatggatcaacatgacattctcaggctttgtcacaagtaagttacagacccagccgacttcatgttacccagagaaattcaagtgctagtgagacactaatatcacaggtcctgtgttttcttttgtaaactgataatagtccttgaacaaaaaatttaatatgtgatgacttttacggcttttgcccaaaaatgatcctaagttcatgacgtggatgctttttagccagattagattcaagcaagtgacttgctagcttacttccaaaactaatacggtattctcgttgagcaggataaagggaagcgtatttctattttgacttcatttgctagatgttagggtgagttttctgtttgtttgtaagttgattcgcttttaatcaatttggtttcttattaacataattctatgcttatatattccacttagagtttgacagtttgctgcaagttttttccaaatttcaggtcacagctcagtttgagtccctgcttcctc

SEQ ID NO: 104594 - DNA, 1030 bp, Homo sapiens
gctaatttttgtattttagtagagacagggtgtgagccattgcacccagccaagaacgcttccttaagaaggaatgtaacagccggacacagtagcacatgcttgtaatcccagcacttagggaggctgaggtgggcagatctcttaaagtcaggggttcaagaccagcctggccaacatggtgaaaccccatctctgctaaaaatacaaaaattaaccagacacggtggcatgtgcctgtaatcccagctactagggagcctgaggcaggagaatcacatgaacctaaggagtagaggttacagagagccgagatggctgcactgcacttcagcctgggccacagaaggaggctctgtctcaaaaaaaaaaaaaaaattccacagattaccattacgccccctacagggcagtaacacccccatgaagaaccaaccactgctctagagaaaatgtctctgctcataattgctgcatcccttaagtgaggtagttggattataccagctctgacatggagtggctcagtctcatcaggtcatcatttgacttgagcaaaatgctgtacatgctgaaccagcctaagtccaagaaaaaggtgtgttttagttgtaaaactttttttttctttttttttttttaagtgacaagtcttgctgtgtcacccaggctggagagcactggcacagtcaaggcttactgcagcctcaacatctcaggctcaaggatcctcccacctcagcctctcgagtagctgggattataagcgtgtgccaccacgctcagctaatctttaaattttttgcaaagatggggtctcctccgttgcccaggccggtctcaaactcctgagctcaagtgatccttccatctcggccttccacaatattgggattataggcatgagccactgggtataggcatacccagcgatataaaacattttaataaatatactataaatgtccattagcagcagggcacggtggctcacacctgtaattctagcacttttgggaggctgaggcag

SEQ ID NO: 104595 - DNA, 1050 bp, Homo sapiens
agaacctgtacttttatagcacttacataactgtagttcagtacattaaggctatttgttaccatactgtaaattccctgaggacagggatcatgtctgtctagttcacagttgtaaccccagcacctagcacagtccctaacatatagtattgaaatcatgaattaaaggacaggtacgttggggatagataatggagggtcttgaatctcagatggagagtgatgggttttatccttcagcaacagcgaagtagtctgcctaaagaggtaactaagacttgaaaggaaggtagtattggctagatgtaagagttgaaatttgcttagcacctaggtttaggtagcattaatatggagatgtgagcccctctgattttggatagagcagttttctttgaacaatagctttaacttctcagaatttatcttctagagggtaacttctgtttcccgattttgctctaggaagtaatttaagtgcacaagacattggtcaaaatggtttccaaaagaagactgtcaaaatctgaggataaagagagcctgacagaagatgcctccagtaagtatctagtcatttgttgctttatttcctgtagcaatgtgtgaggcatgtgagagatataaagttcctgcttttcaagtgctgagaatcttcaaagtgtaatgaatggagtgcacagaattaagggagaaatatcagatttgggactgagtttttgcctcgaattctgcgtataactttgagtatgaccacagcctctggacctcagtctccacatccataagaggaattagtgttacagactttttctgctatacatcatttaggtgttgagacacaaagacataacatagtctgtacccttaaaaaactttatggtctttcttcctctcttggaaaaaaaatattatgatctagacacatgctatgttagtgatgtgaaaggaaaaatacatcaaagcaagcaaaccagaggcaaagaaacagtgcagactctgcccatatgagaaatagttgacaaagatcccaagagttccagatata

SEQ ID NO: 104596 - DNA, 1034 bp, Homo sapiens
gccattatcaaaaccttatttgagaagttgccagaatatttttttgaaaagtaagtggcgttattatggaatgttcaaagtaccctgatgtacttaagttctctctgaaaaggttactctgaaaactattggtttctctgaaagtcatatttatcattatatttcttaagtgactactaaaattttactggagtgtctttgaagtttcatctattaatatgactttgtaaaaatagataggattactgttaaaagtaactattggcctggtgcagtggctcacacctgtaatcccaacagtttgggaagctgagggaggaggattgcttgagttcaggaattcaagaccagcctgggcaatgtagtgagaccttgtctgtatttcaaaacagaattttttttttttttttaagtatctgttgcttatgctcagggataatccctagtagaaggatacacaatatactggtaatggtagttgtctccaaagagggtagccagttggttggaatcaggtattttctgaatacttttctttaccttttaaattttgtagtgtatgttcagacagggtctcactctgttgcccaggctggagtgccgtagtacgatcatggctcactgaggcctccacctcccaggcttaagtgatcctcacacctcagcatcatgagtgcctgggactacaggtgtgcgccacccggtccagctaattttcgtggtttttttttttttggtagaggtggggtttcgccatgttgcccaggctagtctcaaaacttccaggctcaagtggtccacctgccttagcctctcaaactactgggatgtggccctacctgtttttttttaattactatgttaagaaatgaacagcctaatagaaaagtagacaaaggtcatgaacagacagtttacaaagaagaaatacaagaacatcaaatatttaaaaagttcaattttgttagcaatcaaaggcacaaatttaaaacactgtatcaaaatagtaaataataactattacacagtaaaat

SEQ ID NO: 104597 - DNA, 2109 bp, Homo sapiens
attaacaactaaaagattctaatttggggaaaaatctaaaattttgtttttccctaaattataagtgggaagatggagtaagagaagtgatttttttctaattttatctaacagttcagtacaaagttgaggtagtgacatgaaaacctattaagtttctgtgcttttaatttttaggttcgccagttggtgatggataagttgtcgtctattagattggaggatttacctgtgataataaagttcattcttcattccgtaacagccatggatacacttgaggtatgctcttatatcccatcacacctagataaagcaacttaagtgccaattgctcttctctgtccccagactaactgagaatactgactaatccggatagcattcagaggagagaatggagctattcaacagattcattgatctatataagctgctataagttacatttactcttcctgtgtagtacctcacagaattctgaaattttgggtatgatgttctatgacattgcattggctattctcataactctatttttcaaaatgtccaacatttaaatttttttcttcctcagtctttcaggagattgtcatggtagagagactggactgtgcctacccactatgaatgagcagaaaaccatagctaatatttactttctgcaggtaatttctgagcttcgggagaagttggatctgcagcattgtgttttgccatcacggttacaggcttcccaagtaaagttgaaaagtaaaggacgagcaaggtaaagagctcatcctcacacaggatgtcacaattttctgacatcccactgtcagagttagagcttaatactactacaaataatgatactattatgacatttacatctagtattatattgtttttcaaattacatatatgtatgtgagtatgtatgtgtttatatattttcttagccattcagatcaatcccagacagacgacagtgcaagtttattagccatcttatacatgaggttgtcatttgctccagggtacatggcaggaactccgatcttgtaagttcttttctggtacgtagaagagtaatttttttcctctctgctacttgtagttcctcaggaaatcaagaaagcagcggtcagagctgtattattctcctctttgatgtaataaagtcagctattagatatgagaaaaccatttcagaagcctggattaaggtgagatctttggaactttgattatcaaggaggaaatgagtggcaattagtgacagatgtataactgaggtagactgaaataaaaatctcaaaactcattcaagtggaaatgatagctgatggttgccagatggacacattggctcttagatgagataacagggcatgctgaataaggtgtaacgtgtttcgctgatgtgtcataatatttttgtgactctctcctgttttttcaggcaattgaaaacactgcctcagtatctgaacacaaggtaatgttcatgtactatgcattttcagtattgcagacttaaaagtaatgacattggctagcttgccttcccactgtctttctttctcccccctccagtcactcttctctctcttccctagttgctctaataaacattagctgtctggggaagataatctgaggtggcgactggccagatagcctgcccctactcactctggctataaaataagcctacagtatccacaaggggaaatactaacagtgtaaacaagcacatcaaggtgcagtcaaagaagccaggtccccactgatgagatgaagaaaataaccacctaagtctcaggtccctgtatctgcctaattgcccttccttccactcagcaccactgtcaagataatggcattccatgttttactttactttgctcatgtagacctgactagagtaaatcaatctgtccactgtcaaggcagtggtactggatcttatgtctctattaattctagaaataccttccatcaaaaagccagatgattggccgggcgcggtagctcacgcctataatcccagcactttgggaggctgaggcaggcggatcatctgaggtcaggagtttgagaccagcctggccaatgtagcga

SEQ ID NO: 104598 - DNA, 1023 bp, Homo sapiens
ggaagggatgatatggcaaggaatagggtaaagacataacttttggtagaatattgttttcactgaaaaaaaagggaaaggtggaggtaaagaataccgagaactgggaggtgcattagaatgactaagcagtagatgattaaagcccaggattgtggttcagagtgaagaggataaagaaaactttatgtttcctgatagttagttcctagtctctgataataagagatttagaaagttgtaagaattttcccagtttatatccagtctatcaaacctttgggctctgagcatagcttttagaacttgagctttgagcttttaagggagctaaaaagttttagatacctggctatctatgtgtgtctcttttacagggattttaattttttgaattttaagggaaaaatgttagctgctagcctcattgttggcatcattttttccacagggcattttagattatctggataacatatcccctcagcaaatacgaaaactcttctatgttctcagcacactggcatttagcaaacagaatgaagccagcagccacatccaggtaagaggcaatatgttgggaaagatttttttttttttgagacagagtctagctctgtctcctagactggagtgcagttggcacgatctcagctcattgcaacctctgcctcctgggttcaagcgattctcctgcctcagcctcccaagtggctgggactacaggcacgtgccaccatacccagctaatttttgtattctccatcaaaaagtgggcgaaggacatgaacagacacttctcaaaagaagacatttatgcagccaaaaaacacatgaaaaagtgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtgga

SEQ ID NO: 104599 - DNA, 1006 bp, Homo sapiens
atatatatatatatatatattttttttttttttttttttttttttttgagatggagtctcgcactgtcacccaggctggagtgcagtggcgcaatctcggctccctgcaaactccgcctcccaggttcccgccattctcctgcttcagcctcccaagtagctgggactacaggcgcccgccaccacgcccggctaattttttgtatttttagtagagttggggtttcaccgtgttagccaggatggtcttgatctcctgacctcatgatccgccagcctcggcctcccaaagtgctgggattacaggcctgagccaccgcacccggccacaaccatcatattttttatctttttttccccccctttcttggatccccagtcagcacattttttttaattaaaaaaaaaacttttggactaggtaatatacatgtgtcatacaaaattcaaaacatatagaagagtattcagtgaaaaataactctcacttctcagttctgtaggcacctggtttgtctcccacaggggcaatcactttataagcttctgagatgttctgagaatttacaaatttgtgtttacctgtagtttcctttcccttcttgttctacatcttagcttttgcatttagcagtttattttggagattgcttcaaatcagcaatataaaactacttcactattttattttatttttgaattttgataaaatatacataatataaaatagaccgtttaagctgtttttaagggtacaatttagtagcattaagtatattcacaatgttatacaaccattgccactatccatttctagaacttcctgatcatcccaaacaaactttgtacccattaggcaataatttgccatcttcctctccccaccccctaataatcactaatcacattctgtctatggatttgttcattctagatgcctcatataaatggaatcatacgatatgtatccttttgcgtctcgcttatttcacttagcataatattt

SEQ ID NO: 104600 - DNA, 1422 bp, Homo sapiens
aagtgtcttccaatccatgaagacagtagctctttccatttccttatgtctttaatgtttttcagcaatgtttattttattattttattttattttgagacaatgtctggctctgtcacccaggctagagtacagtgatgtgatcctggctcactgtgttcttgacttcccaggctcaggtgatcctcccaccccagccttccgagtagccaggaccacaggcatgcaccaccacagctggctaatttttgtattttctatagagatgaggttttgccatgttacccaggctggtcttgaactcctgggttcaagcagtccagcagcctcagcctcccaaagtgttaggatgacaggtatgagctacttcgcccagccttgcctccatgtttaaatctttacctgagtattttattctagttcattattttggctgagcagtgatcaacattatgataattttcatatccttatagaaataataacaataaaagatattattattgaatgtctatcatgtgctaggcactgttctagaagttttttataatgtatcgctaatccttaaaacaaccttctccatttcgggccaggcacgtaatcacccctgtaatcccagcactttgggaggccaagacaggcggatcacgaggtcaggagatcgagaccatcctggctaacatggtgaaaccccgtctctactaaaaatacaaaaaattatccgggcgtggttggtggcgggcacctgtagtcccagctacttgggaggctgaggcaggagaatggcatgaagccgggaggtggagctagcagtgagccaagatggcgccactgcactctagcctgggtgacagagcgagactccttctcaaagaaaaaaaaaaaaagtccccatttcacagatgtaaaaattaaaacttggagagatgaattgacttgctaaagacacacagggctgggtatggtggttcacacctgtaatcccagcattttggaaggccaaggctggtggatcacctgaggtcaggagttcaccagcctagccaacatggtgaaaccccatctctactaaaaatacaaaataagccgggcatggtggcgggtgcctgtaatcccagttacccaggaggctgaggcaggagaatcgtttgaacctgggaggcagaggttgcagtgagccgagattgcccctttgcactctagcctaggcaacaagaacgaaagtccgtctcaaaaaaaaaaaaaaacagttagtaaacggtaaacgcctttatagtctagctatatggctcgatatccataccttcttttgctgtgccattccagcattttcatctttcttcatcatctcattgcaggatgacatgcacttggtgataagaaagcagctctctagcaccgtattcaagtacaagctcattg

SEQ ID NO: 104601 - DNA, 1031 bp, Homo sapiens
ttctctgagggctccttcacttaataacaatcacgatagtaaagaagagattgactttgttaatgatgatggctattatctgtctgagagccctattctgtgctgggccttgtgctaagtgctttttatgcactctctcttttctacttcacaatagtgagatatttattattactttctttttagaaatgagggaactgagacttagaaaggttaagagtaatttatctagggctgtacagcaagtacactctgcactgccctttttgtttgtttgcttcctgaaggaatgggttgggcataccatctgtaatgatttccaggatgccttcgtagtggactcctgtgttgttccggaagggtaggtattgtttacctgctggcttggttgcactggtgaagttacatcaattctgtcagtagctgatacaaacttcagaatacccttcacctcagccacagctgcccagtcccacagcttctttcctcccaaccccagcacccctgcacccttagctccaaaattcctaaaaggttcactgtttgttcttctaatttctccccatgatgttgtgtttgaaattggtttgctctagtggttttccctgtagccttgcgtattcctgagctgcaacatcagattctggtttttctccgcagtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaagtcagtatagtttttcttttctaaacctgttagtgttttgaatgttcatggggaattccacagctcttggtggggaagttgagtcaaaaaagtttctctcgagacaaatggtatttggagaggttagggagaatggggcagattccttgttttttcttggatccttggcttgagatttatattgccttgtgtgagccaacagatattctgagattactttctgg

SEQ ID NO: 104602 - DNA, 2547 bp, Homo sapiens
cctgggttcaagcaattctcctgccacagcctcccaagtagctgggattacaggcgtctgccagcacacctggctcatttttgtatttttggtagagatagggtttcaccatgttggccaggctggtctcaaactcctgacctcaggtgatccgcgcgccttgacctcccaaagtgcttggggttacaggcgcgagccaccctgcctggccaccatttagattttaaatgtttgttttagtttttttctgtttgttagttatatatcattatttaaagtggttttatgataattgatcatacttaatatgatatttctgtgttatctctggccattttgctatgccaaaacaatgtcagatgacttgaatatgtcttataagcattcagccatgcttggtaattttggaaactagtttttagccaatggagtgactgaatttcaagtctaatggtggtgtgtaattggtacacattgagcttcagcctgctgtttgtttcagtcaccccagactatgtccctcctcttggaaactttgatgtggaaactttagatataacacctcatactgttactgctatttcagcaaaaatcagaaagaaaggaaaaataggtaagtatgttcttttcctcttgtcttgtgtctctaaataagcttcattgaattaacctaaaagttatgtgtatcatggcatcagtaattggaacaattgtataactgaactcttcctttattagatttataaatatactgtaatttagggttataaaattacctcttctacctctaggcagtttccaacaggttgttttctgagggcaatgatatttggcaaacatgattattaattacttgagtcacttttctctttttaatataaaagaaaggaaacaaaaaacagatggcagcaagacatcctcctctgacacactttcagaagagaaaaattcagaatgtgaccctacgccatctcatagaggccagctaaacaaggtattggaatgatgggtatccgtgaaggtttgtgacatcccagtgagattaacagaaacccagctttattctcggcattttacaaagaaaaaaaaattaggaaacagcgagccaaaactctcttaggcgttggagtaatctccttagtagcaaagttcagattagacttcaggtccttattcctgccacacactgttgactgttttttctaattattttcttgactgttttactcccttttttgtaccccagcagtacattgaattctctcttgaggtacttgattatcagtagttcccttttactttacatttgtactgttcgtagaatgagtttcatgtgtttgaaattgcctgggccacatggatcccaattatttctgttgatcagccaccatttattgtatatttattaggtatagtttctgtaagagcccaagtttcatattaataccacatttaataaaggaggaaactaagatccagggagggcaagtgacttgcccaaagtcacacagttaataaatgctggagctggggtttgaagccagatcattctggcccctaagctcacagttttttgttttttgttttttgtttttgagatggagtctcactctgtcacccaggctggagtgcagtggcacgatcttggctcactgcaacctccacctcccgggttcaagcgattctcctgcctcagcctcccaagtagctgggattacaggtatgcaccaccatagccagctaatttttgtatttttagtagagacggggtttcaccatcttggccaggcaggtctcaaactcctgacctcgtgatccacccacgtcagcctcccaaagtcctgggattacaggcatgaaccaccacacctggccagctcacagttttctgtactagacctaaatgccttgatttgcctaatagatcatccctaaatagatgacctgttaagggtcttgatgtgtgacttgtatccccatcttaaattaggtgctctgtcttgggaatatttagggacttgggctagaggaagttgttattataatgaaaatgtaattttttgcattaaataaatgcatatttgtactttgaagtttttattaaaattcgattaatatagaagatttatatattctctttgttgctgtgacttccccataggagttcacagggaaggaagaaaagacatcattgttactacataattcccatgcttttttccgagagctggacattgaggtcttctctattctacattgtggacttgtgacgaagttcatcttagatactgaaatgcacactgaagtaagtgacaggctaggatctcagaatttaatcttctttcagaaagttcctcaggtctattcttatttcacaaagaacactgtgacactgaggagagaagttagactgacttttaaagcctttatatgtgaaagcaatgatgaataatcatcctcatactggtgtttgtaagtcataaggtttgtaataatgtgtcagacattataaaatatcatgccaatgatgtaatccttacatttagg

SEQ ID NO: 104603 - DNA, 1049 bp, Homo sapiens
tcaggaggctgaggtgagaggatcacttgagcccaggaattcaaggctgcagtgagctgtgatcgtgccactgcactccagcctgggtgacagagcagaaccttgcctcaaaaaaaaaattataagaaggagtctattgccctacatttgtcaacctaaatgatttctacttttatgtgacctttatctgattagttatgatagggctatatgtctcaatcaaacactgttcctactctacaaaagccaatctctcagtcattggaagatggagcaagatttttatccctctgtcagaatacagtcttaggttaacaactcatttctcccatctgctcctacctggtgacacaggtttgacttgactccattgcgaacccttagtttctgagacgctatccagcagtttcttcactcataactctgcatttattatagaacaaaggaagccggaatattggattctcacatctccaacagagatctgcccaagaaattgttcattgtgtttttcaactgctgaccccaatgtgtaaccacctggagaacattcacaactattttcaggtcagaagcctagacttagaagctgctaagcaaatatgaggtttcatttttggctgagaaaaaggaaaatgaggacaattactgaagcaactgtcctaaaatcatttttatttttagtgtttagctgctgagaatcacggtgtagttgatggaccaggagtgaaagttcaggagtaccacataatgtcttcctgctatcagaggctgctgcagatttttcatgggctttttgcttggtaagtatgtgggaagtgtggagagaactgagtatatacttgcttttatttgacagtcaccaaggcactgaaatgtagaaaagaaagaaaaggttcaaaaatcttatgtgaatatggttcattaattttgtgggagtgtttttgtctgtattatttcatttgatcttgtaccctctgagtcctttggagccactatgttaacccatttgacagattaggtgacttgctgatgagctgataacagat

SEQ ID NO: 104604 - DNA, 1054 bp, Homo sapiens
gttctcattatacaagatttctggtcaatcctacccaagcttaaatttagccaaaatttattttctgagctataggcatttatatccaactgcctacgcaacacctccttagatgtggcattgacacctcacactccacatccaaaatggaatatgtcatccctagcatgctccttcagctttgcctggcttagtaaatggtaccaccagttgcctgaaccagaaaccaggagttattctttgtccctccctctgctctccaccgtctttttcccacatctgattgccaaatcctgttgattttattttctgttataaataacatctagatagccatctgtccctgtttctccactgcttccagactcccattatctctcaacctggactgggctaggttcacacttggcctctctcagtccattcttcacatggcagtaagagtgatcttcctaacataaacccagtttgatcctatcccaattttgatttctgattgctcttagatttttcttgagttaaaactctcttacctagcctctaggtcttcttctgactcctgctattccacttattatgttatactctgcctccagcctcactgaattaatttgagcaccctatatagcttttacgtgggaggctttgcacatgttcattctcctgccaggacccccactcttcttgatccccagctttttctgactcatcacatctcttgagatctgaacttaagcatccatcctgcctctctaacccccagttctcttctaacactctggtatccgttcgtgataaaacttaatctcattttattataattacttgttcatcagtctttcctgctagactctgagctccatgaaggcagatgtctgtcatttttatatcctcattacttaaaagcagtgcctgacaaaaactttgaacaatttatcaaagagacttatagatggcaaataaacatgtgaaaggggcctgacatcgtggcttatgcctgtaatcccaacactttgggaggccaaggtgggtggatcacttgagctcaggagtt

SEQ ID NO: 104605 - DNA, 1454 bp, Homo sapiens
aactatatcttagtgggaatacagtaagggaagtatttggctgtgactcagaggtgcccatatatttggctgccccagattcatgaagagaaactcctctactggaacatggctgttcgagacttcagtatcctcatcaacttgataaaggtgagtatggagactgcttgacacatctcaccaaataactgcagaaaccaagtgtcctggcttccaaaatggactttccttgctcctcttcccactcttccttggggcctgctctccctgagtcgtcttcttcctttgtccccctacccatcctggataaccccttttctcactaggcatttttttttttgtcttttccttccttcctcctacttatgccacaatactatttaatgactccttccatctgtaattccctcactttttcaccttgccttggatcctctatgatctgagcgcacattccctcttctaaccctgaatgccctcgttctcctttaaacacactgtgctctcacccactccatcgtggttttgctcagcttgttcccccagcctagaatgtccttgtctctccacctctttcatgtcttttttttttttttttttttttttttgaggcagggtctcactctgttgtccaggctggaatgcagtagggtgatcacagctcactgcagcctcaacctcctagactcaagaatcttcccactgaagcctctggagtagctgggactacaggaacatgccaccacacccagctaatttttctattttttgtggaaacagggtctcattctgttccccaggctggcctcgaactcctgggctcaagtgatccaccagcctcagcctcccaaaatgctgggatatcaggcatgagccagcatgcccagcctcatccagtctttcttaagtcttcagatcaaggttttggacctctaataatgccatcttctcaacactcccagttggaatcagtttatttctctttgctcgtctcttccttttcttgaacttcagttgtgataattactttattctgctttgtaatattaatttaaatgttgacattcctccattttagaattctctgcagcacccaaagctgtgctttgcgcagcgggaaagaggctggagtgctcaaaggagcagatctcagccttggtttcttgtctttcacctctccaggtatttgatagtcatcctgttctgcatgtatgtttgaaggtgagagatttactgggccctgtttcatatttattcttcctgtggatcactctagagaggacctcagctgagataaattgctcaatttcttgcccacaagccagagtttccagaatctatgccagtttagggaaggcaatggatgcattttcccaccctagttggatgattggagaagccagttttcctatgaatttgaaaacttttggtaagaatcttagtactaggaggaa

SEQ ID NO: 104606 - DNA, 1029 bp, Homo sapiens
gattgggaaatttagaaattggtcatatgctttctcagctttacccagtttttccctcttgggagtaagttatcctcagatagagctcccctctactctatgctctcactcctaagctgagcaagttccctgtccatcgactgtatctgtggtaggtaagtctgcctaattctggggcttagttaacaggcctatttgatttttgtattaagttacattctccaaataaaccttttggacccttcccaatttgttttttatatatataaataagaaaataaaacccttgggctggatgagactattctgcctcaggggcctttcagtgagatacctcagctagaggtaacagtgtgtctctcttcttcagtatgggcgtctctttgtggaagcatttctgaagcaatgtatgccgctcctagacttcagttttagaaaacaccgggtaagagctaagagcagagaacaaagatatgcactgaagagttgctcagaagatatgtccttggtgactcctgggtggggctgggagtgttctacctgggctcctctggtccacttcagctgtagccagagatccccaaattggactgaatattccaaagtaggctgaactcctcaggcccactctggatcaaacccacctttctatttcttctccagatctgacagtggtcttccttttagcttgattttattgtgctactgcactctcaggtcctcatgtatcagtgtgtcatttgcttattcctttatgcttctgtaggtatactctcagaaatgattttaaaaaaaaaaaagctcatttgtgtcataaaaccctttgctgtggtaatgaacagtcttgacagttttttagccaatggcatccagggctagagtgatgaattaaggatagaatcacattatttcctatacatatttagcaagttgaacaaaatactcaccatatttggttggtccctcacagccctgaaagagaaagggaaggtggtattttatcctaatgttgcagatgggaaaactgag

SEQ ID NO: 104607 - DNA, 1063 bp, Homo sapiens
gtcctgaacagtgatttttttttttttttttttttgagacggagtctcgctttgtagcccaggccggagtgcagtggcacaatctctgctcactgcaagttccgcctcccggctggacagtgaatgtttaaggaattctcttagctaaacagggctactctattgtttaatatcagtaaaatatatattcaagaatattttaggtaaattcattgaagatcggccagtaagaggttatgaagaggaactagaggtgttggtggtatgtcttctaggctttgaattctttagctgccattctctttggattactctgccaaactattcctgtttgatggaacataccgttggcccatactggcagggcttgtgttcttattcaacattcaaaggtttctataagaaatgtgaaggcatgatgataaactcacaaaagatggatgttatttatttccattcagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcaggtaagccttggatcctgctagtgataatcccctactcttattctttgtgacagcatcagatggcatgtaaggaaggtcacctaagccctcgtctctcagtaaggctacttttctcttaagtctgtgactgtttaactcttaaagttatggtacattactcatgggccctggtcacaggctgcacccctcatcttaggcagcaaggcaccaaaacatgccattgatataaacaatgcctcagacataaaggagtcagaccagtacaaacctctctccacagctagaggagctcctttaagccccactgagggtagattcataataacatttttgtatagggacaaacatttcttttgttattttttttcccctaagccaatctgtcttattccagaaattacaaattaatctcttattgggggacctgccccgataatcacgtaggttcttttcta

SEQ ID NO: 104608 - DNA, 1096 bp, Homo sapiens
cattctatatcgaatgccctctttgttcctatgtcatatacatgcagtagagctggaggaccatagcttatttaaaattatgcaaattgggccgggcgcaatggctcacgcctgtaatcctagcactttgggaggctgaggcaggcagatcacctgaggccaggagtttgagaccagccttgccaatgtggagaaaccccgtctctaccaaaatacaaaaattagccgggcgtggtggcacatgcctgtaatcccagctacttgggaggctgaggcaggggaatcgcttgaacccgggaggcagaggttgcagtgagctgagatcatgccactgcattccagcctggtgacagagcaagactcctttaaaaaaaaaaaaaagttttaacagtgataatagtacagttgtgtatcctctaggagctgtattccagaggtcacccagagcagtaacctaaaatgcttatttatttattctttgccccttaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttgga

SEQ ID NO: 104609 - DNA, 1129 bp, Homo sapiens
aatccttgacctatatatatagatttttgacatcccctggtacatagaaatccatacatctttctcctctacaccccttttccccccaattcattgtggttgtaggtgtttatgtgagttcacactaggctcattggtttatatcatttgtttaacggttatcacatggacatgtcaatgctagtttgactctaaatggttcaaccttacaatgggaatgttcttccttgttctctatcattggtccttttttggaggggaagggatgaaaggggctcctgaatcatcactgcttgaaacaaaagcaagatggctgggacaatgtcacagtttcatttacatggacaggtttctgtaagctttaggtacataccaaagggcatggtgtgagtaaatggggatcaaatgaggaccctttacttggagtgctgcaaggcaaaggtgcactttttgtaagttgcatacagcaagaggatagagcgcagcatctgtttgcacatagtgactgtcatctgaatctgaggctccttcagtccaatgggccactggtgctccctgctaatgattttgcaaaaggctgacttgtctgaaactctgaaagtcccggtccactttggtggctgagctgtgataaccctgccaaagacagaatctactccactgaggcggatgggctggggcttcctgaccagtcctttgttgttcatcgtgcgcaactctgatgtgtggcagggtaacttgggactcactccagattccaggaatgggctgtctaggactagagtgacctcttgaaagcacagctgcacttcaaggtcggacggtgtgtgtgggaagcagggggaggccttgaatgggtgcttggaggaaggtgtaggtgtcgtgtgccgcagccattggaaactctcatccagtggggtccatggtgaccagagctggtatcctgccattgacagtcctaaaggagggaaatcagagcatggaatttccctgacatgcttttcatgagagcatggcctttcaaattcccatctctgtctcactatagacataaacttgttctatagttcccatgaatagattccaacaggtgttaggatattagtaattattttattttattttattt

SEQ ID NO: 104610 - DNA, 1086 bp, Homo sapiens
aaaccttgtctcaaaaaacaacacaaaaacacaaatttccttctgaaagggactgttccagtttgcagtgtgcccagctatttatgaccatattattttttagactccgtctaaaaaaaaaaaagacttgtatttaatgtgatttaatcgactgtgcccatctcactgcggacactgagtgcgcaacctgagcctggagcagttgagggagacggcaagaccccacgcgccgtgtaacgaccataacgcgcgtgcactacaacctcgccgccggcgtccaggcttctgtgttctatagcgtgggagtagagagcaaacgccggcgaggacgtgacgttgcacaggcctatcatagtgcccgagaattcgtgggtgctcaagaggatgggtgtggcctggcagcgcaggcgcactagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcggtcagcgggccagcaaggggaggcggggaggagggaggccgctgaggtggttgggctggggcgccggggagatgctttgagaggactcccgcagccttcggctgttgcgggttttcacttcctccttcaggtcccaccttctccctcccgccctgaccctcaggctcccgtagacagtctctgtagggttatcctgccctacgctgagctcatggcttcctgccatccctctggatccattctacaagtccttctcctagacgcgtcaggcagccccatcctcgctccgtggttcttctcctaagtggtctccctgcctcctttgtactctgcatccattccggtccccactttgcactcaaagtgagcatccgggaccgtgtcactcctctgtttcaagactgttgaccgttccccatcttcaggatctggtcgataccctctagcgtcgtgccttttagttggacccgttgtcaaccactcccgtcttgtccattcct

SEQ ID NO: 104611 - DNA, 2047 bp, Homo sapiens
gacagagttttgctgtttgacccaggctggagtgaagtggcgagatcttggctcactgcaacctttgccccccccggttcaagtgattttcctgcctcagcctcttaagtagctgggattacaggcatgtgccatcatgcctggctaatttttgtatttttagtaagagacagggtttcatgatgttggccaggctggtcccgaactcttgacctcaggtgatccacccgcctagtcctcccaaagtgctaggattacaggcatgagccaccgtgccctgcaggaaaggacgtttttgtggggccgttattctctacttgcaacacttgataggaagttcagcagatccactctaagcaactgtgctatgagtggatcttagcactgtatccatttccatttgtattctgtgtattattcctctttttcattgtaggtgttgtgtgtgtctgtgtctgtgtttggagtgacattaatcctgaacaccagtctctttttctcagatatgtcttgtcgttcaagacttgcaacactaaacgagaaattgacagcccttgaacggagaatagagtacattgaagctcgggtgagtttgatgggcaagggcattccagagagaatgcacatttccacttattgctgaaaaaaacctgaaagcagaaacagtcttaggaaacttaagcactggccggacatggtggctcacgcctgtaatcccagcactttgggaggccaagacaggtggatcacttgaggtcaggagttcgagtccagcctggccaacatggtgaaaccccatctctactaaaaatacaaaaattagccaggcatggtggctcacacctgttgtcccagctactcgggaggctgaggcaggagaattacttgaacctgggaggtggaggttgcagtgagccgagatcacaccactgcactccagcctgggtggcagagtgagactccatctcaaaaaaacaaaagaagagaaaagttaagcatgttgcctggatttgaaccatgtttctgtgacttcacagctatcttcttttctgctatttctcactgcctaggatctaaagatttttttttagacccctctaatcttttttaatttatctaaatgtcagttttcctttcctttcacaggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttttatctgactgctgtgattatggtggggagaggagctagagatgggttcacttattgcacagaaatgtaatacatggcgttattattctaacataaaactttcagatgtagctgtttgattcaaagcctaggtggcttaccagcccaagtccccatgtttggactttcagctgactagctcatcttgggaatcatttggtcattcagcacatttaccaagtatttactatgtaggcatgttaaactccaataa

SEQ ID NO: 104612 - DNA, 1039 bp, Homo sapiens
tgtaaatggatctgttgtgaggactgactgagataatgttactagaagggctttgtataatatttaagcagagtgagaggtaagctttttgtgtaggtcaggggaaatggagaaaataggtgccctgactcagaccagtctggctctttttttttttttttttggagacggagtcttgctctgtcacccaggctggagtgcagtggcgcgatctcggctcacggcaagctccacctcctgggttcacaccattctcctgcctcagcctcccgagtagctgggactacaggcgctcgccaccacacctggctaatttttttgtatttttagtagagacgaggtttcaccacgttagccaggacggtcttgatctcctgacctcatgatccgcctgcctcggcctcccaaagtgctgggattacaggtgtgggccaccgtgcccagccaccggtgtggctctttaacaacctttgcttgtcccgataggtcacctttggctcttcagagatgcagggacacacgatgggcttctggttaaccaaactgaattatttgtgccatctctcaatgttgacggacagcctatttttgccaatatcacactgccaggtactgacgttttactttttaaaaagataaggttgttgtggtaagtacaggatagaccacttgaaaaattaagcccagttctcaatttttgcctgatgtcaggcacgttatccaatctttttgtatcctattctctaccataaataaaatggaagtgatgtatttgtacgttatgtgttaaaggtgttatggtgtctcaaaagcactttgggctcttaagagacaagcgaaattaaagtatcatatcataggttagttttgtagaattgtagaattacgaatgccttttgtttccctggccaaattgtgccctggagttccaggagaacaatgtgtagagcatgagatattttggcttatttgttgctgacttctaattttttttatttttttgagacagaatctcgctgtgttagctaggctggagtgc

SEQ ID NO: 104613 - DNA, 1141 bp, Homo sapiens
tctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagtttttttttttttttttttttttaaagctgttttttaatacattaaatggtgctgagtaaaggaaataggcagggtgtgttgtgtggtgttttaactaggcgcttctctctcagagagttttgaaacctgtttacataaaggcccaggatgggaaggagatccaaacataagccaccagcctcattccaagtctcttctatttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatg

SEQ ID NO: 104614 - DNA, 1072 bp, Homo sapiens
gagaggtaggaggaaagtcaggagggaatggtgactgagaaccagcagaagaggatttcaggaaagaaccccagtcctagagtcaggcaggtgtgggatctggtcctggctttactgctttctagtttgtgaccttgggcaagtcccttaacctctcagtctccgtttctggagatggggcagttgagatgtcatgtgttgcagagcagtaaagcaggatgaggaccaccatactcgttgaaggcagacagttttcatctttccaccctggggccaggcccttaggggtcagagtatgtggtacctgggaggttattggtggcgttggaggaggagagggcagaagaggggtgggacatgaggaagtagatcattctttccgtctgactcctcacacctgcactgacgcccgattccagatgctgccaccccaatgtcttacctgtgctgggcttctgtgctgcaagacagtttcacagcttcatctacccctacatggcaaatggttccctacaggacagactgcagggtcaggtaagggactgggtcatggtcagagaatgggaccaggctgcacccagccatggggtcaagggttaaggacttacagaagttcagaggggagaggggccatctaggtgagaccagggagacttcaaggagagaagtggggccaggatacataagatctggttaagtgctcactttggcagcacatataccaaaattggaacgatacagagaagatcagcatggcctctgaatgaggatgacaaaatatgaaaaagaaaaagaaaagctcaaaaagatctgattaaacatcttcaggaaaaatctataaaaaattatttgacgagaagcatttcattcaaatcaagagcaggacaaaggtatctcatagaactaacttcgttcgtcatggttctggaggtgttagccaatgcagtaggacaagaaaaagaattaagaggtaaagagtatggaaaagtggaggtgaatttttattataaaatgttcttctaatatatacctatttgcttgtgtgtttatggaatgtctctggaaagataca

SEQ ID NO: 104615 - DNA, 2071 bp, Homo sapiens
gctttttcccattttggagtatgttctcagtgtttgctcctgggggttagatgactagatcaaatgattttttttgagacagtgtaccactctgttgcccaggctggagtgcacctctgcttccgggttcaagcaattctcctgcctcagcctcctgagtagctgggactacaggcgcacaccaccacggctggttaatttttgtatttttagtagagatggagtttcggcatgctggccaggctggtcttgaactcctgacctcaggtgatctgcccatctcggcctcccaaagtgctgggattacaggcgtgagccactgtgcccggccaagagggaatttttttttctttctttttttacatgatctgggcaggtttagtcacaaaggatgctggccacttagacctgagtcagccaggccagagctgggggttggaacagttgtggaagagactgagtctgcacagcctgtaggcgtggcaagctgaggctgatcagggttggcatctgtggggatcagggaggctgcactttggccacattcctggggcagcaagactaagtctgaactccatctccatttgctggagggagtgtgctcctgatgccctctcttccccagtcagggctggctcagaagctccatgctgagggtctttagagacctcaacttgcaggaggtgaggttgctatattgtctccccaaagggtctccatggcaacttgttgttatccagctcaaaatgagaaggttccctctcctttcatttccacagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtaagagtgtcctgctctgcgtagagtggggcccaccttgatttgtccttcccacggctcctttgtaatcacaggatacggtagaggcacacagacaggttccatcaaagtacaacaggggctgacaaactgtggcccacaggccactttggcctgtggcgtattttgtatggtctgtgagctaagggtagttttacatttataaaggattatatttttaaacacaaagaatatgtgatagagactgaacatgctccccaaaagctcacatatttactgtgtggcgtgttacagaagaaatttgccagcccttgaaggaaaaccactcatgagtgtccaggttctagtaggctccagatatcctctcctgacttccgtaattcccatccagccatccacttgtccatccagttgtctatttgtccttatttgttcatcgctgtccgatcatccatctaccctttagctgcccatccattcagcgaccactgacccacccagcatcccaccctaccaccaccaccatccttgtctgccattatgtcgtgccaggcactaggaatatgaatgtaacaaaaacacagtccctcccctcaggagctcatggtctgcatgtagcagtctccaaagtatatttctgtagaactccagttccttcggacctctaggattgatgtgttaaaagggtttgtgccctgacaggcttggaaatattgcattaggcaaagtcaagcaggtttctttaccacaagattaattcaagctggttgaatggtagtgagcctttaatctggtacttgtgaattcaccagagaggggtatgcagtgtttcccaagctcatttgactatggaaccttgtgttctcagaatatctgtccttgtcagtgttccatggaacccagtctgggaaatgctggctgagaagagtaacagtcaggttggcttcagccaagtgcatacagctgccccttgggcctcaccctcttttcttctctagccttgaactctgtacttcctctctctgaccacagtctcctgtctgtctacctctgctaccagaaccgtggccctgagtcacctctgccctcagccaga

SEQ ID NO: 104616 - DNA, 1066 bp, Homo sapiens
atggagcttttattctgagaatatgtgtttgtctgtttgtttgttttttgagacagagtctcactttgtcacccaggctggagtgcagtggcacgatctcagctcactgcaagctctgcctctcaggttcaagtgattctcctgcctcagcctcctgagtagatgggactgtaggcacctgccactatgcctggctaatttttgtgtttttagtagagacagggtttcaccatattggccaggctggtctcgaactactgacctcgtgatctgcccgccttggcctatcaaagtgttgggattacaggcttgagccaccgcacccggccgagaatatgtgttgttatttatgactggattatgaagaatcaggagaatgcatttcatgtctgattctgctgctaattaagtcaatcatttaatttttgggacctcagtttctttgtaagtaaaataacacctgcttgttcttcatccctgggctgttgggaggaacagatgagacagtggctatagaagcacttggaaaatgcacttgtcctgttttgtaaaataaaaaggtattaaatgtgtatttctgccatgtacctaatgattattcagtgcgtatatatctgaaaagtcatgttgcaaatctttctgtgaaacagatgctattttaaattcactgggagaaatatcctatttaaagtaatctatagtaatttctttttatataataaaaatatatttgtaaagtcgacagacaacttgtaattagttttgtgtctggaagaatttgtttagagaaggcactctgtatccttgagatggggtagcaaagagctaggatcctggctcttactgttgactgttaatagctgcatgatcttgggcccagttagggagttactctgaggctctgtttcctcatctgtacaatgggaaaaagaaaacgtacgcatcttgtagggttgttgttggatgggtcctgcctggtgaaacatttggcagctccccagtaaggacagctttggcttgatgtgtgatgtagctgagctgggtcccagtccaggtggacagtgat

SEQ ID NO: 104617 - DNA, 2424 bp, Homo sapiens
cttatgtcttgccgtcctcctgggcccggggtggcgggaatctgaggtggggtcgccaggaagggtggtgttggaatccaggccccctgtaccttgcaggtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggtaggtggctgccacgctttgcaatcggtgaagccccttccacatggcttgagaggttggggatgggaattttggtggaaggagactacaaaacattacatccttgaaggtctggaaggtctttctagaagtccactccccccaaactcgaagacctagcagtcttccaggcgcgtggcctgaagttaagtagagaggtaattttcaaactcggcagcactttggaactacttggaaagctttaaaatacttgggcctgcctcctactccagagaaactgatttattgggctgaggtgtggtctgggcttccagatttttcagtgctccccaggttattgtaaacgtgcagccccgttggagaatcactgcagtagaaggtggattatgtgctcaagagaagaatgtatttattttagttgtcagtttaaagaattgtgtgcccttgtactttgaaccactctgaatcacagaaccaagaattgcggttcttggtgtagcttttctccaaagtcatagtttccagcatgttggggttttgcttggtggtgctagttttttttttttttcttttttttttggaggttaaattgttaattccctaatggaaacatgcaagagggtttcataagtactttgagcagaccaaggagtgcttcacagagaagatacatttcgctcatctactcaatcaaggctttgaacaaatatgtgttgagggtttagtttgtgccaggcaatgttctaggtgtttgggattctttactaacaaaacagatcactttccccttagagtttgcatcctagattttgaaggtctgagtcttaagaagtgagaagttctgcctgtggaggagtggagaaacagtcttatttgggatcagatgggctgcctctagagaaaattactttacaaaagcaattaaaacaggccctaaggaatatgtgtttgtttttaagcctagccttggtggtttcttttgtgtagctgagaaaggaggctgtatttgactgtttgtcttggggactcataggctaagtgcccctggttttttcaatgtggacctcactgtctgaactcttgtgtgggcacgtggattttttctttttaaattcacaaataacagtgagttgaaaagccctgtctctagcgtaggaatgctgaatttgtctcaaatcaggtaagtatgggactttgctcatacaagttaatcttgccattaatccttgatacaatttcagtagacttgggtacagcataaaataataccagttgattcaatttagcttcactgacaatttgtagatagagtgaaacctgttactgggagaggcaggaaatttactttacatagtctttcaggtgtgctgaatccctggctgtcctaaagacctggaactcaggtttgagggtgtggtctctaatctgggtgggtctaattgtaggtggacccacctttctctcattaaggctaaaggggccttgttttgcaagaacccaatttaatggtttcagtagaagcacttgagggttattgtgggccacgcactgttgggtctgggagtgatgagcttctagggagcagtctggtgggagggctggaggagtggtcgcatgactgcccacaatgtggtatgatggagtagtgagcccagaatggaggctggagagcgaggtagggggtggattgcagcaaggttttagtagccaagggaatttggattttatcctaaggacaatggattttattctaagggacaattcccttagaattgtattctctttttttgagacagattcttactgtgtcacccaaggtagactgcagtggcatgatctctgctcactgcagcctccacctcctgggttcaaacaattctcctgcctcagcctcccaagtagcta

SEQ ID NO: 104618 - DNA, 1118 bp, Homo sapiens
tccctttgactggtagaaccaccactgatttataatttgccaaatgcttcatgtacgaaagtgcccttggaacagccctttcaattctgttttttttttcccaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaaggtgagtaaagcttgtaccaggcatctgactttttagttctgttgatgaaatgtgttccatctttctagtttgatcctaagtgttactaattaaaaatagtactttacttaaccaggcctccagggaacaaactgatggttttcttctaacatacttttcagattttcagagttattaataaacctaaactaagtgcttttttttttttttgaaggatttatatgttaggatatgggtttagctgctgtgtaaaaggccaaaatcacagtggcttaaacagaatataagtttggcttaagaaggatggctccatcatgtcagagatactggtaccttttgtcttgattctctatcacccctcaacacagtgtccatctcttggtgtgaaatggatactctgataggactcagggtttgttatctgggcattctggccagtgggaaggggagaagaggagagtgcattccttccctgttaag

SEQ ID NO: 104619 - DNA, 1070 bp, Homo sapiens
caccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtaacaaggctctctttagtctgcttatagttttaatttttcttttagttgttgaagcctgacaataagggtttatctaattttagaagtaaataattgagaatccctgaaaacgcagtgtgcttgctctcatccagaccatctagatgccatttgtcaaatgctttacaagctatttcttactgttcagctttattatggaagatgagggagaagtactttgtgacttcttatggatgatatcaatgtcaaaacatttgttttctttctttcttgggaagcaataaactttaggttttcttaattgattttttgagagggagtcttg

SEQ ID NO: 104620 - DNA, 1168 bp, Homo sapiens
caaatatttgagtaccttctgagagccaggcaccttgctggagatgcacacaaacaccacgccctgccgtccccaacagctctgcataggagaggtctggaagttggtatctcttgagagcggaggtggggacagtgaggtgagggacattaactttgcgctttatgttcttgatccctgccctgcccctgccaccccaggtcggcatcatatagtggttactgtgtggaatgccagggttcaagtttggatcctggtgctatagctgctggctgcaagttaacttgccctcactgcatgctgcgcagacagcagcacctgcctcagggtggttgtgaggactgcaggttatgatagacgtgcagtgctttgggcactacctggctctattgtaagtgaccaataatcattagctattattacattatatagttaaaaaaagagagacacagggggtgcctgctggactgggcgttccagaggtgatggacttctgaagtgctgctaaccaacaggggttgtcgctgtgtcctctcctaggtatttgagagacagctgcagctggctgtgtctctaaagaagcccttggtgatccactgccgagaagctgatgaagatctgctagaaatcatgaaaaagtttgtgccccctgactacaagatccataggttagaagactggaacttcagcgggcaaatgaaagaaacacttcctctgtcaagttgatgaggacagcaatgatcgtattctgtcattatacactatctattcttttttttttttttcgagacggaatctcaccctgtcgcccaggctggagtgtagtagtgcaatttcagctcactgcaacctctgcctcccgggttcaaacaattctcctgcctcagcctcctgagtagctgggattaccggcacatgccaccacgcccagctagtttttgtattttaagtagagacggggttttgccatgttggccaggctggtcccgaactcctgacctcgtgatctgcctgcctcggcctcccaaagtgctgggattataggcgtgagccaccgtgcccggcctatacactatcttttctaaagaattaactattaggttaaaccacttgaaatttctcatatttgacctttttttttttttttgctcacaaaatagtaacttcg

SEQ ID NO: 104621 - DNA, 3392 bp, Homo sapiens
ccaacgaggtggtattgcaggaggaggccctaaatttacagattggtaactatatatatggcaccaagaacatgaacaggtatcagattaagaaaatccacctgtagttcgactccccagtattttgttagatttcctttcagttcatttgactacttgggcatagtttttatatgctgtcgttgtcatcataggggccacagttgttgattttgctcctcttcagtgttagaagcatttcctatcccagtgtgttctctgtggtggtcatctcaggggactgcagagcactctgtggtgtgcgtggtatctctgagtgatctctgatcactcaccaagtgccatctcggggcttcctgtgttggagccagcccttgtctgtgtttactgtggagtccttccctaggatgcagtctttccatttctgggaatcattgaaaaggggtgatgggtgtggggggagctgggggctgctgcagaggggactgtgagcagccctgatgtggagttctgtctccaggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggtaagggggtcttcaggctgagtggaggcaccggagggagagggtggggaggtgggtggtcacccttacaaggttggcagggccagagccccagtgacttccaggtcccatcctgggctgtgtagatgcctccttgctgttactctgcagaaccaaaagtctagggggctgagaagctgaagggtaaccactctcttccaggcagtgcaaagccctaccctgtagagggtagtccaaggaagcgtgggaccctgctcacccagagcccccatgactaggactctccctgcacctgcaggtaaaggggtctctacagggcagccccaaagaggtccttgctggggaagggacagggagggagttctagattatgactgtgcacacatggcacaatgatgttatgaccacttgatgtcttccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaaggtacagtcctcgggagtctcctagaaaaggtcgtaaaactcacattctgtattttttaaaaaccaggacaagtcttttgttgcattttgttaatgtaaagaatataaacatagtatgagcattaagcctgatttgttttgagtgacatggtttggaaccttcttctttttctcttccaccctccagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagttggtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaa

SEQ ID NO: 104622 - DNA, 1893 bp, Homo sapiens
attaggttttctaaacatgcacattggccttgctacttgtccttttattcccttcccacagaccataaaccaagaattatttttatttgtattattttgatttttttaaagtaaaatattaacttttcctctttgaaataaattcccatttggaacatcagcatacagtttgaacatttattcgcctcctgagcttgtacaacagtcgtgggagttgctgcagaagcaagcgaaaagccagatgagcgcttctaaacttagagagaggtgagtaaggcttgtgggcgatcacttgtcggctggggcctctggaaagcaagaggttgagtaagaatgctgggtgcaccgtcctgctagtgcttttcttccacggtggtgagattggaggtgggatgtaatggtgggggttgtggggaagcactggccttggagtcagagggcggcactcaagtgtggactgttgtgccctgggcaagtcacctcaaagctctgagtcttggtttcctcgtttgcacagcggggtgaatgctacccctgctgttccccaggggtgacgggtcaccgccttggtgaggacagtgctttgcagatgtgcaggtgtttctgccacctcaatcagttgggcggtttcttttttttcttttacaaggtgaggggattcaaagcaaaccctttgcttaactcaggaagctctaatatttgaaggaactgcttaacaggctgcagaacctgttctgagtgctattttggcaccaattcctttttgtttgtggagtaaagttacgcagtgaagacggtgtaacaccaaataattgtagactctcacaataggtaaaatagctccattttacagttaaggaagctgaggttcaactgaggccccaaagctagttaatgtactagttcttagaacattctttgaacacaaagactatgatgaactcccttctgagccactcacaaatactagccaaccactatcctgcagatctttgggaaagggaaattagaagttcttttggagaggcagaggttggggaaaactcatcacccacagagtgaactcccatgtggggctgcaaggaaaccgagcaaacccagtccaggcaggactcacctttggcctcttcccagaggatgtcctgaagaaacttccccagggcctggctgtgctgctggtactgaacccctgacagcttgattccaacatcaaagggggcgttgaactaggaggcagggcagggaggacccaggagatgtcagaggtcatgcccatccccatctcaaagggggctctgggctctctgcctctcttcaggagtggagagggagaatggcctttgggccccagcagggactgctgagtgacacctcagccaggttctcttcctttctcaggaccacagctcaccttcccactcaccatctttcagacacttaccttgcactctcatgcctctcagccttagcctctaatgggattgctgataaaagctgtggtgccccctagtgtgagattttttttctcccttgcagttttgaagacaaaaggttgagtcaccaatggcagcatttcaggccctggcagggggtctgcccagcattctcagcactggcctgctggccttctattccttccctgctcccagctctttctcctttctctcttgtctgtttcttctcctttttctccttccctaggtattttttctctcatatgcatagacctttctttgatgcctggaaaatcaaaaggaagttgatgttttcctagaaagaggctctgagccaagtcctttctgtgcttccatttcttcccctctacagggagagcgcctcatctcttccattttccaggtattcctgagatgatttattggagctcaaagcttt

SEQ ID NO: 104623 - DNA, 2410 bp, Homo sapiens
aaatggtgtcaccaaccaaatatttagaagaaaccattccctgaaccacagccacaggaaggttgcatagaaaaccccgtaaaatcctttactccctcctcctctccatccttgggttgtcttaactttctccttgccccacgcacgatttgtcagagcacatcacccacacctgccccctccttgcctccaggcgaggtgagtgggtgccggagcctgggctggcgccagccctcccatccagggtgctgttcggaagcactccaccccacagtccaggccctggaagcccctgagtaaaacatggttttctgcagagcaacatcttcagtctgggcctgccgtttatttctgggtgtctttgtctctgggcactgtattttctgtcccctttgagtcgcctggaggctctggcaccctctctcctctgcccaggctccttccgtccctattctgttgtagcaaagttacttcttctagatatttttctcttaatgggtaaagacctcacagagcccagggcagagctcaactcctgtggtactggttttatagttctggggagcttgtagttgggaccctgttcactgccacctctccctgccctccctctcccctgaccccaccctcctcgctgccacagaagcataaaactgcagaggtaccgacccggacttccagttcatcctctgccccttctgcttgacctccatcttccgggcggagccagcctgctagagctcggggctgcagcttggctggtggcttcttcgactcctttctctgctggaagggggaaacagtctgtttaggactctaagcccccatgtccttccagaaacagtgaggtcagacccagagtcctttgtgctctgggagaagactgaagcccagagatggcgctgctgctccaggtcacagagctggttgctaagtggcagggctggaacaacatgtggggctttgtggggaggtctcacctggactctctggtgttcagggctcaggaagctggagcctgccatggccaagtccagccagagcatgccgaggagcaggaggctgcagacggtccctggggagggcatggcctcagctgggttgcagacaggtgggcctgggggagagagggtctccaggcagctgcctccccttctcatgtgcctctgagcttgctcaggtaggagcccagcagatggcgtgaagggctttaccatctggggtcctgactgctgtgtagagaggacccccgcttccacctcccaaggtagaagatgatggatgtgtgttctcttctccaaggccgttcagggcagaacacctggcagcaggacttgataggggctgggggtcctccccggtgccttttgtcccaggctctgagagctcatggcgagtcttttcatgaggagggaggaagctgaaccagcaagggccccagggcactcagcagggagggggttagaggtagctcctaaatgaagctctgtcttccagccagacagtccgacatcccccgtgtttagaggggactcctgaggcccagagaggttaaacggacgggcagcagtcacggacaataaacctgtcagcaaacgcacacggagagtagagagagcttacctgcagttcctggcggaggtggtgcctggtggctgtcaggtccttatataggatgactggcgtttgttctaaaccagcaaccccatcccagaggtggcctagcttccgtggggctgatgtacattccttgggaactaaaaatgttcttgtcctctgggtagaagtcaacagtggaggtcagatgccctgcggaattgctgggttggcgagggaagaagcatgtgctccagctgtccctggaacacggtggcggggtgccccaagtgggcatggccctggtggaggagggagggaggagagtggctctggggtctgggtgcagctttgttgctgtgtgaccttagcttactcgccctttctccctgggtaaaatgaggctgtcatcactaggagagctctgagacctccccagtccagcgccccgttgtttcccatgtgctgttgctgctctggcctctgtgagccccgggagtccgcagggagccaggctggtgattctacaccttcccgaggaggagtcccacctcccggttgagcagactgctcctgatcatcctctccagagagtgggtgtggggataacttcagccagtggctatgcttcagtcatttctgccaggtgtgacatgactgcctggcctggcgttttttcacatagcagcttgccttgcctccctccagcagctttggtccctattttagcggatgcctcttctgagagggaagtgcattggacctggaggtggaagatctacgcttagcacgggcctggctcctctctcattga

SEQ ID NO: 104624 - DNA, 1112 bp, Homo sapiens
cttcagtgtagaaacaacatattgaactgttaccttcctctaccacagtagttttcaaactgcagtgttgttaaacctgttaaaacagattgccagccccacccccagagcttcctaatcagttgttccaggccccaagaatctgcagttgtagcaagctcccaggtgaccgatgctctgctctggtctggggaccacactttgcgaaccctgctccccgccaccccatatcctctcgctgtagctctgtcacagtttgctgaaaacagtatcctgtgttgacatcatcatccacagctgctgttattgttactcctttttttctgtgagtttttattcctggactctcattttggtgagatttcagtggaggagggacatgctctgttcacccacaagcctctgggcagtggttcttgatgaggatgaggctcatatttaggggacagcagagggaagggcacagacccgtgataatctgcttgtgcactgactcgcaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataattcctgctgcgttatcctaaccaccccaccccaccagctcagtttgactcttgtcggtccacgcactagaacaaactattcacaaaggccacggctgtgatggcctggcttaaccccacgcacaaaggtggcttgtcactgcatgagcatctctgattcagtttatac

SEQ ID NO: 104625 - DNA, 1056 bp, Homo sapiens
aacctgtttggtttggttctaaacttgggatttttgtgcttttttacttgtgccttctcattcttggagcttggtttttggagagctctgcccattcagttgagaaggtatagacggccagtggaagtgacttggcaggcatgaggaaaaccccagagaaaatctgagttagcaatgcagacagagtccacctccgaaacccggatgagaaaaggaatccgggagactcttaaccagtgtgaagagacagaaacaaagctgtggacgccccagaggtcctcggctcccctttgaatcccccaccctgttcctgcagagaggtgccgggtggctctagactgggaggacatcacatcacaaacgcaggagtcttgactccacctcctgactctatcctgtttcttcctaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtacatacccattccccgtggcatggtggacacagcctgttggtcttcaccccgcccactagagagggcacttgacattcccatctgactgcaggctgggcaggagccttagccaggactgcgttttgagtgtgcctcttagttacatcattaatgtcacagcccctgaggtagtattaacacgtccccctttcacagatgaggaaagaagctgacagaggcgatttgacttgcatgggggtcccaaaactatgaggtggcagagccagtcaggcccatcaccctactaagcatttggtcacctcatggtgatgttcagttagctgtgccaaaaaggcaagtgtataagaacccataaacagaagaagattggggatattttttgtccataacactgaaaaggctttttaaaaacctttagagtttatgaatacttgttatgctggtaagaggcaggtacacagtgggtgcactggaagagtttgcattttgcagctgaa

SEQ ID NO: 104626 - DNA, 1033 bp, Homo sapiens
gtggaagagggagctgtgattaggaagggcataatgacagggcttttcaggcaggtggcagaattcttgtttcttgatctattactttataataaaagatttttcttaaaaaaaagctccaatgtaccattctttcatgtgtttagaaaatgtcctgtttcttaaacttgtgggagttcttaatttctacttttagcgcacactgcagaaaaatgcacacactgttgggatccttgagggagaattctgagcagtggaccccatgatgagtgcttcatgtcagccttcacacacactccagtcctgagaagcggaggggagagggacagcaggcttgggtctgcagaagcagtgttctcttgcaaggcagagtcaccatgtgtcccatctttacagattggctgcaatgccgtcagctgggcccctgctgttgtacctggaagcctcatagaccacccatcggggcagaaacccaattacatcaagaggtttgcatcaggtggctgtgacaacctcatcaagctgtggaagtaagtagggatgtgtggccttctctttgaggggacacttctaccctttaccctactcaccatgactcagccacactcacaagaaacaaggtcacctttctttctccctcctgccagtaaaatactgttttcaatctgttggaggacatccttgaaaaacaacacaacacctgttcacctaattcccaactgttggagctgactctttggctgtggaagcagagcattttctggagggttttttttacagctggggtgaagggaataaaatgccacaaactccatgaatgaaagaagaaagatggaatcgcttctccaccccaggcagagcctgttgggttggggaggagttgaggtgtgggaacggccccctgctgattctctttctgtccccactgttagggaggaggaggacggccagtggaaggaggagcagaagctagaagcgcacagtgactgggttcgagatgtggcctgggccccctccatcggcctgcccacca

SEQ ID NO: 104627 - DNA, 1530 bp, Homo sapiens
aatatttcctgaacacttctggctggaaaccttggaccaattaatgactatgctgtagacagcacatacagacagtgctggctgcagtctgggcaagtgaggctcctgcctggccaggacaggaaggctgacccagaggctcaactctctctcaaaggctctgtgaccttaggttgcttaacctcttaggacctcaggctcctcactgtccactgagcaccccttttgcaatggcattgtatagttctccctttgaagttcttaagcaattctgccctgatatatcgtctcagggagccatttagttctgtccaaagtagtgcctgcagaggcactgtgggttcctctggcctatctctccctttgtagtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcaggtatgctgagcttggcagcagagcgggcaaggggaccactgggtaaaaaaggactctgtcccggctggagccctggctccctgcccctcgtggtgcctcttgtctgtctcttgagctttggttggcttttctgctactctgtcctcagctgagtaaggccctaagacctaaagccagtccaaagcaaataagaaaagacaggtgagtttctcttcaggattattcattgcaaggactacccttcattctcagattgttttcctacccacttttttgttagatagactgtaggttatgaaatcgtggtattagtaggtgatggggtttttttgtgtcctcagttgaccaagttacagcttcccccggtgactcctacagttgtttgttgtagacatttagtaaaacagtaaatctgtggaaggcgggacctggggccgcggtctccctgctttgctcactgcactctccctcttcccgcagtgaactcggtgtgctgggccccccatgactacggcctgatcctggcctgtgggagctcggatggggccatctccctgctgacttacaccggggaaggccaatgggaagtaaagaagatcaacaacgctcacaccgtgagtccatcccctgcctttcgtgcagtgagagcgcctgccttgccccgtgtctgctgcagcctccctagagggtggcacgggagggtccccgctggacagtgggccggggagtggtcagctgaccagacatgattgctctagagcagctttgagcctctctgccctgaagccagaccaggcagggcttggcactgcttccttgttgtgtgctcccaagcaggggagggctggtgcagcagcagcctgctcactgccaccttagctatggttgcctccaggtgacatgccctgcagtagtcattgggaccctgtagaatggagtggtgttattaaaacttttaaaaagtatgtgagctatgcatacatttaagaaagattaatataaacaaggt

SEQ ID NO: 104628 - DNA, 1659 bp, Homo sapiens
tacttaaccgcagctttacagaactcagtgtaacaactgctttacattctagacaggcagcctggtggagtgaagttttgtggactcagcattagaaggttaggggatggggctcttttcccaggtctgccttgaactagctctgtgactttggcaagtgctttctcttctctgggcttcttcatttccttagtctgtcgcaggtctctgattgactgtgcccttggtaccctgccctccccgccttcctgtgcactttgtaacctatacagctcggcacatggaggaaactccttattgtccttacttgcctttgcagacttcggggacctggtttttagagagtctagaatctgatgagagaacctgtgcttacttggtgtgtacctcttgaactgctttgcagccatcctcttccactgtctgcctttctgaaatcacaagtcaaactttatacctacagggcttgtgctggaaaagatgaaatggggaaaatggtaagaaatgtctgttccacactgaaacttcttttaagtcctcttttctatcccaagaatttaagagaagagtggttgagcaaagaaaaaaaataacagcttttgttcatttacttattcattcagcaaatagtcgctgagttccttctatttgcaaagcactgtgctggatgatttgaggggatttgaaactgcagatggctcagaccatggctccaaggagctcaccttctagtggggagaagaaacagcataaagtgttgtatgtgttccttgctgaagatatgcaagagagtccagccatttgagggtctgagaatcttcaagaaaggtgatggatggccctttttgagctggacctcaaagaatagataggagggagatgaccatgacaccatgttccagccctacaaactgttcaactctggatcccactacgtgacggaccagggagcagcctcaggaaacactcgaatcaagtctcccagtctgaagtaataaccccgttatgcataaactgcctggaacatcagaggctctgtcatccaggaaaggaacaccagctgtagctcccttggggtctctcctcaaccttaagggtagccaggactgcttgccgtttccccacacacatcaggctctctcagacctctttgtctctactcgtgtattccctctgcttggctgcttggactggtattttcccctgtgccacctgcaaattcctacccatcatctagggctcaattcgtgtctaccaccccagcccctcaggctcctacaggacacacaaaccaccattaaataatttatcttgcgacactagcattattcgcgagcttctcaagggcaaaaagttcctcttatttgtgtctgtatatccagttcctagcacagtgcttggcagaaagaaggtacttagaatgaatgcttactgaatgaatgaatgaatgagtgagtgaacaaacaaatgcagtcaagaacttgagatggttgtattctaactgccatgagttaatttaccagtgatatctttggttctaggtgtcagtaattaacactgtggatacctcccatgaggacatgattgtaagtattaatatcaccctccctggaggggtgtggacatgggcatttttgtgggagggaagcaatttggggt

SEQ ID NO: 104629 - DNA, 1043 bp, Homo sapiens
ttctgccaagcactgtgctaggaactggatatacagacacaaataagaggaactttttgcccttgagaagctcgcgaataatgctagtgtcgcaagataaattatttaatggtggtttgtgtgtcctgtaggagcctgaggggctggggtggtagacacgaattgagccctagatgatgggtaggaatttgcaggtggcacaggggaaaataccagtccaagcagccaagcagagggaatacacgagtagagacaaagaggtctgagagagcctgatgtgtgtggggaaacggcaagcagtcctggctacccttaaggttgaggagagaccccaagggagctacagctggtgttcctttcctggatgacagagcctctgatgttccaggcagtttatgcataacggggttattacttcagactgggagacttgattcgagtgtttcctgaggctgctccctggtccgtcacgtagtgggatccagagttgaacagtttgtagggctggaacatggtgtcatggtcatctccctcctatctattctttgaggtccagctcaaaaagggccatccatcacctttcttgaagattctcagaccctcaaatggctggactctcttgcatatcttcagcaaggaacacatacaacactttatgctgtttcttctccccactagaaggtgagctccttggagccatggtctgagccatctgcagtttcaaatcccctcaaatcatccagcacagtgctttgcaaatagaaggaactcagcgactatttgctgaatgaataagtaaatgaacaaaagctgttattttttttctttgctcaaccactcttctcttaaattcttgggatagaaaagaggacttaaaagaagtttcagtgtggaacagacatttcttaccattttccccatttcatcttttccagcacaagccctgtaggtataaagtttgacttgtgatttcagaaaggcagacagtggaagaggatggctgcaaagcagttcaagaggtacacaccaagtaagcacaggtt

SEQ ID NO: 104630 - DNA, 1131 bp, Homo sapiens
ttgaacctctgctttaaagtgaacaaggctcagtctctcactaggtgtgggtgcccgcaggagtcgactgtgcttcctttaaccactgttccccatcatctctttgatggtgcttggtgattcctcctgtcctaacactagtttctaccaaaaccaaagagatttttaaaaaccagctcaaggatgcctataacctgagccccctttttcactctcccccatcctgtcaatgctaataacacccagcgactatggattccagccacctgctttgccctaacccttctcccacccgcccctcctgtgagccccccgagcctggctgtggtccctgggcagtgctcctgacccctgtgcttcccttgcagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatc

SEQ ID NO: 104631 - DNA, 1039 bp, Homo sapiens
tgtccaaatgtgtgtactgaaaccacagaggctgtgatcctgtctgggaaccagtgccctcaggcaggggtttggtcaggctctttttaagactataggctcaggaagggtctcaggaggcacccagaattacaggctggattctgtcacagagggggaatgcgagattctccaggaggcatgaagagggagaggcaagatggtgagcagggtggggaggccctggccaaccctgccgggtcccctgagagaatgaggggtcagggcaaggactgtcaagttggctttggctgagcctctgcctgggcttcttttccaagactgttccaaagttggggtaaccacgggctacaggggactgatctggcctcgaaggaggtcagtgtagacacattcctgtctaagcatttctgcagaaatgaagaaaagggcatttctgcaaagaagtgttgttcccggacgggccctattgaatggctttgcaaatgaggcagaagaaaagctgagaaagaagtggctgaggtttgagcggacagctctagcttccaggctgtgaaagctaagatgaggggctgactcggggacgacttccaaaggcagtgggcctgcccagcgatgtcaggtgtgctccgtcgtggccagggtgaagtgctgcccttcaagaaagaggctcaactgggatggacaaagaactgggccttcacccagaagccagactgctagcaggcagccccagccggagggccgcaggagtcatcgggaggggtggcagaacagaagtggattcttccccatgtagctctccctgccgggacacttggttaccgcacctcaggataggtgggggtgctgagcaaggccagagctgagttggtgcagaaaggagctgggaggtcagctggctaggctgctgctaaggtgagagctctctggtctaaaggggaggaggatgggaccggtgttgccttccccgagaaatcctggcagtgactgcctagtgacggtatctcatggaaatgtgactcagccaccatctgct

SEQ ID NO: 104632 - DNA, 1038 bp, Homo sapiens
gcagaatgggaaagagctatgccttcattcctaatcttccccaaaaggcttgtccatggggctgaggacccagacgcaggccctacaggaaagctgcggtggcagatatcagaggccccttccatttcctgtaggagcagtcaggcgctggcatgaatgcagcctcagggggctccctgggagtgtaaagtcagcactgcccgctggcattaacctttgtcctctgaatccttccctcagttactgggcccagcccccaagagcctcctgtagggggtgggccccagtgggataaagatggcctggcccccagggtgcccaggggtttatcactctccaaagcagccccaaaggttacaggaagtccttttggatgaaactaaactttcttatttatcttttagttaatttttgcccccgtagcttctcactctagcctgcagacagcttgaaggcaagaaaaatgcctcccacccatggggtcccactgcctggatgtgtgagcaccttgggaatcaggccccttaggccctgagttggttctgggccctcctcccaagccctgtgtcctgggtcaggagcctttgggctgcatgctctcagagctgtgacagggtctggaacttgggcaaacgtagaaaaacgaattggtgggagaatattctgggacaaagctggaagggcccctaaagagcatccagcccaaggagccccagagctggggcaggcacagcactgaggccacagatggccacaggcacagcactgagtaacaccgcaatgtggcagagtgtgtcctgcttgcgttccctctgagtgctctaaaggatcctgattgacgccagccggccaccagcgcccgcagaccactgattcatctcccttcctaacaagctgctccagccttgaatccctggcaggccatggcttctagctggagtttaataatgtcattctcattacattaatgtttttgttagcttccatttatgacaagtgatactgatttttcagttgtcttagtaacaggacgttgcc

SEQ ID NO: 104633 - DNA, 1825 bp, Homo sapiens
aatatttttccactcctggcccccaatgggcagccagatctcctcatttcatggagccctctcttccaggggactctcttgactggttggaccagcagggtccagacctcagcacagaccagcaccatcccagctaaccaccctggtcatccaccatgctttatttgaaagaccctccatgtctgagtttctcccctcaacctctgcggcatctctatggaacatttcacccccaccccaaatttgagtttcttggtttccaaaggataatttttttttttaagaatagagtcatgttatctccccacaagttggttcatgtctttgtcgttgttgcttttctccattgtgacactgcattttccatccctcccacccccctgcagcagcagacggtgcggcagcttcaaatgctgcagatagtgcgaatgccagcctagtcaatggtatgtctcccacggcgagctcctggtcatggttggatgggcgtctctcacccccaccccaactttgggctttctttccttgttctggactgcacagatctcggatgtgcatgggccgctgggacagtcaccttctcacatggggcaggcgcttaagacaggagccacagccgggggagtcagctctgcaacctgtcagcctcacagctgccaaaaaggtgctggctcctgtcgagcccttgactccccatggagcccagataagagacgagactttggcttcagattggctcccaagaaggagcgtcccacctggcatggccctctcctaagtgtattcctggccctggctttgggaagaaggcctgggatcagggcttgggctgaagctggcatctgggtccccagcaaaggctctagtcctcgactctaaaatttcctcgaggcaaggggacccaggccgggattcagctccttggccctgtcctgtagcatggctgagccagcagtaaacagtttttcctcttctctttcacggagccaacgggcagggggttcgcttgggctcgggcctggttctgtccttcggatgtggactggtgtttcttgctgttgcctgtgctggagcgtttgtcctgggtcacaggggtggagggtgggggagaggggctggcactgtgtactggtgtctgcatcttaatctccttacacgcaagcaagaaggagttccattcacttgcccccaaagcctttagaagatttcggatttctatccccttctggcttcagagcaacagacaaggcttttgtttactcagataccacccctatccccaaataaagtgacataatagtcccccaggctactcctgaactgttgagagccattagggctccatcatgaaaacattgccccagaggagctgagggcaggggaaaatctttttcccaccgtctctgcataccaggcactgggctgtgggtttctcatccattatatcatatcattcacttctcaccactcctgcaaaatatggagacttgttccccgcagcctcccatcccctgccctagacctctccccaagccacctgcattcaaagtgcccaaagatggaagcacctagtaggtgtcggggctgagtaaggcacttctgcgagcagtgccttgccaagaaggactaattctggtatggctctatttcaggcacaggaggaggaaggatgacagcttggggagtgggaggtgtcatgcctcagggaggggtggctgagggtgacaaggagaacccatgtgggcaaacccatggctgagagagaaggaacctagagggggcacccacttcaccccggcagtgagcctgctgagctttgtgaaca

SEQ ID NO: 104634 - DNA, 1774 bp, Homo sapiens
gaactctcagactggcatcatctttaccctcctgggggctggtggtgaagaggaagagaagaaagacaaaaaaggtaagcctaatccccttgcagaccaggagaggagctcttaaggccacattttttttttgtttatttgttcactcaacaaaatagttattgagtgccttctacgtccgcaccctgtgctgacagccacctcctgcatccttaaggcctgcatgggccaggtaggctctgtctgttccatctccaggtcttgtcccagtctctgtcttgtccaatcatgtcatggaggcccctccttcccctccgggccaggccaaggatgctgaccatgttgttgagtctccagcctcaagtggtggaaacagccagcatcaattggtcccatcatcactccagtattgagtagaaatccccacccattggaagcatattccttccaatattgtcaactccactgagcagaaatgaaaatccacccagcatagattcatccaagacatgggcagaggagattctgggaaaggtagccagatgcatggctccaaatcaaccattatgagtttactctccagtgctcccagacctaccatcttgtctgagttctgattcttcctcctccttgaaaataagattccttattcactgggctctcctcaatgcagcgagctgaccacccaggctaaaactgtctctcagaacagagggaaagatgctcaaacaaaaagctcaagtctcttcaggccaggcccaaatccaaaggcccaggcttctggtcccagcacagctgactccttacctgtccccacacttgatctcaaagatagcccccctttcacattttcagtcttttgtctccttcctcaagcacaaagggaggatctgtgacattcagaacttctagaaccccagaagggagatgagaggacagatgcctcccccactgagttttaggggcagccctgctccctccagctctcagaggctaatcaggcacagagcttaggtcgagactgaagattacttgttcctgaaggcaaaatccattttctagggggtcccctaagattatggtggcccctccagcaggacaatggggctgagctgtgttctgggaaattagaaggctggagagagtaaaggggtgctgaggctgaaactgaggaaagagtcgtgactaagagtcccagaggacataaggagagtgtgcacatgctgggtttgaatctgtggtaggatggctgagccctattccacaatgatagcagttaggcagatctaagcaggtaggcaggatgcagcagcctgtactcattgtcttcacctcactgaggcttgagtgaggggaagacgcccccagactcttctatgggccagatctgtggtttttaaaatgctagcagggccagatctgtggtttttaaatgccagtaggaagacaagtgtcaactgccccagaagcacagttcagggtccttcgctgagcatgcacctgcactcctgtgagatggagatgtcagaaaaatagcctcatgtagaaggaagatggggaatgtggaagggatgtggcagaggaagcctgggggagcagtccagcatctcaggccaccatgagcagcatggcctcagctgggccccctctgccctcccatcccatcacctccactaggaacattgcttagagcccgccacatgtccccatttcaggatgaccctaggtgtatggccatgtgtgtatgcacatgtgtgtttgtgtgtgtgcgcgt

SEQ ID NO: 104635 - DNA, 1011 bp, Homo sapiens
tgctgtactgatgtgtctgtcccccaagcccgatgctcagtgggcgttaagaagtgggcgttaggaagtggcagtgtggtgagagagttaagaggcagacatcctgggtctgaaccccagctttgccacccactagctatgttgtgctgaggaaatgacatcacctctcagaatctgtttactcagtctgtgaaatcattcttattcctgggctgtgagaagtaataaatgagctgatgtgagtcaacacacttagcactgcccaggaaacccctggaagtggagaccatcatcattattattattactattactattatcattatcatcatcatcattatataggttaagaagctgaggcccagagagggaggcatcttgcgcagcctcacacagccatctggcacaaaactaaatgagaactcaggtctcccaatccacagtcccagatttttcaaccacgtctctatgtgacactaaaggggaaaagaagacaagtaattcctaagtgccccacattaggaaagtaactaagtaccttttagcttctccacgtgcctttgggacattatggaaaaagattgttacagagaatgcaaagccacgtggatgaggctcaagaaataatgtgatgttgaaaaagtgggtttagcatcgtatgtcctgacaatggcaacacctccacgaagacagatgcaaggggaaaggggctggcaggaaacatctagaatgtaccccatgttgtggctgaagggtgagactggggtgatggttctttcctcagcctgtttctgcctgtgtgccgatgtcgctccactaaggcacgtcggtcgtaaacaacagaagctgactgggcagcatagtggaggcaagagggcagcttaggagtgggctctccaagttggagcaaaggctggaaaacccagctcaattttccagaaggaaacggggacatgcagggatcagtggcacgactcactaagtaaatgtccctttggggaactgcaggtt

SEQ ID NO: 104636 - DNA, 1069 bp, Homo sapiens
tcagctcaccatggaaaggaagcattccctacgttaaccctacaggcatgtgtgtgaggctctgcagtgacactcccaatcctgaacatttgtgcaaagctgcaccgagcctcagttttcttctcctggaaaatgggccaatgcctacctgacaatgcctagtgcgtggctgggcatacagtaggtgctcaaagtggcagccatgattattctaaggagaagtggatgtcaagtccttccccagatatctaccaccacctgggaggcaggcagcatctgaactgttatccttcatgacagaaaaggagcctgtctcctctgtccagtcctctgagccctgggccctgctggactctagccctggcagcatttcctgcagggcttgcctggcagtccactggtcacatgtgcctacactccactacacccagcagctcccagctgtctgtgtccctctttgtctgctctcctggttcagaaagaaaagctaaaactggttcttcttcccacattgactgttctcactgacattttgcccatcgcctgagcccaggcagaagtttagaaacaccttttctcactgggtgctatttttttgttttggcagggagggtgggaatagagaaagtaacctttcctcatagtgtgattctggcacgaggcttaaaaacagctgcttgtggccgtaaaatgggcatcggctttgcttggagacttctgggtcccagcttcttgtgctcacttatccctggcagaatggtccgtgctcccctccaccatcaggttggcacatgaggacgctggcaggcagggttgttcaagtggcctttgcctgttgattggggactgggagattgcctcaaatcaggaattcttaaatgtctctcagccccagtccctggggagaagctgatgggcactgtggcccctctctcagaaaatcagccaaccacacgcaacaggtgtggctcacactatttgtgggtttctagaccccctcaaagcagggttgtggaccctagttaagaaaaccacctaccactcccaccagaaaggctccccagagctg

SEQ ID NO: 104637 - DNA, 1026 bp, Homo sapiens
ctgtgcgtgtgcctggggccttcctgagcacctgtcccatgtggcctccagtgcctggcctttgtcactcactctgtgcttgtcccacaggagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtaagtgttcaagacttgaacccagggctgcagcctaggtggccaccatctgaattggccacagggaccatattcataatatgtaacagcagggatgtgtcagagaaaggctgaaatgccagaatggccattgtagtgcattctagctgagtatcagcccctctggataggctggggagcagggcttcatcaggggttgggcatgacccaagccacctgcagagagaatggcaggaagaaagctgggtcaagactgtgttctggagacaaggagccccacagccgcagagtggcgagttcaacattctgttactatgggaggcactagtttctgaggcagaggcagaagggccactgggtagaacaaacatggaacctgcacccaggcccaggaggggcttttgctttccccgcttag

SEQ ID NO: 104638 - DNA, 1017 bp, Homo sapiens
ttattcacattcttggtccctgcctcacctgcttctccgaggaatacattgttggggtcaaaactcatggattctgtggatggtgtgtgttccatccatggccaaggaacatggcctcttttgagtattgtaggtgggagcaccaagcgtgcagtttctttggtgtctcatgtctctgtgcctcttcttgaggtatcacatccattttatgttctattccataagagatctgttagtcccagtgtaaaaataatcttcctactgcatccctgagtaaaagcgtcccttgtgtaagacatttaaggtttctcctgtggctccagcacccagtgacccaagactgggaagccccaaatccagaaacacactggatttgaatacagtttataattagttctcagtaaactgggaagtagtcaggggtaggggtaaggaagagagactgttttgcccccaatttgcagatgagtgaaccagggctccaaaaactgaaggaacttgcccagggtcccacagccaggatttgaacgcaaatcgctccaatgccagatactgtgttcttagcggctgcctggcacagtccacccacccaccagggctcttcggagacaaacgcgggagcaccccctaggggaaggggaggagcccagggctatgagccaggagaccatctccttctgcactcctcagcactctcactccgtgcggctctggaagagtgctttttccctctctgagcttcaagttcccggctgggaaagtgacttagccctagaatgcctccagctctaaaatgtgtgaaagacgaaaaggttatgaaggtgataaggcaggggaggagttggagctgaggagggggtcagtcctgccttccttctctcagcccttcccctcaccgtcctgggcccaggatggccagctgtccatgactgcggggcagggccactccctgtgccagacccaaccgagctcagctggggccctttgtcacccaacgcttgctggggcctcggcctc

SEQ ID NO: 104639 - DNA, 1030 bp, Homo sapiens
cttcactggccagcactttagaaaagcatttgcctttgcccatgggagggcatttatggcaggggaactgcctgggcaaaagcctggaagtgtggaaccttacaaggtgcttattatggcaggagggaaggttacaaggaacgggtggaaggatatgagcctgaagaagcaggcaggcgtgtgtgtcaggctaaggattttgaaccttgttctgagggcagtgggagccaagcaaggcacctagtcaggtctgccagggtggctgcgtggctccggtctcctcctctacctgacctctaatggctggggctgggctctgagtcttttcccttctctggctgagctatgtccctcgatgatctcatcccatcccatggctttaaataccatctttaagctgctgatttccatatttatatctgtagtcagggcctctcttctgagctcccaactcatgcatccaactgcccacttggcatctctacttggacgtctcacaagcatctcaaagttaacaagtccaaaacaggattcttcatcatgcctacccaaccttctccacccacccccaaaagcctgctcccttccccgacccactgcagtaaatggtgccaccatccactcgccctcttcctaatggcatagctcaggttatcagcctactggttccacttcctaacccacccacccacacctctccaacaccactgctgcccctgcaggcaagacctgtccctacccacctggatgacacagtagccacctcacttcctccctgctctcaatctcaccctgccagtccattctccaatgcatgacagatccgtgaaaaagggaaaagtacgttaatctatcacctaaaattctttagaggcatctctcactacctggaataaaatccaagttcccagcggcttcaaagcctggtgtgatctggcccttatgcttctctgaactcactttgcctgattctctctcatcacaagccccagccacgtggccttctttgagttactaaaagcatgtcttg

SEQ ID NO: 104640 - DNA, 1216 bp, Homo sapiens
acgtcattgtgctcttccggagaataggggcagcagcactgactttatggggtaattgccaagtaccgaaatgttcatcataatagtactaatcgctaaaatgtgtccgcaagcactttacaaatgctttttgttttcccatgtaatgcgtgggaggggaattgcttattcagtcatgtgcgttcggttgtgtgtggttgaaccagtgacttcgcctcagtttgctcctccgtaaaccaagggttagctgagcacccatcttcccggttgtcacgtgaggcaaacaggatccaagtacagggcttggcccgggtgtggtccaggtagaggctcagcggatgttttcttgcctgtaagatgggatagtggtagtattatgatgatgctattatttgttgtatgaggatttggtgaagtaatgcaaaggaagcacttggctcagggcctcgccagaaattgatggaaagtggcctcctttgtggcatcagaaagatttgagtataaatcctaatgccagtgtttactactgtgtgaccttgggcaggtagctttgcttctctgagcttgacatcctgatatgcaaagtggagtgggaaaaacctgcctcacaagattgtgccacgagatgatgggtaggtaatgtctcaaatggaaccctcatcatgccaggcattcgaaatatgttgagcttctgccctgcttgtgggcatcttaaagatgtccccagaaggggcacatcctagtccaaggagggtggatttgatttgggaaaattgggagcagtcgtgccatagtggagcatatgggattggtggagcctatgggagaagcagtgaatggatgacaccgtttggggtccaagcaccatgtagctttgaaggaagaaagcaggtctctgcaagcttctgtgctgcctctgaaggcagtttcctataaagtggtgcctttcctgtgccggctgggctactctaccgggccatgtctggctgccccgggaccattttgtgggagccatgggggcgtcatctggatgaactcattctagcccagctctgtcaaacacctgccttgcaggcccaagggagctgtggaggcagtgggcggggaatgctgtggcagccatttggggtgcctcctgcatgcctgaggcatccacgctgagtgaggcccccaggctcatccggagcagagggtgctggcctccagctcactgatc

SEQ ID NO: 104641 - DNA, 1030 bp, Homo sapiens
ccccatgtactgttgggtctgacggttttcacacatcttcttggccaggcgctggaacagcaaggagcctaggagggatgaagtgttggttcttcccatccatctctgttggacccaagctggtagccctaagaggcatgtgtatctgctttagtgatgggcagttcagcatttggtgcttctcagaaatctgatttagttcacctgatgggaagggaagctgggatgttggaaatgacgtgggtgcttgtttgcatagtatagttgagaatcgtcagccaccaaaagaaaccagattaaagggatggtaccaggtactccactacacactttacattcattatgtctttctttcacaggcaaggaagttgaggttcaaagaggtgaagtaatttgcccagggttgcatagcagtaagcgaaagagcagagctccaagctgggtctgctgaccccaaagtttttgcccttttcattaagctcctgcaaggctcaaagcatggagcctggctagagctatcttgtttaacttaggccccttttgcttggtgtttcagtgccttcttccaagtgggccagattcctggggcaattaggagattcatttgttcgtaagcccaaagtgactcctcacgctggccagtgtgtacatttctctaaagtaaatggacaagtgacttcctctccctgggtgttagtttattcatctataaaagggagataataaataacaatggcacccaccttaaccgtgtggacgaggtgagtttaatacctgtaaagcactttccatctggtatgtcataggtactaataaaagttagttggtgtcattgtgatcatcagcatgactatcatcatacaccctcttactggtgctttcgtggcaggatgggttaatgctgcatttgtcaaagacctaaggcattaccacagcaaacacaagccaattcgaggacatagagatggatttaattggtcggtcagctgatgctggctttggtgacaagcagaggcatgcccttctgttc

SEQ ID NO: 104642 - DNA, 1028 bp, Homo sapiens
ctgtgtctactaagagggatgcccagtgccccactgggcaggacgggaagcctagcctgggccccctctgtgcacacagttcaggcctgcccagcttcttatgggcaagccaccatcccactctcgtctccctgagctgtctggttctgcggacccaggaagggccaggctggggccctgcttgtgtttatcctcggctgctgtcttcccagcaggccccaggcaaggaggcttcccattgctgctgctaccggttctccacagatccctgtggtccgccatcgccgacacacacacacgtcgtaatgtggctaacgcttgactcacttaacactactcatggggcagggcggagggtggattgttgctttttgttttttgtaatttcctactagtatttgggtaactttgggggtggggagggcaatgtgggggcaggggaacatgtcattgtgatgacttttttgatattcattagaaacaatacatcctttctgagatatttacagtattattaaaaaatgaaaaaggttgtactgttttgcataatgaacatttttattgggcattcaaagggtgcaagattgtctgcttactcatttttaaaaattaaagaaatgaacaatcagtgtggctattcctagcaaggtggtattcgttgggttttttgtcctggttttattccctccatgatatgcctgcaaaaccatcttgggtccctgtgtggaagctgcagtctcaactcagcactacaaattagaaacaaaagcagtggtgttttaggagcccagacttctttaggttcatgtatttaccatttgcctagtatgtgctagatgctttacagaagttgtctttttaatccttacaacaactctgtaaagtaggtacttctccactttatttatgtattgctttatttctttattacttcccctgttttacagatagccatctattcttgcagccaccccagccaggatctatgttctaagaccttcctccagcctcccatgagaaggagccac

SEQ ID NO: 104643 - DNA, 1027 bp, Homo sapiens
tttgcacatctgcaaaatggggaggataagggccatgatggctgcaggcaaaacaactgtctcctaaccaatcctggccctgaatctggaggatcacagagacctcatgaatgtttgaagagtgacattctggaggaaattcagcagagagagagagtgtagtcaccaaaggcagcatctggttcttcctgtgggtctcactcaaatctcactccaacccccaattcatctccagcagctcaggtcacttgttcccagcttcctggacctggaaagctgtttctcaggtctttgtaggctagagaacatcacaaaacccacccatttcagacacacctgtgttatagatgggtaaactgaggcctagagaggaagagtcctaggtcttgcagaggctaggacccagagcttctaacccctaacccagtgctctttcccttccaccaagccagcccagctcctccgttaagaaattattaaatagagttggtggaaggactctggttgccgtgacaacggagcctgtgtcctcgggagataatggcgttgcacaaggcagagcgatgtgtgttgaatgctgattcaggacctgctagagtgagagtgagtacaagaggagagtggaggggaccgtgtctagaactcgagcttccccaagaaggaggtgcgggactggtaggggtggggcaaattgccttctctacttccatccttcctacagccttgtcagaatgggatacttccctgcacttcgtggaggtgcagagtcaggtgaggagaggtgaagtgactcatcccaggtcacacaaccaggaaagagccagagctgggattatacctccaaccaacacgggggcctaggctatagggagggcctggaaggaggctcacctgcaggggcaggggatggttgatggagacctctctaaagtcttaagtgcttgtggaggtcctgatggtccaggaatgacaattccagcccaagaggaagagaaaacagaatgtcagcatagctaaaagcatcagc

SEQ ID NO: 104644 - DNA, 1069 bp, Homo sapiens
ggggccaggtggcagatgacagtgctggtcagaagctagggaggtggaggtggagaggcccaatccagagtcccccgcacatcagcctgctctgtcctgttagcccatctatttcctctgcaagggctgggtgtgactttctttgcctcgtgctcagtgcctgacaggcacccaggtagatacatggtgagtcatgctcactgaccgagggcctgggcctcacctcgtccggcaagctgagaccccagccctgcctgccaccagtctgcactgggccccagacatgagtcctggccccctggcttgtcagatgtacatgaccttcagcaagtcactgcctctctcttagcctcagtgtcctcagtaatgcctgtctccgagatcaataagattgtagaggtcatggaacatgccacgacagttcatgttaattccgtattaaatggacgcgtgtctgtgttccgctcccaggcgtgggccttgcggctgctgtgctatcattctggctgaacatctactacatcgtcatcatctcctgggccatttactacctgtacaactccttcaccacggtgagtggtccctttgaccaccccatccagcagaagccacacccagagcccacccttggcccaccacggccaccactctgctgacaaggccattcctccaggagtggggaacttggtttgtcttttgtgggccttggtctccccacaacagccatagcctcacaaatttagcatctcctgtgagacaggcactccttgcaggctcacatccaatcctcatgacacccctctaaagtgcgtattgttagcacattttatatggacacagacagcctgggttcaaatcctgactctactatataccagctgtgcaacttcagaaaagagacttaacctctctgagtctcagtgccctcatttataaaatggaaataaaattagaacctgccccagttcctcaaaaaattaaacatagaattaccatatgatccagcaattctgcttctgagtagatacctgaagaattacaagcagctctcaaagagatatttgtacac

SEQ ID NO: 104645 - DNA, 1009 bp, Homo sapiens
tacgaacctagagtcactcggaataaacatgcacacacactctggccatagtgaaggccgtgctgattgtatcttcaggggagtaccttgtagagatgtgtgtcgggggtcactgatgtgacacaatgaggtgctggggcccaaatctctctggcatgaaggaagcatccatgctggacagctcagaaggatccgggagcagtctagaaggtctcagagcaccttggataagctcccaggaggagctgttctcaggcactgtcagaatcagagttgcctgatctcttcatggccaatgtccatggttacactgtttctttacaaataaaaatcaaattctgctctggtgggttctgctttctggcatctcccgcatgctgctctcaggcacgttcggacttttcattcaaccatttattcagtaaacacttcttgatctcctactatgtgccaactgatgacaggcacggacatgcagacaggcaatggcaccaccaggcggccaatgcggagaggagggaagcccaggcagctgggctgcggggacctcagggagtcccctggaccaccccaggtcgggagtggcatctagaagagaaaactgcagggcaggcaggtgctggagagaaacagtgtgaaggctgggaggcagatgaggtcaggccaggcaccggcaaacagctgcagtgagtgctgagaggagagagagatgcaagggccttgaaaggctggccagggagtttgggcttcattctgagaacaagcgggtgctattcatcgcagtaagcagaggagtgacatgatcagacttgcaatttagaaggctctctggggctggagaggggatagagcaaaactgaaggcagggtcccactaggaggccactgggccatccagatgagcagtagtggtggctgactaaggccctggcaggtcctgttctctttgatctcttgaccaaacagcactttctactgattagtataatgggcctcacagtccccagcta

SEQ ID NO: 104646 - DNA, 1050 bp, Homo sapiens
acccagctgcctatctccccactctgggccatcctcttcttctccatgctgttgatgctgggcattgacagccaggtgagggcgccccccccgcaccccaggagctctccatccccagactcctcagtccccgagtaaacagggagaggaggcaactcttaggctgccaagaagatgaccaaaaattccaggtccctagaatgttccactgcatgaaatttcaggaaacagctcagccaccttctccattttccagaaggggaaactgatgcccagaggggagggactctcctgaggtcacaaagtgagtcacaggcagaatcaggctggaccctgggctctcctggctcggtgctgctgggcctcccgtccttccttagagggccaggctttgggtgggttggggctggggctgctgcaggtggctgacctctgttcccacctgaagttctgcactgtggagggcttcatcacagccctggtggatgagtaccccaggctcctccgcaaccgcagagagctcttcattgctgctgtctgcatcatctcctacctgatcggtctctctaacatcactcaggtaagctcagtaagcacctggcactcccccagcactgcccagggccatgcccagggcctcctctcccctcctctgttgtatcccacctttcctgccttcattgagcatcatctctgtgccaagctctgggcacataacagtgagtcagatggggtccctgccctccagaggctcccaggctggtggagacacaaacattgagctaagacatataggacagagctagagaatgcagcacctaactggactcggagcaccagggactgcttcttggaggaggggatgtagaaattgagctttgaaaggcccacagaaggcctggcatggtggctcatgtctataatcccagcactttgggaggcagaggccggcggatcacctgaagtcaggagtttgagaccagcttggccaatgtggtgaaaacccgtctctacttaaaaaaataaaataaagtaaataaataatacaaa

SEQ ID NO: 104647 - DNA, 1410 bp, Homo sapiens
gagccttcattgggtcctgaagagtacaggggcatgatctgagtctggttttcatacaactctcctgctgctgtgttgacgacagaatgaaggggtgagaggacagcatgaaagtgggagtggaagctgagggctgattgggagttgttgcaataacccaagtgagaggggctgtggcgtggcccatgtggggcagtggcaggggtgcaggaggtggggatgtggctggagtctgggtgtagtttggaggcagagcagacaggatgcacttgaatagagagcaggagagggaagcggccagttcctcaccatcccaggctgggattttccccagagagcctcacaccttcctccccggtacccacagcgcatccaagtcatggtccagcccagcgaagacatcgttcgcccagagaatggtcctgagcagccccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatcc

SEQ ID NO: 104648 - DNA, 1123 bp, Homo sapiens
taatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaacatcagaccttcaattctttggggtgggggcacaatatcctctttcatcacaacaacaacacatacacacagaactatttttccccagcagacagagattggggctcaaaacccaacaaaacggagctggacttccccagagtcttaaagtcatagaaaatgattgtgt

SEQ ID NO: 104649 - DNA, 1057 bp, Homo sapiens
tgtaccaaggtctgacatgccagaaaacacaatatagggttaagtatttctcaggtagccttgcaaagatgctagaagtctaccagccccaagatatcattccaggagtgatttcctttatttctatctttttactgcaatagaaaagctgcagaaattcaaacggatctgggttcaaatcttggctcagaccttttgtagctgtgtcaccttggacaagtgaccacgtctctgagcctcagtttccccctctgtaaactgaagatgataatagcgtctgtcttacaatggtgttggggaacacatttcctggcatgcagtggatacttaatacatcattcttggttataaatttggatttacagcctagagtggcttgaagacgggggcagctctggcagaagcaaaggtagggaagtgagagtcggggttggggtgtgtgggaggccattttcttcctatgaagtttgaaattttccttggcaagagcctcatgcctttcaggtctctggcatctggccttgtctgtctgcatagatttccctgggctcctatctcagaaacagaggccaggaaaagggcaaggcttatgtggtgcagaggtcatggagctgggccttggtggtcacacggccttggagtggagccccagcctggtgctgagcctgcggaaggctgagcgacaagaacaagagaaaggccctaagtaggtaactgccatgttttcatggacttttcaagacctcgggagacccgctagaatggggcctcaagatttggggtgtctggagcagaggatggagtgggctcactgggcaagcatgggttgagatccctgcttcctcatcaactacctgtgtggccttgagtgagtcgttttcacccactgagcctcagtttcttcctctgcaaaatgcagagtcatttctattgggagatttcaaggatccaacgggacaacaatgggaggatggcgaaaagtcatttccctggtctggctgatggctgagaagtcaccagccacaactcattgacctgctaagttactgaagctccc

SEQ ID NO: 104650 - DNA, 1042 bp, Homo sapiens
ctacctccaggcagcccccttctatccccagaggtccctttccgagggacatatctgaccatttcactttcctgcttaaaatccagtgacatcctctgcagccattaaatagaaggaaacctgaattttaccatctggaaagatgtccctgataaatgcattggacaagagcaagtggcagaatgacctggccagcctcagaaggcagggaacagtggtcaaaacatgggcttggaggctgcaatgagtttgaacccgagctctaccacttagtcactgtatgaccaggagcaagttctgaatttctctgtgcctcagcttcctcatctgtgaaatgggaatgataatagtcctctcccctataaggttgtgaggcctcacccctataaggctaatatgtcaaatgtgctagtccagtgctgctcctagtagcatccaataaacactagttattacattagcatataagtacatgtgaacacatataatcataggtcacatcgatgcctaagattatatgtgttctcatgtatttatatacacctctctctctcttttcacctcattcttcaggactcagaggtattctcttccaggaagtcttccctgaataccccccacccctaaggctggattaggatccttctctggccttacaacacccccagactcacatcttccatacatgtccttattgtcaccatcggtccccccatggctgtgagcagcttgaggacataggctgtaactgatttccctccatatccctggtacccatcgacgtgcaaggaacatagtgcactctctggagatacttgttgaatgaatgaatgaatgaatgaatgagtgagcaggactttgaaacataagggatcaatgggtaaagacatggagggagaacagccaggtataggggatggcctgagccaaggcatagaggtagaaagggatgctccagaaagagcacacggcctgggctggccatgccttagagagcgacagggaggttaacaggaagtaattaagatgctcaaggtgggta

SEQ ID NO: 104651 - DNA, 1106 bp, Homo sapiens
gctaaaatatgtgaattattaccccatgaagcgttgaaaaagaaagacaagaaggggagaaacgctcttcccaagttccccggtccatgcacataccaaataactctcctctattctccactccaccattcattcaacaacatctattgagcacttccggtgtatgaggtgctcctctaggcacacgggattcctgcagaacagagcagacaagcattcctgccctggtgaggcctacattgtactttccggcttctccaggcccgtgacatctgctgtctcctgcattctccaggccctgacatctgctgtcccctagattctccaggcccatgacatctgctgtcccctggcttctccaggcccatgacatctgctgtcccctggcttctccaggctgtgacatctcctgtcccctggcttctccaggcccgtgacatctgctgtcccctagattctccaggcccgtgacatctgctgtcccctggcttctccaggcccatgacatctgctgtcccctggcttctccaggcccatgacatctcctgtcccctggcttctccaggcccatgacatctgctgtcccctggctcctccagacccacgacatttgctgtcccctggattctccaggctgtgacatctgctgtcccctggcttctccaggcccgcaacatctccttcccctggcttctccaggctagtgacatctgctgccccctggcttctccaggcgcatgacatctactgtcccttggcttctccaggcccatgacatctgctgacccctgcattctccagaccagtgacatctgctggtcccctgcattctccaggcctgtgacatctgctgttccctggattccccaggcccgtgacatctgctgtcccctgtattctccaggcccgtgacatctgctgtcccctggcctctccaggcccgtgacatctgctgtcccctggcttctccaggcccgtgacatctgctgtcccctgcattctccaggcccgtgacatctgctgtcccctgcattctccaggcccgtgacatctgctgtcccctggcctctccaggcccgtgacatctgctgtcccctggcctctcc

SEQ ID NO: 104652 - DNA, 1046 bp, Homo sapiens
ggaagatttcttcctaagatgaccttaaattgacaaatcctttaatgttagaccttgtcaaaatgctttaaggagctgtttagtttctttcttatttattttaattgtggtaacttaatgtgttgttttttttttttttttttttacaataaatttttctgaaaaaggaaggaagtattggctacaaacagagtagtcacgcagaccaaggttaaaatccagattctgccttttgttagctccgtgacttttggcaaattacttaagctctctaagactcaattagtaatctggaaaagtaattgtaatagtaattacctcctagcattgtggtgggactttaataaaacaatacctatcaatcccctaacaccacgcctggcctggggtaactgctatatatgttagttgtttcgttccaaaaagaattggacctgggtctaagaaaccccaagtgccactgtcagctccaaccctgacttgctgtatagtcttggtaaagccgcctgtctctgaggccggttacctcatcactgtcctgagaatccctgtcctctgtgagaacagtactgctgaggtgcagtgtcctgtttgttggtatgcaaggggcttaggaatgaggctgccggtgcttgggtttcctacaacccagtgcagagcctgcagccactccagcaggcaactagcaagaggcggtgtggagctgcagggctgcccatgcacaccggcaggtgaaaatgcaccttagacacacagctgagacggtaaattggtttccgtcatcctgtgcagggaagatcatgctggttttacccttcttgttgggctgcctcttgtaaaccttgtttgccctcctttatcgggctgcgctgaacttaaagaacagacaagttgaggttcattatagcaaccccagggaagggtggcctacctctcaaagattcactttttccccctgcatttctctgttttatataagtaaaataataatgtacacattattttgctgcatttcatgattttatgattgttctatgtcaataaca

SEQ ID NO: 104653 - DNA, 1049 bp, Homo sapiens
agacacatgaggatgcagcccaccttcccagaacatgtgcggaattagatttctacaaacacatttgtcttgcttctgcccaactctctcactagaatgcacattccataggggcaaacatttttgtctattttgttcacagctatattctcaacacctagaagagtgacagaaattcaataaatagttgttaagtgagcaaatgaatgcatgaataaggaaaagggtacatggctattgagtaggtaaccagcagtgttgatcacccccaacagcatacaactccagtctgatgaacatcatgctactaagtggccactcatcacccaagtctctgaccttactttttctctcttttctcccagggagtgagccataactggtggctgctcttgcgccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccg

SEQ ID NO: 104654 - DNA, 1030 bp, Homo sapiens
gccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaataataaaaataaaagagagagagaatcagacctgggtggaactctcctgctcctcaggaactatgggagcctcagactcattgtaattcaagctttccgagtcaagtgattgacaactgaagagacacgtggctagggttccactggagaattgaaaaggactcttgagccctcctggaatggagctgtataactgtgcagagactttatccatgccaatagttgctgtccccttccaggggtcaccttgagaggcatgacagctgttccacaggggctatcccttctcagaaaacttctcttctgagcctctttaacagctttctccagaaccagtgtctgaaccaccctggaaattctgccttattatttcttactcaaacatgtttagagtggatagaaaattatgcagcttgcacacccatcgtctttaaccccaaatttcctttggctattaaaaaagtggtggcaaaagacatcctcaaaagaaagagaaatgaaatatttttgaatggttgcacgttaaaaattaaaagaaggaatgggggcagaatgccatatttttgagggctgtactaggtttatctcatttaagccccacaacaccccacaggagggtaattttctaactctagtttgcagaggagcaaattgaggttcagcaaggtgagagaggtacccaaggtcacatagctagttatgtgagaaagttagagtacagatcctctggggtttcagcttattgtagcatattttctccgaaaggcaaaaatgtgcccttttggccgggcatggtagctcaagcctataatcccagcatgttgagaggctgaggtg

SEQ ID NO: 104655 - DNA, 1044 bp, Homo sapiens
tctcaggaaagcctggaattactcagcacacgtgatgaacacctccttatgggccagaaattttgagatacagttgtacttgttctcacaccacctaaggtcttctagaggagatcagacattgacctgtggaaaattaaggagaaattcaagtaatggaagataagttcagagaattgatacgggtgatactttggttggtcttctatgccttatcttattctaggaaagatcaccagaagccttagagcatgatggcctcataggagttttatagccttcatgctgcctttcctacctgtggccctgaatgttcctgtctcccctccacactgctgtccaagtgcattttctaacgtgtaaatttgatcatgtaactcttctacttaaaacccttctaaggttcctgttgacttcgggataacgttaaaactacttagcttggcgtttgaggtctcttcagttccagttcctgtccaccactagcctcatttaatatttcccaagatacatcctgtgctctggctacccctgtgccctccaaatgccgcagcttcccccatctctctgcctgcagacatctctctgtctcccttctgtcacctggctgctgcctcacctacctttctgattcattaccccaggaagcactggctgattgcttgcgccatttcatttctctcttctgtgttctggtagcagcctccttcctagcactgactagtctccaaagtaattgttgatttgcttttctgcctgccccatatccccagcctgtgagcaactttagcacagaatcttgtttgtccccactctgcgtcctcaacatttagtgcaatgctggacacttaagagacacatgatgtgagaatgctgagaggaaagagagagaattgtggactggtatgaaaattaaagaaggcttttgccgggggcagggccgaaccctagagaaataatttctagacatcattttcagtggttcttgcttttattgcattaaccttgttcactctctttagcatgattccagtttcccttcga

SEQ ID NO: 104656 - DNA, 1014 bp, Homo sapiens
ggacaagagcaatagccaaggagcaacaatttatatgctgttagttgggctctttcttcacttagtgatctctccgcatcttggcagctgtctgtgactttgaagtgcattaggtatttcagttttttcccccatactttaaaaacgtgtaatctcctttgtgcatttcctgttatatcaagtgtttgagttctaaagacagccatttgttagattagcatgttttatgggatcattgtggaaaatgttcttgctgaagacaagcaagttggcaattttgccctcttttctttctcacagtgtactttttcagcaaattgcttggcagactgatcatgactgaatcatttcaatgaattgtatgctctcagccaagtagaaaggaacatttatttcataaagcttctaaacaaagtttttcttcagttacgttgagcttctttctgctgatttgtattacaaaaggaagtgatttgcccaagttcgcacaattaatttgtggcaaagccagttctaaaaccagaactcctagtcagtgattatttatgaaaaatattttttaaaaaattctgtttaaccgtagtataagctggcttacctagcattgtgccaactaatcattcctccaatgattaagatagattctgagttgattcctaaagcacttaaagattttggggtcacttttgaatcatcaaagaaagattaaatgatgttcagcttagtgttaaatggattttgtcattttcctattcgacgcctgccttctgcacttatgcctcatatgggtaggaaagttaccttaaaccattttcaagctgacctgcttttatgggtaagtggtagattttcctccttagcagatcattcctgctctctatagcccatgttaggtcaggttgctctaagaaacttattcctagtcttttctgctcaaaaaaagatttttttttcactattctaccccattgcctttgtccttagggtaagaaatatgcttattctttgaaatta

SEQ ID NO: 104657 - DNA, 1044 bp, Homo sapiens
tcaagtgaatctcctgcctcagcctcctgagtagctgggattacaggcgcctgccaccacacctagctaatttttgtaattttagtagagagagggttttaccatgttggctaggctggtctcgaactcctgacctcaggtgatccgcccgctttggcctcccaaagcgctaggattacaggcgtgagccgctgtgcctggcctgagcgcaggagatatgggaggccttattaaggagatatgggagaaatttctgttttcagtactaggaaaaactttcctcttaatcagatggtgtgtttttattcatggacaccatgattcctatcactggtcatgctcttcccttttcaccttggctgctggaactcagtatcaaatctgtggccccctcgttgcagaggactccaacagcatgctgctgggtgggaagctttctcctccctgcttaccctccagtttaattttctttttcctttgatcccaatttccttattatttcttattttcttgcatagccacttgaaatctttcagaacaagattattgcataaaggagtgactgaataagtaaatctctccttttctaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatggtaagtcggaggtggggggtgcaaatggcacctttgaagttgtagcttctcttcttgttttactctcatgattgccttccatctcccagctccccatcccctccatctctccctcccttcctttttccttttcttatctttttaagtgtaaaagaaatacaaccttttatcatcagatagaaacagaaagtcctccacacccatcgcaagtcccatttcctattaagcagactttgtagattagtatgcagcctttttcccagatgttattgtagacatatctaaatatagagaaatcagtatctttgc

SEQ ID NO: 104658 - DNA, 1024 bp, Homo sapiens
atagtaaattgttgctcccatctcacggtcactttgaggtgttagctcagttaaaatggcagggcagaatcatttgcacttttcaaatcattgttcctttctgtgtctctgtcacttaactaccaagcacagtagaactgaattgagtcacttaaaggaacacatgatgcagttccattatatgaggcagctaagccctcatttttggttaatatcccccaatctgtttaggctactgatcctttttagcatatcacctcatttagttacctaaattgtatattttgtttatcttgataatctcaagaaatgatgtacttgaggctggatgttctttgccaacaatgagcatctggttataatttaaagctttgtcacagaggatttcatacttgagacagctagagttgaatggagtagaacgttctgcacacaccaatgattgtttctttgcagtcaaccagagaccggaccttggaccagcagtgcactgtgagtcgtccaggactggccgtgattgcaggagccctggccgtggaattgatggtatctgttttgcagcatccagaagggtgagtttgctagtaggagatgagtatttaaacaaagcttttgtaggcagttgttcatcagtgtctcccatggccttttctcagtctgactttacagagaatttcactatttcaccctcaaaaaaacaagactagaaaaagcaggtctggttctttgggctgagataacttggcatgtttcctttgtggccacatttctgcatctttccggacaaagtcactatggtttattttatttttccaacgcttatatagggcttactttgtgctaggcactgttctaagcaccttagaaattttgcctccttcaatctttttttttttttttaacgagacggaatttcgctcttgttgcccaggctggagtgtaatggcacgattttggctcactgcaacctctgccttctaggttcaagtgattctcctgcctcagcctcccaagtagctggaat

SEQ ID NO: 104659 - DNA, 1071 bp, Homo sapiens
cccaacaggtgttcctgcctgagagcctttggaagctaattagacacgcacaggtgtgcctaatgaattcctgccggaccacacgctgtccagctgggaacagcccgggagcgaggccaaacaaccatataaagcgaggccaaacgacctattctgatgctttttgcatgctgtctgccgtgttttcattccccacggtgaggacggtgtgtcctgtctcctaaggccctgtgagccaagctcagctacaacctggtgccccacatctgacaacagggatttccactcaaagtgcttggcccttttgggcctgggggtgatgagtgggactggagccaagaaaccacaggtaattgggattcttctaggctctgtgattcccaggtgggttttttaatattcagggagtagcaaagatacaaatattgtagagctagtttaggcgtacaattttttttttctagacgtttctatggaacactaatgttggtgattattttgcagggagagggaatggaggtaacagggacttagggttttcatttcgtacttttctgcagtgttttgaaaaattaagattataagccttttttaaaatcacctttttcaagacataactgatatatagtaaaatgaacccattttagtatgatttgacaagtgtatacactcacataactatcacttccacaaatgagatacagaatttttctgtcaccccaaaaagctcctttgtgccttctcccagttcatctccccaccctcagccccaggcaaccaccaacccaatttctatatggaccatttttattttttctgtatattttactgtactaagggaaaaaaaatgtaatggaaatcttaaaatgttcagagggaggcaaggtttggtcactctgaggaatccctcttactagctacaaagttggtaggtaagggctgggtgtgtgtgtgtgtgcgcgcgtgtgcgtgtgtgtgcgtgcgtgcgtgtgcgtgtgtgtgtgtgaaatcggccatgttttccccttgtggggagaggggagaatgagaaaacaatattcaggtgaggct

SEQ ID NO: 104660 - DNA, 1043 bp, Homo sapiens
aaaattattgtgtttttccaaatgctcgctgttcttagaaaagggaatgctgtgtatggtggtagagctatttggatcacttggcaaaatgtgcaattcctcagaattgatgagtgagattaaatcaatcttttccccttagttacctggataaagaagccatgaggagaaatgtagcttatgttgtgtttccacaaactatataaggaaaaccttgacttcctgtgtcctgcaggggtagtgcacttgccattagtccttttaagttgcaattcttcccaccagctaaagagaaatatataaattatttctagctaggtggcaaaactcccccagccatcttgtcaaatgattgcatgggtgcaaagatctataaattcctccataggttgcatatcctcaccattcagggaggccccaagttgtcaatgaatagatggccaggcccaatactggaccagccagtggtgaaagggctgctgtttggagaggtggagctagtgctgagtataggaagaccatgtagaaataccaaagtcagacccattggaggtttgagcagattgtgagatttttcaggtacaccagggaggcaagatagtacatctctagtgctggacttaaactgaaggcagtccttctttaaattgttttggtgccctctgggcattaaacagatgcagtcttccacttatggccaatagttagagccacaaagagtctatttcaagtttcaggagatgaatggcatctctgctgctctttgagagactttaaggtatttttcccctgaattgtgattgggttcccaggcagggttcagaacattgtgtttattgtctgccgtattatcttttaagcaatgctgtactgcctgatggtatggaagaggtaacatagatgtttgtaaacatacagtcatttgatggctaaggaagttttgccacccagctagaagtaacttatgtattgttagctagaagaatttcaacctgaaattgacccaatttttcactctttaaaacagagcagttgctagaata

SEQ ID NO: 104661 - DNA, 1035 bp, Homo sapiens
gtcaggaattcgagaccagcctggccaacatggtgaaaccccatctctactaaaaatatagaaaaaattagcctggtgtggtggcaggcatctgtaatcccaactactcaggaggctgcaacaggagaatcacttgaacctgggaggtggaggttgcagtgagccgagatcacaccattgcactccagcccgggcaacagtgcaagactccgtctcagggaaaaaaaaaaaaaaagtaatttattgcttaatgaaaccaggtcatgaaatctgggcttcaaggactctagatgggggcatttagtgtcaagaccatcttagtgttcatcagctctgttctttgttggctttattctctctcactaccaacaagttcttttcttccccatatagcaagaaacatggactcgggcagttccaaaatctcattcttacattaagaaatctttcctagtggctccaaaaagaaaatcccagataaggactgtgattggccaggcctgggtcacatgccatctctggacagctggcagtagaaagggaagggctgccatgattggccagcctgggccaggggcaggtcatactgattggcagcctccctcagaactacacggttggagtgatgggggatggtcctcctcaacaaactgatgcagatggatgggtgttgggcatatatgatagaagtccattgtaagttcagtctcctcttagttctattcctgtgtctgttcctgtcccttccaaacaatgctgcttttctatcagcaattcattattaaggagttgagtgaaagtcatgaaattccagtccccagatttgtccccaagcttgactcactctgctttctggatttacccccatcttctcacctaaccacagataccagaaaagaagtctttattcactgaggctttgaaaaaattagctgcacagtcttccttaccaccacctccaaacaaagaactttctctgagattggagcacagtgcctcctcctttctccttgctacacagaagcctcattctag

SEQ ID NO: 104662 - DNA, 1131 bp, Homo sapiens
gtcttttcttctgtctggctagcaggtctgaccagcattttaattaaggcttccctagagagacactgagctctttaagatagaaactagactgggtatctgctggtttttctgcctaggaaaatgtactctaatgggtaccttgatttttacccagagaagcccagggtctcactctcatcccatgtttttctggtggagttgactccgcccttggcccatggttggggcaaggtagttgggaccccaggcaatcagcacatcgtgtttccctggccaaaatgcttgggtcagaaatgggcacatgacccaatcttaaccaatgaggtatgatgaaactttggctaagaggctgcgattagaatttggaatttgacggcatgagtctgggctggggcagccttctagtgattgtgagtggagagccagtttgagtatggagaccacacatggaagagagctgagcctggctgggctgagagagcaagaggatggtcatggtattgttctctaagcccagaaccaggcttccctgaaggtaccattatcccggtctttctgggcatatgaggccacatttcccttttagcttgagtaaataaaggttgagatttctgtcccttgcaaccacaagttctgacttgttcaggggcagcgtttcaatctacctaacatctagcagaatgcctggcaggtagaaggaagctcagtgtgtgtttactgaatagattctcattgagttaaacagatgttcatcaaatgctaatgaggttaatggctaccatattggatgatacagatatagaacacttccatcattacagaaaggtctataggatagcactactatagagaggacaaactcaaaccctgcctcccagaagctctatttttgagggtttttaaaatattatcaaaactagatagcataacatatggaaagatagcctgacttactgatttataaaagttcagctttatttctctcgagtacagttatttacatataaattctaatgaaggagtttaacaacaattactatacagatagagtcacacattatacaaagtaaggtatgcctaaatattcttttacatatgaggaactggaatttactgggcctagaaact

SEQ ID NO: 104663 - DNA, 1052 bp, Homo sapiens
ttaatattcagagttgtgtaaccgtcattgtctgtttagaatatttcatcacccccaaaggaaaccctgctaaagagcagtcatctctcagttcccctcacaccaccctctggccccctaaccctgagcgatgactaatctttcgtctcttcggatttgcgtgttctgaacatctcatataaatggaatcctgtaatatatgggctcttgtgactggcatcttccacttaacatgctttcatggttcatgcatgttgtagcattatcagaacttcattcctttttaaggccaagtcatattccattgtaggatctgccacatattgtttatggattcatcagttggtaggcatctggattgtttccacttttttgctgttatgaattatgctgctgtgaacattcgtgtacaagttgttgtatgaagtacacgtttttgttgttttgggtatatgcctaggagtggaattgctgtattgtgtcgtaacttttttgttctattcttttggcaatatgatatattctgatacttaaacccatggtgtttcgcttaacactaatacaccttgcctcccctaggaaatataaacccttgagagctgaaaagaagccttatttctttctactccccccactaccgaccactgtgtctaacaaaagccacaattactgtttggactcaaaaatgtgacggaaagaagtagacacttgtgaagtttttttcctctctttctactttaaccctaaactgtgtcacattttttcgcgttcacactgtatgtgtacccttttctgaaagtgcttgtcctctctgaggccccagtattggaggctactggatgtgtaagtagttggtatacagcacctctcaggtgtgaccattccaagggaggagatcagcttccagcatgtctcctccagacaacaatacacactgtcctcctgctgaacagtcagttgtggagtaataatgcacctctgcaaggctttgcagggtttttactcatgtatcaccaaggatgaaaatggggcaggacacagtagaagccgtt

SEQ ID NO: 104664 - DNA, 1426 bp, Homo sapiens
tcaccctatgcaaaccattggaggatgaactccagaaaagtaagagtaaccaagaaagggaaagagatggaatatagggaatgggagatcccacaaaggagagattgaaaggcatcctcaaaacagtagcgaagggaagcctggggtggcagctgggcctgaagcactgaggatgactagaacagactggatccaggccagagggctctaggacagattgtgttaagatgaaatggcttgaatacctaatgtgtctgaacatatatttaggaggtttagacagttggcagagagtttgcgattaaattattgataagtacatagagacaaagtagaacaacagaaaagacagttgttaattccagggaaaacaatgttgtacaagaaagaataagtaatcctagtatattacatggcttacctagatacagcaattaaacagtcaaaataatgtcaacactggatgtagatctaaccaaaattatagtataattatgttgaaatggtggaaagatagggaggcaagagtttgccatgacaggggtaagggggctcacagcagtgaaagagccaaatcctcatttaccgagcaaaatgggaaatatatataatgcctaaacctgaaaagatcgagaagtcaagaggtgacaatatgagcacgttattttaacatacagaggtaactaaaagtatcaggtaagtctctacggagtatagtatggaagctgggagcctgttaattttcataacaagccttggaattatttggctctttaaactatgttcatacataattttactcaagtgaaaacgttttaaaaagaacaaaagtgctatgagaatgggcagactgggtttttaaaggacgagtaggagttctataggcctagggaatggaggagtgttcgcgcaggtagagaaaagaagactagcggtaagccaggtgtatcctggctctaaggaagcttgggatgtaggatatagtcacacttaagtatatgggcttttctcccttggtgtctgtgttgtttagaattgaagacatggaccttttgttactgataaaattataacctattactatttttggttattgttttaacataacattattctttgaattgatctcaaagagaggaaaatgagaggtcactgaaatgaccctggcagtaaaatttgctgaaaagcagcgtcctttacaagtccttacctccgaccgcaaaagagtcttctaaagaccactctcagccctcaagggtccttgcaagtcagtgacaccacaggaaatgggaaccttgccaagaattagggaaattcaggtgtctgcaagtccctaaaccctagggccaaaaaaaggatttggcagatgtttgtgtgtcctggaggcagatggatgaaagtatcagtaggctccgtggcttaagtg

SEQ ID NO: 104665 - DNA, 1046 bp, Homo sapiens
ataaaacaaacacagtgcttactccttgccatacttatacataagtatgcctataaagtgaagagctagttttttctctgtcattctgaagccagttccacaagtggagtttgcaagtgtcttttaatcagtggcaattttatttggaatagggtcaagtcattctagtatgactacatttaagtgataacactcgtttgcatgtttgccaaaaaataatccagtttcactgccccccacccccacccccagccaccctatctaaaatatgaattccttgagggcaagacatctaccatctcttgtgcatcccttccaccattagcacttctctgtattgtgcacatgatttgagatcctagagctctttagagggctgagacacttttggttatcatgctaggaagactggctttgccttcctagtgcttgtcttcctttgttgagctttgcaaacccatttatatcacatggagtaacgggctgtttgggaagtttcagccaactgttctttacttcattttatggatgatgtgatacccattttgtctgtaagtggctttctgtagaatgaatgccccattctcattgaagaggtgggataaccatagctcttagccaccacaatgtgtttagagcactgttcagggaatagtcatggtaccttcaaatattactgcctttcaaggtaatgaaatctccagctctgccagatcttttgtgtcatgagaaaaaaccaaaacaacttagttcctgcccatccagggcttatctttgaagtaataagaggagaatgaaagacttgaagaaaagagtggcacttggatacatttccacccacacaggtacttgttttgttttgactttgtgtggtctgtttgtgtgcttgcagtgtatttttttggaaaggttgtgtctttgagttcaaaagaatttcctttccgtatttgattcagcttccgtatttggttaccactgcagttgtgacagttgcttgactaatttttgcaatgcccagggctcattgagattcttggaaaggtgaa

SEQ ID NO: 104666 - DNA, 1056 bp, Homo sapiens
tgaagtagcccctgcagggaggcttatctctaaggaattaatttattaaacactagcagaaatgactcattttaaagatcactgttgctactaataatgtacaaattccaaggaatactatttctatttgataatactttgtagtttacaaaacattttcatttactttttttttttttgagacagggtcttgctctgttgcccagactggagtatagtggcacaatcttggctcactgcaagctccgccccctggggctcaagtgatcctcccacctcagcctctcgagtagctgggaccacaggtacacaccaccacacccagctaattttttgtatttttggtagagacagggtgtcaccacgtcacccaggttggtcttgaactcctgtgctcaagcaactccgctgtctcagcctcccaaagtgctgggattacaggcatgagaccctgcgcctggcctattttcattacttcttatagcaagagcctttgcagtagactgggtgggggaggtatcagagaaaaaattaagagaataaaaattaggagaagttggatgcctaattcaagattaaagtaaaataaacatccccccaccccccctcaaaaaaaccaacccaaacaaacctctgtcttccttcctcctttggtgctggcgcactgaattgtgcgttgctgctgggatcatcagaacagtagttcccaggtgagtgtcggcagctgtggacagtcgagtgcttcaggcaccacaggggagcgctcctcctctgactggaccatgttcctaagctcccattaggtttaaaataagcactgatgtttctgttctttctaaaagtcggcgctttcagttgcttcccttttgtgaacaatgacatcaaaaaataccatctcccagtagtctattctaattcaaaaggcttcataaaacatcaggtggattaggtgcttatttaagccattctctaagtgggggcatccagggctagacatctggcctttaatcagaagggctgccctccagagacagctactaccagtgtctctgctat

SEQ ID NO: 104667 - DNA, 1005 bp, Homo sapiens
tctgcctgcctcagcctctcaaagtgctggaattatatgcatgagccacggtgcccagccacatctctaaattcttgatggccaagaagtacaccccatgccatggtgtgatagttcatacttttgggtttgtcctaccattgtatattattagctgaaaccaaattggttttagctcagggagtggtcctggggaggccagagtttggactcatgaaggaacagggccaacaggaattagggtattttattgtgtgcatctggaagttggagaggccatcaggtgtttaaggatagtgatgtctgtctgtttctgacttttggccctgttactgtgtgtggcaggaacacctggcagtttgaatgtgattcctccgatgctcacccccctggcctccacatctagacaaggtagttgctccatgttctcgtactcttacctaaagtatatcatatctagccactgccatgggacagacatggagtgaacatgcctggtgctgtagcttttattgtgcaaatcttcttggaaaacttccataacatattttggagttgtgttccattgcttgaaaaacaatataatctaatataccccacagtgctgttcccaagtgatttggtttggatgtttgtcccctccaaatgttatgtggaaatgtgatcctcaatgttggaggtgggtcctggtgggagaggttggatcatgggagcgatccctcatgaatggtttagtgccatccccttggtgatgcgtgagttctctggtagttcatgggagatctggttgttgaaaagaatgtggcaccttcttgcctcttttgctcctgcccttgccatgtcatgtgctggcttctgctttgccttccattatgattggaagcttcctgaggtctcaccagaagctgagcagatgctggcaccatgcttatacagtctactgtgagccagttaaacctcttttcttataaattacgcagcctcaggtattactttatagtgaca

SEQ ID NO: 104668 - DNA, 1036 bp, Homo sapiens
tttttcttttttttttttttgagacggaatttcgctcttgttgcccaggctggagtgcagtggcgcaatctcagctcaccgcaacctctgcctcccaggttcaagcaattcccctgcctcagcctcccaagtaactgggattacaggcatgtgccaccacgcccagctaattttgtatgtttagtagagacggggtttctccatgttggtcaggctggtctcgaactccctacctcatgtgatctgcccgcctcggcctcccaaagtgctgagattacaggcatgagccaccacacctggccccagaagaccggatttctgtcttggctctatcagtcctggctgtttaatctcagcaaggttatttaacttcccagagtctcaatttgctcatatataagatagtgattaatacaacaaacctcaaagagtcattgtgaatattaactgagagactgtctggaaaacagctcgtgaaggtcaggcacagagtggaccctcagtaaatgacaggtcctgcctattcctctgcatggccagcacatcagttccaatgcatgagaaaagagaatcacactcaggataagtaagagtggtcatggaaaaggagaaaagacagtgccaccagacacttggtagcttccaacaaatggtagctgttcagtgactctagaattgaaaagcattaatcgagtgcctcaagggcagagaaggggcgctaacatttattgagcacctactatgtgcagagcactttataaaagtcatttgagccgcaaatagtcctggaataaactccatttcactcatggtaagatggacacagtgattgctaaggtcttaaagggagtgcagaggaaagctggaattctaatccagggagtgtagaggaaagctggaattctaatccaagactgtgtgatgtccaaacatgttttgccccccattatataatactcgtccatgctaacatcagtcaggggacgaacagacagcaggcaggagaaagctcagggaggaagtgcttcatggggtg

SEQ ID NO: 104669 - DNA, 1565 bp, Homo sapiens
aacacaaactgaatgatcccaccctcaacacaaaggaagttgagtccataatcgcatccacagataggatactcttagatctgacaaataacacccatttattttattccctttttcttctttcccctaagcccccggagagcctttctccagtttcatcacacactcctgactaagtagatgggggtgctagggggccagctctccgaatgaggcacatttgtcttgtcatttcaaaagctttcacagagcacctgctgtgttctgggtcctgtactaggtgacagggccacctaggtgaacagggcaaggtccctgtcctcaggaagctcccagtccaggcagaggcgtgggtgaatcggcccacacgtactgcacagtgtgttgagtgagcacagatgctgtggggccaccctgtgggtccagggaagcacttcctagagaagaaatccaaacagggattccaagtcaacgaggcagaaagtgatgggaacagcatttgtcatagtcagacaggtgcctttcacagtgacatagagacagtgaggtggggttggaatttaggcctgagagaacggggacccagtggcatacagagtcttatccttgtcctacctttttgaaagagctaaattcagaggctgccaatatgttcataactcaaaaggatcacttatcccaataacttaggaaccgttggcatccatagccctaaatcggaaaatgccgaaatcagaatcatttccccctacattgatcacagtgacctttaatcaccttcagctccctggtctcctagagccacgggtcagcccctcactgccctcctccaaagacaagtctgctcagaatgtcactgaaactctgagcatccactcaacaagcctccatcttcttactttctcatcttttctcttttaggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacagaacagtgtttgttactttgacccattgcttgaattcaaagataccctggtttgcataatacttggttttttaaatgtatgcatcagacatttatccagttgggacccaaatatattagagggcttagcatcagaagaaaagaaccctctccatgtacaaagtcatgtgggtcctgcagaatagctttgcctgtcctgcattctgtaggtacgtgagagtcagacatgacaaatttcttgtatgctgtcaacacgtagcccaggaaacttacagggtgtggaagcttgactttctctgcctggcttgttatgtctctagtctccatcctgttcacttgttttttttccagcaggggctcgcaagtgtcacgtcaacatttccctggatctaggcttttcgtgtgtttctttgttctccactaaagtgtatggcagtgacttttgggttaggagcctggaacagacaccttgcagagcctgccttattgtaacagttaggacgtgttt

SEQ ID NO: 104670 - DNA, 1060 bp, Homo sapiens
gaattgagaaccagaaatctcaagcagatttaagtcataaaatgccctttgagggtcagctaacccatccccttgttttaaggggaagaggcacagagctgttcggtcatcggcttggactcacacagccgggtggcgccacggctggctgctctggtctcctggccctcaatcccactgcccttttcattgtcactgtgacagcaggacagagatagatttggtggtttgattggctgactagaaagaatatttagtttcaagttttaaaactgttaagatgactaacatctgttttgggtttttttggtctcctttttggtttttttctcgcagggctttcagcaatcgtgagaccgtctagtataagacagagcacgaaaggcatttttactgctggtaagagctttggaaatccgtgtgtaacatacctgctgactgagtggcttccacactcttggttacagtgtaaagctttgtatcttttaggtgcttgtgaaatgctgagctttgatggccataaactgggatattgcagtaaggtacaaacaggcataacagcagcagaacctggtggtcgaacaatgtcagaccattggcagtgctgttggaagctttactgcccttctgaattttctgagacacttcctgtgtgcagggtttttccctcatattgttttatttatcaaagttacagatgcataggattgcaaaaacagcagcatctgtgctccccctcctcttccccttctctgagacaactgcttccatctgtcttagtgggttatttttgttgttactgccatttctctaaatggtaagttttcgttgctccttctctacgtttcaactttaggtatcatctattgacttctctctatgggaggttagaagtcaactctggcacccaccctcatcaaatgtacgcaccctcccatccctctgtcctcctaatatagttgtctggtggttttggctaattagttttcagtttgatggtatggtgagccacagagtacacctttccttccctgcataatgttcttctctcatggagagt

SEQ ID NO: 104671 - DNA, 1406 bp, Homo sapiens
tacaggcaggagacacaattcagatcccacttactctcattggtgatgtgatcagggcacgccagtctccctgtgtttgaaatgggaggggtcatctcagtgcctggatttgacgcggcctccacgagtgtcaactgcagcaccacttcctttgactgctggatttaagacaaatataaattttaaaaccaaaagtcagaaattgatccttgagagtggcttctattcttttctcaggtagaaatggaatattataggacaagaattgtcctttttgaagggacttagactcctgaacacttacccattcagtttcagaaaaagagagtttccttagcttgctgcctcgccaggggtgtgggtgcatatatgtttgtgtgatttttaaagagaagccctgagttttggagtatttgtaggatttaaagcacttccatagacgtcgtcttttttttcctcccttcagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactaggtacgtttatgaatttgatgttgaggaaatgccagccatggggaaaagcagactttgtttgtgattggaatgtattatttcttcctttttgtttagcgagatagagagattgcctctcagaagaagaaagcactaaaaatttgagggttttctaaatctgcatttttatttgtttgaagtaagatggtgaaaatacttctgtttttaaattcctggatcctaaatcactgtcaaagggagaaacaatgtttcttttggttcctagagcacaacttctagaatttatttaaaagatgtgtctgtgttttgtggtggtctgagaaaagagattggtggcatttttttgtgcttttataacatcgagaacacagctttcctcaatcaactccatttgatgtgtctcatacattgttgagtacattccctcagacatggcccacgttccacagcattttccccagcactgccctgatgtttatccaaaactctgaacccaggccaggtgcagtggctcacgcctgtactcccaacactttaggaagtccaggagggagaatcacttgaggccaggagtttgagaccagcttgggcaacagagcaagaccctgtctctgcaaaaattacaaaagtagctgggcatggtggcacatgcctataatctcagctaacttgggagtctgaggtgggaggatcgcttgagcagttggaggctgcaatgagctaggatcgcaccactacactccaggcttggtgatagagcagcccgtatctctt

SEQ ID NO: 104672 - DNA, 1168 bp, Homo sapiens
tcccataggcaaatgtaacattcctcatttctcatcacttgcaatttaaaaagttatatctgttttcaatttcatcttaaatgcaaacctcctcttacagaacttttaagccttattttgcctttgtaaaatatgataagattatattcatcaagtgcctcaaaagccctcataaacagacaggtcaacgatgaggaagcaatggcaaggacaagtctacagtgatggtgcacagctcctatctccttcattggccacaggcagaatttggcccataagacaagactttgtaggtacagaagcttctgcattggaaaagctaaaacaagttagctactcgcttgtgattaccttgtgtaactaggtaactataatttaactggcataaagggctttgtgatttgagagaccctcttttcctccaaacaagtgctcacatttcttggggtaaagtgtccaggttttgaggaggaaaagcaagtgttctgatgagggatcctgccagagtgaacccgtgcggtatcagtgtggggagcgtcgttcataggtcgagagtgtggattcttaatggaagatgtgtttatctctttgttttaactaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggaggtaactgtatgtggaaaatagcttgtattgtttctaagacaaaggctatttgcaggaagaaagtcaggggtagaacagcatgactggtgtgagaacatttatagtttaaaaagtaagtactgtatgtaaacataggcttctgtgtatctggaataatgctaaaaggtaacagactagtaataagaggctgcctttggagaagggaactaggggcagaagtgggagagggacttgttttgaccatgtatatcttttttgccattggaaattattaccatgtctatcaattaccaatcaaaacaagtgaaaataaacttttagatcactctcattccatccccagacccatttagctccccagaggtaactgtactgacagtttggtgtctggttgttgttgtttttttttctttttttgggg

SEQ ID NO: 104673 - DNA, 1052 bp, Homo sapiens
ccagctttctaaaggtatcttgaacctttcttttttgttttatttgtttttcattattttatttcctgaaacacaagcttgaacctttctgagcccccagttttcttatttgtaaaacaaataactatctcacaaagaaattatcaatgagataatacgtataatagcttccaacatctttttttttttttttttttttttgagagacaaggtctcactctgtcgcccaagctagagtgcagtggtgagatcatagctcactgcagcctcgacctcccgggcccaagcaaccctcccacctcagactcccaagtagctgggaccacaggcacacgccaccacggctggctaatttcgtttgtgtagcgacaggggctcgctgtgtgcttctgctggtctcgaattcctgagctcaaacgatcctcccgcctcggcctccccgagtgctgggattataggtgtgggccactgcgcctggctgcctccagcatcttatctcattaatagtcagtgttcagaaaatgattgctgttattattatttttatgtattattgttggtcagatgggttttcctcaggttgagaaactgttatttgctcaatcatccagtgattgatggacacttatattagctccatttctcactgttttattagcaacactgctgtgaatcactttgtacagattactttcgttgggaaaggggcaaaggaggcactgacttccttggatgtgttctccaaagtggaattatgttgtcagctataaaaattataaaacttgttacatattgacaaacaatgcctgtcaaaatttgcagggtgctgtggctcacacctgtaatcccaacttccaggctgcagtgaactatgatcacaccactgcactccagcctgggcaacagagccagaccctgtttcttaaattaaaaaaaaaaaaaattagctgagtacttagatcagatggattgaaacatgacagccccatttcatctggccggttaaggtcctcatggaatgaaaaacactttcgggcactctcctatgagag

SEQ ID NO: 104674 - DNA, 1033 bp, Homo sapiens
caagtcttgtgacctctggacacatgtctcctgagcagtaagacatcatagaaactatcccaacattttagcagaattcaggcccttcccataaccctaatcttgtggactttcattagttttacaaaggggatttcagctctggactggggaggggaacagttttagggagggactattatcatccttgctttaaaattaaactataaactatattcctcctccttggttggcttgacctacgcccaggcatgagcttggatagccagcctgtgaggctggcagcaagatggagtcagccatgctagacttctctgttataatcttgtgaagacagttgcaacctccccttacataccctaggggctaaatcagtcttggacacttaacctctcaaaagttttggtggagatgtgtgttttcacaagtcaggtgttttgagtggctttggaatcaaggtactgctctggtcaagaattttatctgtttccttatattttatacttgtataagcaataacatggtattttactccgttttgtgccatttcttttttccttcagcttatcaaatatggagttattagcactaacgttctgattgaagatctcctcaactggaataacttatacattgctggacgactccaaaaaccggtgagtgttttataggctgcacagttaaggatgcctttcctctctgagcctaaccttactttgatcattgtgattgcaatgagatggaactctggaaatagaaatgagtttctgactcttcctattccctataaaatttattgccaaataatatccacatattctattgtgatataagaagaaatatgtatttggtttttttccttgggctcctggttcagaggtcctaaaatctttggaatatctgagtgttagggatgagagggtcttttattattcataacaagttcctttcagtcgtacctgagtttatactaataaagtgactcttgatgggcccctagatagattcaggatagggctggttgccagggagc

SEQ ID NO: 104675 - DNA, 1031 bp, Homo sapiens
gccaccatgccccaccaaggttctgctttttttttttttttttttgagatggagttttgttcttgttgcccaggctggagtgcaatggtgcgatctctgctcactgcaacctccgcctcccaggttcaagcgattctcctgcctcagcctcccgagtagctgggattacagagcccactactgtaatcatgtccagctaattttttgtgtttttagtagagtggggtttcaccatgttggccaggctggtcacgaactcctgacctcaggtgatccacccgtctcggcctcccaaagtgctaggattacaggcgtaattctgcatttgttataagctcccaagtgatgccaatgccattggtcaaaggcccacgctttaaagggcaggaggttggagtactgacttgagaaggatttgaaggtctgtctgaacttggctaaggagtgagtgttgtgattgactggtgacgtctgcataccccttgggccatatatttgcttttccggttgagatccaaccttgcttcacctgtattttgcagttgaggaaactgaagttcagagagaggaaatgacttccataaggttgtgcagctagtttgcaacaggtcccctgacttccaggcccgtggtgtttctgttacctcccagtggttacttgcctgcagctagaagggctttctgcagtgctgctgctggagttggggggaaaaggctgacactcagcacagccttctgcatccacttgagtcatgcaggacacttagctttgttctttctccacagttaatattatgccaaacctacctgtaattagtaattttcaaagaatattataagttccagtaaccaaatgtttgggcataattatatgccaaaagactactttttaattgataatttttaactgctttttatatatttgcagcctgagaaggctgtttggatactgaggttcagcaaagtgggtctgaagatacttgtttatgcaaatgggactttgtaacctgggaaatctacaggatttatac

SEQ ID NO: 104676 - DNA, 1077 bp, Homo sapiens
ctgtgccttggtttcttataaaattgagataatagcagtagctaccttgtagggttgtgctgaggataaatggagtgactgcgtatgttacccataaagtgtttaaagagtgctggcacaacaatacatgttaaagaagtgtttgctattattacattgatgaaaacaaagctcatatttgttccagagactcgctcacatttctgatgacagcaccaggccttctgactattgatcataattgcgtagtatgttagagcttttccatgctctcttgctgcctttctaggaattaatactgaaattattctcttttcttcactccacagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtagggtaagtgactgctggcctttgtcttaacttggctggttatttacctgggttattagagtgccagctaaatatgtatgttcttgtggtcaggaaacattcacactcctgctggacgttgttatagtcgggaaatatgtatgtttttatagtatgtatattcttatagtcaggaaacattcacactcctgccagacgtcttgaacttggggacagagcagggactggagtccttcctcatgtcccattaactgtcattgcagtgtgaggaggtggttgggtgtgactgacttattttattttttttatttttttgagacggagttttgctcttgttgcccaggctggagtgcagtggtgtgatcgcagctcactgcaacctccgcctcacgggttcaagtgattctcccgcctcagcctcccagttagctgggattacaggcgtgtgccaccttgtaggagagacagggtttcaccatgttggccaggctggtctcgaactcctgacctcaggtgatctgcccgcctcagcctcccaaagtgctgggattacaggcgtgagccactg

SEQ ID NO: 104677 - DNA, 1105 bp, Homo sapiens
ccaggatgtctgactctgtcgcctgagctctttcccactggatgcactgcctgtctcctactgctgcattttcctgggcattgggggccctccccacgtggctgggatctgcctttttggccagaagccacctgcagagtgcctgcctccagtcagtgttgtcatagctatttcctggcccacccatggctcttgtatcagcagaactggactagctcagggtctctaaagatgcgccttcctcacctttccttttgccacctcttctgcctggagcaccttcccctcctgaactctgctttcagaagccatgcttcctctggcattgcctctcaggtgtcccctcctccagggagccctccttggctgcccaaggtgggacttgttcttcccttcgatgtccctcagctttgcagtggcccctgccctagggtacaaggacattttctactgtggcttgtcaaggtcagcactaggaggacagaactaggatcagtaaattcttttggacccttctgtgtctcacactggattttgggcccagccggcattgggtaaatgtttgctaggttgaattacctaacattttccttcagctctcctgcaggacaggggaggtggatcctctggagactggacccctggctttcctggataatatctaaacttgactgtgaggctttaaggtctagggctctgtctgttgcacatactaggtactgatagcttcttctagggtggaaaaagcaaactttgggcagaggtttcctgagagctttacctgtccccttgtctctcttaggggcactcacctgcagcaggcctgggaaggcaaactccttgccttgatttccccagagcccacgcaggcaggtaacattaaggatggtaacattaagatcacgaactttggcttcggtaccacattccatgaggaacagctgatagccctttatggcacctaccactacatggccctgaactcttcctgggccagggctcccaatgccccgccatgaatgtttggagccttggaataacgttatatcacatggtgggcaaagttctgcccttctgctcaggcagcgttacggtcttcacggca

SEQ ID NO: 104678 - DNA, 1065 bp, Homo sapiens
atgtcctgaatggtattgcctaggttttcttctagggtttttatggctttaggggtttagacatttttatagcagtttgacacagtaattttatgtctattgaatctaataaaacatttcggctttgactttgtatgtcgttttttcttttttcaagtaattcatttttattgtatttttatagaagtatcaaaaaaaattgccctttactaaagactaaggaacactggctgaaaggttaggcaagaggggtaaaaggagttctttctgctccaatataaaccaccaagcttatttgaataggagatgacaaagtagtaaggggtaggcattgcctggatttctgcaaatctccctcaggaacctgcagcagtgaatggcgcggggagaggtcagcaatttgggatcctggctgcctttgcctcagaggatggcccataaaccaaatactcccacttgttttttgccatttgtcctctcaaaggttgagtgtttgggggaaaactgaggcagctcagcaaataagatgtaagttctcacaaaaaggttgcaaggtgcagctgttagaatgtgcacatggcctcccttggagaccctgcaaagagaatgcaccgacttgggtctatgtataagcctcctgagtagcagccctgagatccaccgccaaatgagtgacgtggatacaaacgtggcgggctgctttccttctcggttctggatgcttacaggtaagagtatttgtatttcctctattggattcagctgtagatttgagcaatcagatttctatagcaggccgaacaggtctagggaatgacgattcctggtaaattgtttatattgaaatcataaaatatgaagcccataacagggaaaggcagggcaaaaatgagtgcttagcagaataggggaatcttgcagacagatggctgggtgggtggatgacagcccttccctcacctgggagctctttccactccacccacaagcaggagcatcttctctgcagctgaggctttgcacagctggctccagaggcaccattctcaggaagtgtggggacta

SEQ ID NO: 104679 - DNA, 1119 bp, Homo sapiens
gatacatgaaacagttaaaaagaaatctagaattattggttgagactagtgtttcaggcagtcaacaaatggagtggttagtgagagccagagttattggagaaagcttcacaaaagatgaatcttgaagaaaggccaagaaaaggaagaggagaaatgagaatgacattcgtgctttatttttctgtgcaggaatttgacccttctgtaccttgtcctgatttcttatcctattaaatgcacttgttttgagtcttattgccagttaggtatctatagataggtactgatacttatttgtatgggtatgatgaagctgctgcagatttctgtttagttataaatgcttctgtagcttaagatttgaaactctctttggatagtattctctaggaagcctatttggcataaactagagaatttgccttgccctggagactagaagcctctgatggaagtcatagaagccactttcccgtgggctgactcccaactgttttcctattttctctgaagtaataacattgatttattaaaactcataagcccagttcaagtctagttcttgacaacagttttttgctcctgtgtttctgtgcttaatagcagttcccagaattgctcttctaatatgggcctaaatttgtcaaaaaatctcagttaaaaattgatgagtggttttattgaaaagtctctatgagttaaggagcaggtgcttgccgtgacaagcgcagtgacttacacaggtgatttttgcactgaagactgattttagtaaaattgtctcacagtttaagctacctagatagtattcaatgagtgatatcgtatatgccctatattatttttctggtgctggaataggaagtcagagtgtagactcattagaacttaagaatattggtcccctctgaattatataatgctaaaataaaaagagtctgaacaagcatttaaatagcaagagatgtaaaagaagggcttaaaataagcagcctctcagagcatccttaatacaacagcagtttcctttgaatttctgtcattgtaattgtgggcaattggagaccccaccactgaccaggttgatgggaaaattggaagatgtttttcttttgc

SEQ ID NO: 104680 - DNA, 1357 bp, Homo sapiens
tgtcctgcctttgttccggagattctgaccccagtgatcaagtgagcttttcatcctggcatgatgtttcagtgtttgattcagtatagcacaggtactcttgagtgtccagactgcagatataaggcaacagatatttatgaagcaccttctctgtataggggatatttactaagaaaaatgagacacagtatctgccatctaagagcttgctgtccagataggtagataagataaatacttttgaaaaaaaatttactaaaaagtagggcctttggatcaacagcattggcatcaaccaggagcattttgaactgcagaatctccagtcccacctcacacctactaagtcagaatttgcatttgaataagatccccaggtgattcataatcacattaaattttagatgcacttagctgaaggatatgccattagtgctaagggtatggcaataacaccaactactgtcatttattgaacaacatatgccagatttactaagctttgtaccaatctcatttactctttacatagcagtgtaatactgcagaagtttagaagagttaagagatggatctgggctagagtgggaatggaaggtttctcggaacaagtgaggttttaactgagctcgaagaattggaatcaaaagagataggtttgtctcagtccagacagtggatagcataaggaaagtacaactgcagaaaagagggggacaacgaagagactagattgatgcgttatctaggcggtacctgtctccattcttttctagccagcctttgagcatttcatcaagaatagaggaattcaaagtactgcagtctgcttgaaccagtgcttgtgagtggctctaaaaaatacttgaatttgaacttgaaagaacactcaaataaggtttggggcttctctttgtttaatactttaagcgtcttatttctaacataaatatactgattgcacagaatttgattgttcatagcagcagttgcctgtactttagaattctcagatattagagctgaaagatcatctgagttactttataaatggggaaatctcgatctcgagaggggatgtggcttgttcaaggttactcacttagctaatggcagaaccagaactagaatctagaactttaatctctctaccatgtttttttttttcccaactctaccacagtatccctccatttttactattttctacctttaacttttatatttttccatcccttactatctcaaggactggtggggacttttagtctcataatgatagcatttaaacctgagggaacctgaatcatcatctagcctagagaaatggaacattttgcccaaggtcaaatga

SEQ ID NO: 104681 - DNA, 1024 bp, Homo sapiens
tgagccgagatcgcaccactgcactgtagcctgggcgacagagcaagactccatctccaaaaaaataaataaaataaaatggttgaagaagactcttggagacctagtcgtcaaaatccagcaatctaataaagttagtaggactgtgccgtaatgctgaccttcccttcaggaacccatttttaagttagcgttcctatctacctaaggttgcttactgtctttctgtacccaagttcagatctgtaataaccttgttctttttaatatcttcctaaggaaaaaggaatggaggcctaaataggaagttttccagatgtgcatacctcctcaaatttacaagggatataaggattaaacacaggccatgtctattggaatcgtccagtccaatgggagaggacaggcatttaaagaggattttaatattgtatggtaattagtatgcataggatgctatgggaacacagagataagttatcctggggaatgaagatcttgtacttagaaatgttccattaaaatgtgccaccatgtattcttagataaaccacttcgcatctttggactttgattttctaaaatttgtcaaatgagaggattgaaatatattctccaagatcctttccagtactgtattatttccgtggttcagtttttgtgccattttcttttaaaagcattagctctaatttttttctatatggtaatgcctgtaaatctttggaagcagagacatacgtcaataaatgactaaacatttcccggaatgaaaagctcacctttgaatggtcttaattcagtacctccttgttacattattgctaccatatgttatcgtgaaaaaagaggctaatcctgtgatgcctgctgtgtatatttcctcatcaatgatgggaattgggacttgtggctaaatctatgtgggaatctaaaacaaaagatgacaatgccacctgataagcttgcagaagttcttacaagatttacaggtgtacacatagtgggagtgccactaaacaca

SEQ ID NO: 104682 - DNA, 1222 bp, Homo sapiens
gtgtgaactactggtgcccagctgcttttttttcctctcctaatttcacttttttaaagccaccaaattagtggtaatttgttatgacagccttaggatactaatctaaaagagaagaaaaataagcatttactgcagggtctcctatataacccggtatattttaggcactttaatgtgttattttatctcccaacaactttgtgtggtaggcattatttatccatattttacaaatcagaaaaataaggctcagaaagataagcttgtgttttaggaatattctgtcattttgttttcagctgtctactttcttctgttgattgcctgaggaatttattatgtggccctcagaatgactgggcataaaactgtgatgtccattctactgggttggttaaagaaatgcaccgtggattagtcaaaggagggccagacatatcatatgacctttcctatggaaaagtctcagcatctgtcttcccccacgtctgtacctatttctcacctactatatagtcaaatctccatcatgaaacttccctagatttctttacctaatattttatctgtttctctctctcaactgaacctccatagcagtttatctacttcaattttattgtacatactgcattctaccttgtattatatgatttctgccttgtgccatttgtccaggtatattgtaggtctcatgaggatggagatcttgtcttgttcatttttatatcttccatattacctaccagaaattcttacccataacatgttaattaattgttgaatttctgttttcctcttctccttcttccccactttccaggttctagtgtcaacctttagaaggcaaagttctctctctctctctctctctcacacacacacacacacacacacacacacacacacacacacaggtgtgaggaggattcaagtgaggagagggcagtaagacatgaacatgaatagcatgagcaaaagcaaaaaagaatgaaatgcttccatagtagtcaaactggtagaatatcatattcattttgtctttcccatttcatgagtaatcaggatattgaaagatttgaaatgagatccttctgaaaaagcaaagggttccagaaatatgactgaaaacttagtaactgtctaaaattattttgctctgtgatcaaaataattatgagcaaccattcttttagaggaaagaaccaggataatgggt

SEQ ID NO: 104683 - DNA, 1072 bp, Homo sapiens
tactaaattcaccgtgtatttcccatgtgggctgttgcctcttagttggctccctgctggttttctttttcattcagtttattttgtattttttaatgataataattattcacctttgacaaatgttttggttttagagcatttttgacacatctttctttagccctagcagcaatcatatgggatcgatattcacattttagtatttatattcaggaaacatttattgaatgctagctacatgctaggcgttgtgctagactgtatgctatatatcattttaaaagtctcacagtatctgtaaagtattattcagattttgcagaagagaaactagaattttaaagaggttaagtaagtaacctctgttctattcatttctttttttcttctttttttttttgcacctactgcctgataggagctgtgcttagcacttaggagagacatgtttgctgttctccagaattaatgcagtgcctgaggaactcaagatttataaagttacattagaatttaatcaactgttaagacttaattgttggctatactttcaagaaaaaaattaaattgactgttagaattgggcaagaagaatcaaaatttgtgtggaccagggaaataaatacaaatttatggagaaggaatagaacctaaattgaagaatgtggcaccattgtagatccctgatctctggataacatgataaagagttaggttaggagtgttaaggtatctggatggattggtaggaggagagactagaggcgagaaaacaagtcaggaggttgttgtaatcaagattacccataggagccagccttggtcatgtctcctttctttccagaaagagaaaaacagttttttttaggccaaagcatcataacattcttgaaactcttagcattgcccttgcagtttagctgtcagagaaatgctaagttaggagatttgaactcacatcctacttatcttcctttgacccaaacatgctactttgagcttgctgctggttcccatatctcttctgaagatgacctttttgttttttgacataatttccatacatgtt

SEQ ID NO: 104684 - DNA, 1044 bp, Homo sapiens
ccacacatggctgagaggttcatcctgctagaaccccttgaggatattactgagaggcaaaacagtgcctaggaagaatggatttctcctggttgtgggcatgagttaatgctaaaatgaagccctggtggggcatggtgggcctggcaatcagacccacgcaggcttggagcaggaccaagggcagctccataaaacagcatatgtcagtgaccatcgaggtgatcataaggtacggaatactttttgaagaacttgctcaaccctattatctttgaaacactaccccttaaaagacaactaagaccagggcttacactttttaaagttttatgtttgggaaaaccaaggcccagggaagtttggtgacttgctcagggagtcactggtagactatttctgagatccagtgctctctccaccacactctcctgcatctgccatgtggaacttgagacttcccaataaaccctggagcagggtggtctgtgcctgagacacctctagagaggaggggagaggaccctgcattctagggccctctgtgagagagtgcgcctctgacggggccgctcgtccctggttcctccttgtcctgctgactgctgctgtggctgagttgctccgtttctgaggagaagcacttagtggctatatacaaggatagctaaccaaggaccccctttagggcccttcagagactccagcttcttggaatagagcttatcctttgggtaattaactaaccacaccctttgaggcataaattctaataaggaaacatttttatatggttaaattatgaagtttttcttgtactgaacctagggggccctgggcaaccccaaggaatgcagcccccaggcaaggtgctgcctccacgccggctcccccctggaccatcactgccaccttcctcctcttcctcctcttcttcctcctcctcggctcctcagcggccgggcggccccaccacccacggagatgcaccctccagcagcagctccctggcagaggcccagccacccctggctgctccaccac

SEQ ID NO: 104685 - DNA, 1039 bp, Homo sapiens
gagataccatcaccattatagccaacaggtgctgactgctctggcagtgccattcccagtctctgagcttgcctgcattacctcctttcatcttctcaagaaaccttcgagggtaggtactagagatgtttctgtttcgtagatggggactcaggggaggcttcagtagcttgcccaagattacgtgggctcagcgccagagcctgggagacattgatatgggtgtgcacaccagcactccctgagcaccttccagtgctaagtatcgtgccagtgatgggcctgtgtgtcatctcaggtcctcacatcactgccatgaggtgggtcctgttcttatccatcttccacaattggaagaactgaacacagggaagtgaagctccttgctcagggtcagtatgtggacttaggcactgtggccccagaacctatgtgcgctaaccactctaaaccactctgctgtgcacttccagtgataaaggggcattcatcagtacaacaatagggaacggtgccctgtgcaaatgggagaggtgtgtgttcaagggtgcagaaacatgagaagccttggcgtgttctgatgggcacgtcctgtgtccttgcggtcctggatggtgctgctttccccagtcctgtcactgcttccagtcgtggctgctgcctcatccttctgccacgctcccccttaacactttctgcattttacttctcatttctcttcctgcaactgctccagcatctgggattgatggcaacaggacttggctttttaaggtgttgccagccagctagaggacgccttcagctctgacccatgtgtcgttgtcttagtcatttgtttgtgtggctcttttcatcatatctgacttggaggctttcttctacatgctcttcgagcctcagtctcctttgacttttcatagcgatcctctgagaccctgaaaagggaacacaggtatggcctggttctggtatgtgacagaaggcacagaggtagaagtgctaagtggcttagctcagagccacacggaagagccaa

SEQ ID NO: 104686 - DNA, 1084 bp, Homo sapiens
gggatgcgtggccgagacgctgggcgaggccagcgcggggggctacgccccgagtttgaagcgtggcccctgtgggctgggaggaaggacgtcctagccagggccgtgcaggatgccggggcgctgtcgggaaggctctggggcttacgctttaactggaaaagatttgaagttgagtaaagggacgccgagaggacggttacaaatggggataccacataggagtaatttgttaatcgattatgagggcctcaaagtttggagaatccagatgcaatctaaacttgcagagagttaacaagtaaaagttgttgtgtggaaaataacgacaggtagcatattgtgaatatcggcgaagcgccctgcatatttccaagtcctttatattcattatcatcagacttcacagtaagacaacttagtagttattattaccattttacagtgcaggaaactgagaccgaaagacgttgacactcatttatcttactgagagagccatttacgaggagaaatgcgacggtaatggatggtttattgtagaaaatagccagatagctacactacgactgctcctatgaaatagaatagtgtggttgtgtaacaccctcattgcttggtcagcttgtggcttactggtaatggagtctagtcctattgaattgtatgtttggaaaacgcaaattgaattgtatgcttggaaaatgcaaatttcatttaataatttttatgggaaacattgcttaaaaacagttatagagtttgtgtaataaacagtttattttctatgttgttacttctcttcattggtatgaatagttgagacgtgactgtgtagtaagttttctgttagcattagtgtacatttactgttcaatttatccaaggcccaggtggcttatgttaagctgttgtcagaaatttgcacctagtgtctataaaaagacttttactaggttatttgtactagaaggtgttttgtgaagacgggtttgtgtgtgtttacgtatttttatttgtataaagtttctcctgctggaggaagtattcctaggtcattgtgcactgtaaagcagcttgtagc

SEQ ID NO: 104687 - DNA, 1113 bp, Homo sapiens
attctcaccagcaatgtatgagggttatttcatctgtcttttttgttgaggaaaccatatatgtgtgtgtgtgtgtgtgtgtgtgtgtgtgtgtgtgtgtgtattttttttgctttaagttctggggtacatgtgcagaatgtgtagctttgttacatgggtatccatgtgccacggtggttttctgcacctctcaacccatcacctaggttttcagccatgcatgcattagctgtttgtgctgatgttctccctccccttgcccctgcaccgacaggccccggtgtgtgatgttcccccacatgtgtccatgtgttctcattgggaaaccctattttgttaatagtaaataaggttcttggatgattgtgatttcatcttttggaatttctggtgaaggaaatgcctgtagtggtgaggcagttgagcaagaggtttagcagagagtgtgcccaggcttcgtaacatgacttctcccttagtaatctaattcttatttcaggtcttgtccagaatgccgtgtgatatcagagtttgtaattccaagtgtgtattgggtggaagatcagaataaaaagaacgagttgattgaagctttcaaacaggggatggggtaagtgcttttgagtttcgacgtgcccctgctgcctgcctggctctgctgtcagcccgtgtcctcgttctccttcccaggagtgtggtcttaggggcctcttcctctcttccttctctcaggcaccatgctgggctctgggatgcagcaatgagcaaggacatggtgatgtggacctgtttagttttggtgttttttttttttttttttttttttcggtgagatagggtctcactctgttgcccaggctggagtgcagtggtgcaatctcagctcactgcagcctcagcctcctgggctcaagcaggagcctcttgagtagctggggccaccagtagtgtgcgccaccatgcccagctaattggctaattttttttggtagagacaaggtttcgccatgtagcccaggctggtcttgaactcctaggctcaagtgatcctcctgcctcggcctcccaaagtgctgggattacaggcatgagccaccgtgcccggcctca

SEQ ID NO: 104688 - DNA, 1482 bp, Homo sapiens
tggctttaggcagttgctaaaaccctctgctttccctgtagccaccttgacagcactgcggccaggaggaaggggagagttggcttggtggggtacctagggaactttgagcagagacaagtggcccagcttcagagcttagtgcccagaggagtgaccaggcctggcttagctctgtggtgacccaggaggtgctctggagctgccggagggcctgtggagcactgcagtctccacacagcaagtccccaggcaggttaatatcctttgcaaggctgcaggtaagtggggatacttcctatcctgcttggaaatcagaatcccagctgtgtgtgacctgagacaaatcactcaacctctcccagcctcagctgccccacctagaatgtgaggctgacctacctctggcgtaagggtggtaaggatggaggcaggcagtggcccagtttggacccctcattttcccaccagcctcttgactttttctttctgcttttcaggaaaaaagcctgtaaatactttgagcaaggcaaggggacctgcccatttggaagcaaatgtctttatcgccatgcttaccccgatgggcggctagcagagcctgagaaacctcggaaacagctcagttctcaaggcactgtgagggtaaggactttagccatctctagttggggacacttagcagctgtgggcatttccaggtaccgttcctggcagagaaatggggtaggcaaaagaacgatcaaggaacgcagccttcctgttgctcttagcagtaaccaggcatgtccactggctgtttttgcagttctttaattcagtgcggctctgggatttcatcgagaaccgagaaagccggcatgtccccaacaatgaagatgtcgacatgacagagctcggggacctcttcatgcacctttctggagtggaatcatcagaaccctaaagagtagatggttgccctgcatcttgggctccatcggccgaaactttcccaagccagggtgtgcggagcttccctgtactgcagccaaggtgacgtgtgacttggatttgagtggagttgggcttagccttagtctcattcaatctccattattacagccatggggaagagtgaaagatataaagtaacctaattaaatgtatggaattgctatttttatagctgatatagttacacctcaagcccctcaggggtaacaactaacaaacacccaaactgtttggattgattgctttaaaaaacaaacctggctcttacctttgatcttttcttccccagaaatagtaaacttgcagctgcccctaatgcagcatatttttcttaccaaaggagtcttcagccctataaaaggattcctctatagtgtatttctctagtgtatttagtgtgtcgtcaaaattttgatttatacagagctttcaagaacacacaatgcaaagtgagcgcagcatagctgttaacaaacatacaacttt

SEQ ID NO: 104689 - DNA, 1116 bp, Homo sapiens
ttgattttaattgaagggtgagcataaccttgtgaaccagcactagcttgttccaagctggaatttatctaatctatttttgtgtttaaaaaagctgtacctaccaaataaataaatagtttataaaatgtattacttaaggtattagctgagtttagagtactttctgcttaattaatttttatacttaactcttcagtagaggtttacaaagagtacaaaggttaaattacaaattcattcccagcctaggctctgggcacatttcctgttcttgaattctgctcctgaagagggtgaacaaatggggcattcaagttgtgagctcagaattactttaaaaggaggtaacagccagccattacacctaaatttaatttattttattaaaataacataattgagggaccatcagataactgtattttgtcaggtgcaataaaaacaaaattaaaacccaaatcatcaagaaaacctgtattcctggcttccttgtatacacatgatgtgactagagaaacaaggctgtttgtttgtttgtttgttagagaaacaaggctggccctgcggccccgccccataggggcagctcctggaagacaaaattcagcatgatggaagactgctccctgagagggctgagatgcggattggccgagtgccttgcctggaaaaccatcccaatgcactggacaccttagaagctgtgaaaggaggacgtgtcccctaagaaaagttccatagtaccaaagcaggctccttcgggcggccagagtctcggcagtcctgggctgtttggtgccttatgtgcaaaatgtctggcgctgcaccactctctgaagaaagtcccgcctgtgacatgcattcctccagaagctgatttccaaaatcccatgtgtctccacatcagggctggactgcctgctaccttacttcctctaaatactcatgtagccaacagctggggctgggcccctgctttttgtactaccatcaacatccacttgcgcatctacagaaggctgggccttgagcatggggaatgtggggagggagcaggacacaccagcactgcaaatggcttccttctcccagggcccaaagggatagaaaaga

SEQ ID NO: 104690 - DNA, 1410 bp, Homo sapiens
gagattaccgtgttataaagaactttgggatatttttcaaaattaacctgaccattcttttgaaaccagagtccttaacaagcattgagatatatttctccatgaaggcttaacagtgaaaattggagattttggtttggcaacagtaaagtcacgctggagtggttctcagcaggttgaacaacctactggctctgtcctctggatggtgagaatctgggctcccaccagcagtctctggtatagggcaaaaggaatgccttggagatttatgtgcaaacttaaagcgtttctgtacatttccccgaaatccacatgacccctagtgacagccagcctcagggcaattgtagattttcttgaggaagctgttgatcagaaccactgtgaagcttagtgtggagaggagttaataagctgggtgacagaaatgctgggtcttggtcctttaaagacaaggattcctgagctgttttaaccagtgcctgagttggagtcctttgggggaaaagctatgtggggactgaagaatggactcattcataactaatgaaagggacagcctggcccctagatgtctgtgaggcctgtcatatggtgataaatgcacttttgtcatatggtgatacatgtaggccccagaggtgatccgaatgcaggataacaacccattcagtttccagtcggatgtctactcctatggcatcgtattgtatgaactgatgacgggggagcttccttattctcacatcaacaaccgagatcaggtaagtctgtgctggtgcgaaaggacccaactcgtgggagcccctgggcctccgccagcctaagcagctagagggttaggacttgttattatctgttgttcattcaccccccattagctcagctgttttctttcccttagatcatcttcatggtgggccgaggatatgcctccccagatcttagtaagctatataagaactgccccaaagcaatgaagaggctggtagctgactgtgtgaagaaagtaaaggaagagaggcctctttttccccaggtaaggctcagggctgctagaatgtgattaaagcatgggttggttcgtaaagatggcaatataaggtgggagtgttttgttttgttttatagggaggggacccaggtcctctacaagatggtggggggcagggtacatcctgtgtctttgagacacagctaatgagagcattcttgggctttgtttcagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggag

SEQ ID NO: 104691 - DNA, 1106 bp, Homo sapiens
taattttgcaggagatgttgcagtaaagatcctaaaggttgtcgacccaaccccagagcaattccaggccttcaggaatgaggtggctgttctgcggtgagtagaaagctggcggtccagtccctctggagtgctggagtggggagtacaaggactgtagagttagtggactgtgccgcaggttgggacgggcaggcagttaggactcactgtggagtttctgtggttggatgctcctcccttgagagcaaagggatgtttcctttagtttatgtggttgtcaagcctttcgaagagcccctttttaggagaataccctcctctgggcacagtaaactcaatagcccaatttctgtctctgggttttggtttgaggtgggcagaaataggccctatttttacctttatttcccagaacccttttttttatagctgagttgccttattttagacttcagaacagtcagctttccaatctttcagtcactatttagacttgtaggaataagtcatataatggagacttctacaaggagtccttgtgacctccacaggagggtcatggagtgtacattgatgaaagagaatgtcctctctgtaagcaaggctggcactgaactgatggcccagtgaactaatggtgggcttctctttgctcagaatgccacccgggttatcagccgtgccatgtgtttgtttttgggactgggggtggtgttgggactgggggtggtgtcgacagcacagaacccactgtccacgggaaagcacagtagacctccctgagcactttcctcctccctctcctctcttcccctcccctccccagcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggagtgagtagatggtctgatgcctctctgggacccaggcatcaaatttgtccctaaattggaaccaggatcaggaaaagccttctagtccattaagcgattc

SEQ ID NO: 104692 - DNA, 1048 bp, Homo sapiens
caataaagcaaaaatcacagagtcccttggtgcctatactactttggatgacactggaattatctttagagataaatgtgcaaagattgagagaagttaaaagcatcaaatgaatggagtattaaaattcaaggtactgaaaatatcaaacacctccagttttgagtacttggtggttttttttttttttttttttttttttttgagatagattcttgctctgttgcccaggctggagtacagtggcacaatcacagctcactgcagcctccaactcttgggctcaaacagtcctcctgcctaagcctcccaagtagctgggaccacaggtgaatgcccagctaatttgttttaccttttgtagagacaaggtctcactatgttgcccaggctggtctccaactcctggactcaagcagtcctcttgggtctctcaaaatgctgggattacaggcatgagccactgtgcccagccttaccatgtgctcgttaatgcatggtttttaccacttgtaattaatcatctgaccaatttctagttccttaagaggattggcacccgactgaacatttgtaaagtacatgtggaatgattccttttcctttgaaaattgcatctggctgggcagggtggctcacgcctgtcatcccagcactttgggaggctgaggcaggcagaacacttgagcctaggagttcaagaacagcttgggcaacatcgtgaaaccccatctctaccaaaaattaggtagatgtgatggcactcgcctgtagtcccagctacttggaaggctgaggcaggaagattgcttgagctcaggaggcgaatgttgtagtgagctcaatacagtgagtacacactactgtactccagcctgggtgaaagggcaagaccctgtctcagaaaaaaaaaaaaaaaggaaaagaaaattgcatctagtatgtactactgggctgtctcctgggtcccagagaaatgatactgttgtagaatatttatttatatgtatttagagacaagatctggctctgttgcccaggctggagt

SEQ ID NO: 104693 - DNA, 1027 bp, Homo sapiens
ggccgaggcgagaggatcacctcaggtcaggagttcaagacgagcctggccaacatggcgaagccctgtctctactaaaaatgcaaaaattagccgggcgtgctggtgcacacctgtaatcccagctactcgggagactgaggcaggagaattgcttgaacctgggaggtggaatattaaatccttctaatatttaatgaaaaatcagccttggagatactggccactgatatttgctgaatttaatcaaggaacgttgattagagtatgtttaggatttctatggtttttagaggtttttataatctattttgttcttgcacatcctcctcctcttttttccctcccccagagaaaatcttttgtgtgtaggagttgaccagctttccttttctgtttcaggatgcaattcgaagtcacagcgaatcaggtacttttccatagtcatttagccaacaataatgggctttttttctttatgcggtgtatcttctgttggcttatccttgtgtggcttctgtttgtcttgtctattaagcctcaccttcagccctgtccagtagccccaacaatctgagcccaacaggctggtcacagccgaaaacccccgtgccagcacaaagagagcgggcaccagtatctgggacccaggagaaaaacaaaattgtgagtatagacaacagtacctcctgccaattagggttcagtaagaaaaacctcgttggaaattagaatacttaaacttattttgggagaagattctaataaaatacattcaatgaaggagattataaatgttactgtcatttttggcacacttgcatcagacagtttgccagtgctataactaaaatggtatttctcaaaagacaaaaattggaagtatggttaatatgtttatctttaaaagatatggaaacagatgacatgggttgatcctttgatgccctcattatcaaaagattattaccattgcatggagtataataatgatctctacttgtttcagaggcctcgtggacagaga

SEQ ID NO: 104694 - DNA, 1914 bp, Homo sapiens
aaataatgaaaatgttatacctcttaatgcatgttcccagtttggttggtgggggttggtggtgactggaagaggccagtggttaatttcacatttaggtatttccatctaaaaactgaattcccatttatttactttgtttgctggttgtagcaggtaaggacaaacagagggtaaaatcctggcctttttacagacatgctcagcacgtctacttatctgtttaaataaattctcaaatttagtctctaaactgggcgtgttccaactagcttaataggtggtagcgtggttgtcaaatgttaatctgttctttcctggagatgttgtaaaaatttggagtagagtggtgctttatttaaaaaaagaaaacttataatgcactctccttttcattgaattcccaatacatatattatttcctgttccaaattttgtatgcaaaagcacctagacttaagataatttttagatgtcacacatttgaaagaatcaaacattttgtcaaaggttgtacaggtagagtttgcccttaagcatcttacttagtcaaatatgtacttgaaagacttcaccagtatgaaagcctaagtgccaatcatggaattttctttctcctcctagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggtaatagggcaccttgggggtggtaatgtcagtcaattaatggggtgaggttgatacttatttcagagttttgggtttcaaatctgatcaaggaatgttgcaacactttctcaggtctctggacttttacagtttattttatatccataatatcttcagactggctgaatagtctggttagtatatcattcaactggagaactaaaacttcctgaaaaaatgttaacatttgaactcttcccattatcagatttgaataggctattaatgaacaagtgtctaagatatttaaagagcagtttagttttggtgtgggacagaaattaacagtgatggagaactacagattctctggaagacttttgtgattttatttagaaataaaagggtggagtcctaggactttaataagcaggtgtttggggagatgtcaaagtgcccaaagctagtgtttttgaactgctttttcttctcttggctttttggttatgtcctattggtttaatttgctttctgcttcatctttaataacaactgaatacacttaaatacttcctttgttctttattcttctttatttctcattgctttggactagaataacaacctgagtgcttctcccagggcgtggtccagacgattttgtttgaggggaagagtaggtatttttcttcatgcctttgctttcttgtaattaacaggattgctaaaactgtcagacagcagactaccaaaaatgaaatagttgctaagttaaatttatatttcttgtcacttgtttccatgttttctttttctttctttctttttaaaattttttttggcagtagagtatatagaagtaaaaaaaatgttgtatgtggtattgatgataggtgaaatgaatttctgaagttaggccaggcatgacggtgtatgtctgttgtcccagctactccagaggctaaggcaggaggatcactggagcccagaagttctaggctgtagggagctacaattgtgcctgtgaatagccattgcactccaactggggcaacataataagaatccaccttaaaaacaaacaaaaaatgttaagttagattttgaggccaagggcattaaaaagttttttttttaaatcaattccaaccaaa

SEQ ID NO: 104695 - DNA, 1051 bp, Homo sapiens
ctcctgcctcagcctcccgagtagctcagactacaggcacacaccaccacgcccagctaatttttgtagttttagtagagatgaggtttcaccatcttggccaggatggtctcgatctcttgacctcatgatctgcccacctcggcctcccaaagtgctgggattacaggcatgagccaccacgcccagcctttttttttattattattttttaaagacagggtctcgctctgtctcccacagtggagtgcagtggcatgatcacagctcactgtagcctcgacctctcgggttcaagtaatcctcctacctcagcctcctgagtagctgggactacaagtgtatgccatcatgcctagctaatttttgtattttttctagagacggggtttcagcatgttgcccaggctggtctcgaactcctgagctcaagcaatctgtccgccttggccttccaaagtgttgtggttacaggtgtgagccaccgcatccggcggcacaagcttttgagtctaacagacatatgtcaaaatctcagtgttgtcattaaccataaccacatctgagttttcgttcatgcatctgaataaaggggatattaccttccttgcattgttcttatgaggcttgctgacataacctgtgaaattactaagcacaagtgcccacctcatggaaaaaaggtgcctaattactcacttttctgtgatttattccttctattttagtcttttatctatgcattttcaagatggaatgtttccagagaagctgtgtgtgacatagtttgtgaaatgttatactgtagtttgaaaaatattattttgatatagctagacacaggaccagtatttcctagaaatgcacactgggccgggcgcggtggctcacgcctgtaatcccagcactttgggaggccaaggcaggtgaatcacctgaggtcaggagttcgagaccagcctggccaacatagtgaaaccccgtctctgctaaaaatacaaaaattgggggaagggatagcattaggagagacacctaatgttaaatgaca

SEQ ID NO: 104696 - DNA, 1134 bp, Homo sapiens
caaaaacaaacacatgttaggtattgataatgtttccatggatggaaacagtgatgttagatgctgtgtttttttgagacaaagatttttctttgtgtttactctaatgcattatatagactgggcactcagaaagtgcattattttatataaagaatgctatcctcgggagattgacttttctcattcactaatttttttttttattcagttaaatgtgtactaatccctgctgtttgatagattgtttaaagatgcagaagcatttctgcttcagggaagattcatggtttatcctattcctaatggtggtggcaagatagaggcatcccctcaaaggctaggagtaatacctcaaagcagcagagctgtccataattatccattatccattattccctccaccccgaaaatatagggaaacctttaaagggttcttttttaccctcttcttggaaagcgtcacttatgttattcatcgttagcttacattttttcatgtttcaaagagttctgcagtttgggagaatagcccagggaatgaatctactcgaaggggtgagtgtaattctcaatttaggaggcgtttgttgaagtgcaaatctttgaagcagacgttaacttttgctgaaggtagcccaggttgggtccctaagccaatccatagtgttccttaaggactagagagattctgagacagggagggcttggtctactctcatccaaggctgcactggtttggagctactctggagtctctaggacagacagcagattgtcactaggatcagtctgcagattgatgagaaaataaggcttgtcctccttctcttcataagggcaaaatagtcctttggagttataggaagttttccaggtgctgtataggtaattatattaaggaatgtattgtttactgttggatagtgagaaaaatggcttgactaggcttctggtagataatggagaggcttgaatggtgctatacatgttattttctctttacctgagaatattcttcctttggaaaatgggccagattaactggataaaacataagaaaggaattgggcattactttttacttatgtatctattttttgtcttatttatactgtaggcacagaaagtgtg

SEQ ID NO: 104697 - DNA, 1443 bp, Homo sapiens
tccacttgtataacatatacagatttcttcactttttttttttttttttttgagacggagtctcgttcttgtcacccaggctggagtgcaatggtgcgatctcagctcactgcaacctctccctcctgggttccagcaattctcctacctcagcctcccaagtagctgagattacaggcgtccaccaccatgcccggctaatttttgtatttttagtagagacggggtttcaccatgttggccaggctggtctcgtactcctgacctcaggtgatccacccgcctcggcttcccaaagtgctgagattacaggcgtgagccaccgtgcctggcctcttcacctttaaaataatcttactctattattctgaaggatattttcccccaattaatatatcatggactcctctccatccaggtcattataagtaatataatagctgcataatgtgacataatacagatgtctcacactccattcaagtactttcctattgctggacattcaggttgtttcgtatatgtgtgtgtgcgtgggccatcacaagcaatacagactggtgcatttatttctgtgcccacctttccaaggggtgctgcagcctgtgttggtcctaaaggtggtcctttgtttgtaggtcaatgtgcgaaatggaatgagcttgcatgactgccttatgaaagcactcaaggtgaggggcctgcaaccagagtgctgtgcagtgttcagacttctccacgaacacaaagggtaagagctcaaaagtcaattgacttcttcagactagtaaggatcttctagcttcaaatagctatgtttgtattaaattgtactagcttcctatagaatattgtatatttctatacctttctttataaagagataattcagaaaaataggtattaagaaattgaaattattgcttggacattctcttgaaaagttaaatacacgttaagctgggcctgatgaccaatacctgtaatttttttttctttttgaggtggagtcttgctctgtcgcccaggctggagtgcagtggcgcgatctcggctcaccgcaagctccgcctcccgggttcacgccattttcctgcctcagcctccggagtagctgggactacaggcgcccaccaccgcgcccggctaattttttgtatttttagtagagacggggtttcaccgtgttagccaggatggtaatacccgtaattttaacactgggaaactgaggcaagagggttgcttgaggccaagagttcaagaccagcctgggcacatagcgaaggcccatctctacaaaagatttttaaaaattagccaggcatggtggtgcggccctgtagtcctagctgttcgaaaggctgacgtgagaatattgcatgaccccaggggcttgaggctgcagtgagtcatgattgtgctactggactccagcctggg

SEQ ID NO: 104698 - DNA, 1071 bp, Homo sapiens
gagccactgcacccggctgctatgattatttcttagctttttatacatctatgtagtccttgatcccctccatttgagcacagctggtggttggaagccaagcttgacttctcctacagcttatgagaaggttgtagcctaggttagttttgcctgtttctttgggtaaagatgaactaactgtggaagaactagctgctttcaccaggcacgcagcttgaggaaagcggtagaagagggaagagttgcttagctaggccagcaccatcagtcagctctttttactcctccccaggttgctttacttcctgaacccagaatgactctcataatcactcagtgggttctagaaattatttaactgatttcagcatgtatccatggagggctgtaaagaggagaatgagacagaggacgcgtatctgatttaaataattttagatgtgataattaggtttttgaatgtttcttggaatttttattttctaaatgtgtgcctctttgacttcctcctgctgctgttgctgctattgctgctgctgctactgcttctaattattattagataagtgattgactggagccgaggaccactactattagagtcagctgaccagcaggttaaaatacagattcattctgtatgaatgggctttattccatactaactgaatcagaatccttggatgtgttggacaggtagatggaatctatattttctcaagcttctctgaggattctaatgccagctacatttgggaatctgactggattagatgatatttaaagaactgtccagcttgcagtatgatttagtgaagactgataatgtaacagatatcactttatagcttagaaaacattgctatacagtatttgatgcaggtcatgattccgttaggtatgtttattactctttgttttcctcattcttagtgtcttagtagttcacatcagtatagcttacttgttttgtttctgaaaagctggaagttggtgggtatcactgcgtcaagaaacttttaaaataaacttattttggaacattaaaaaatatatacaggctgggtg

SEQ ID NO: 104699 - DNA, 2603 bp, Homo sapiens
acctcggcctcccaaagtgctgggattacaggcgtgagccaccgtgccccgcagttgcttgctaaatcttttaactgctggtcccattttcctcatctatgaaatatttaatggaagtgtactattaaagaaacttttctttgctgatgaatgcaggaggtatcattaaaaacccacatagtgctattttcataattactctttatgtattgtgttcttgggttgaatacttttgttctagagttacaattatttgtgtttcttaccaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtatgtgaacattctacttaggaaatttagctatttatctgcctgtggagcacattaaggatcatgttcaacttaaagacaggcaaaatattcattgtcatttagggtctttatttttttttttctaactgcagatttatttttttatattgctgttccttccacaccccctattttttcctacctcttggccttccttctgttactcttgcctggaatgtcttcctttgtgccacttcatccaaacaaatagtacattcttatgggtatatttcaaagacttttctttgagaagtctctaggcctttccaactacttattttagaagacattttatttcttctattaaaatattcacctaaagctttttgactattacaatcaagtataaagaagaaagtaaagttacatagaaaagattatttttgtatatttcataggcccaggaccagtctggaggcagcttagaaatcatagaatcttctttttcagggcactgacaccagccacttagttctgcgtagtttattttttcagtgccagtgacaggttcatattggcatcatggcaggacactgccactaggttttctgatagaaaatttctttttctttttcttttcttttttttttttttgagacggattctcactctgtcacccaggctggagtgcagctcactgcaacctctgcctcctgggttgaagtgattctcctgcctcagcctcccaaatagctgggactacaggcacacaccgccacgcctggctgatttttgttttttgtatttttagtagagacggggtttcaccatgttaaccaggctggtctcaaactcctgacctcaggtaatccacctgcctcggcctcccaaactgctgggattaccaacatgagacaccacgcccagcctgataacaaaacttcaatttttctaagaatttagctctcaaaaagttttctggctgggtgtggtgatttatacctgtaatcccagcactttgggagaccgaggtgggcagattgcttgagctcaggagttcgagaccagtcgggcaacgtggcaaaccccatctctacaaaaaaaaattcaaaaaagtaggcctggtgcagtggcttacgcctgtaatcctagcactttgggaggctgaggccagctcattacttgaggtcaggagttcgagacaagcctggccaacatggtgaaaccccatctctactaaaattgcaaaaattacagccaggcatggtgttgcacgtttgtaatcccagctacttgggaggctgaggcaggagaatcactcgaacccgggaggcagaggttgcagtgggccaggattgcgccactgcactccagcctgggcgaaagggtgagactatattaaaaaaagaaataacaacaaaaatgtagccgggcgtggtggcacacgtctgtagtcccagctactcggtactcgggaggctgaggtgggaggatggcttgagcccaggaggcaaaggttgcagtgagctgagattgcaccacttcaccccagcctgggtgacagagagccagaccccttctcaaagaaaagaaaaacaaaaaaagttttctactattatggataaaacaaacaaaaccaaccacctggccaaaacagaaaagtgaaattgcattggttttgcttggtggaacttttgagaaaacttgggttcaaaacttccatgcctcttcctttcccatcctctgttctttgtgtaaaatcaatgcattgtgtttattccatatagtcaggtgaagcaaggttctgaggtggggaaccccagtccagagttttctgtttgcttctaacagttccactcttcccaatttgttaataaattgtttatactttttttgtgaacctaaggagcctcccaagtgtagtgttgaatacttaggtgcattttgaactgaaggcaaaactcaaaagtctaactttaattaaagtttgagtaagtttatctttgtctctcttcctaaaaatgaaaattttatggctggcaaaataagcagtaataatcccctatatctgaacaatggtcttccatttgcaaagtaattttgcctactgtttctcatt

SEQ ID NO: 104700 - DNA, 1075 bp, Homo sapiens
tttggttctgtttatatgatggattatgtatgttgaaccagccttgcatcccaggatgaaggcagcttgatccagcagcacatcaaaagcttatccaccgtgatcaagttggcttcatccctgggatgcaaggctggttcaacatatgcaaatcaataaacgtaatccatcatgttcctgtacattcttttgcattctacatgaccttatgtatgtttaaaaacacatttttacatttctttttttgtatttttaggccgtgttggccaggttggtctcgaactcctgacttcaggtgatccgcccatctcagcctcccaaagtgttgggattacaggcatgagccaccatgcccatttttacatttcttgagcaggagccctgtagtttaaaagtcccctttattttcagcagtgtacatttaagacaaatcggatgtgtgagtaggtagaaaatatttaccgtttactgtgacagaacagatgaacaagaatgtatttggttttatttgtaatataaaacaactgtgaagggaatgccaaacaatagtagtgaatcaaactttggaaatacctctgacgtagaattctatagtagctttaattgggtattattatcagctggtctgtttgggacttgtttgatgaactgttagatgactgactgccagccaatcattatcctggctgctccttagctgactgccagtcaacaattactccatgctgattctacagtttttccacagttgtcagtgttctagttctgagtatagtctcttggcataatgtggttcataaacgactgcactgataacttttgttagaactcaccacttgccagatagcccagatgccatatgttactcattcagtaaataactcttaagagcctgccaaatgctagatacttaaaggcagtgggttataagggtgaactgaacttagcttcttagagcatactacctagtggtataggcagtcaataatcattgagtaggcaaatacctaatattatttcaaatggtgataaattattatgaaaaccaaaaagctgagtaaagagaagaatgatg

SEQ ID NO: 104701 - DNA, 1050 bp, Homo sapiens
ttggctatctgaataatcattcctaaaccatattttatttgtacattgtgtgttttggtacttgtgttaatggtgtactttgaatacacatctgtttattttaaaaatcagcagttgctgactagatgaagaaaacaatgactgatttgaaggtgaaaagaaaaactcgggttaaaaaagagtccagacaatgtgatttaaaatgaaaataatttaagcttatttgtggtgagagttaaaaataaagttggctccaggtatcatttgtggaactgatttgttttagcataattgtttttgaactagctcgtttttaacttgtatttttaaagttacacttttaaaatgtaggagtctgttttgtaaacttgtacagcccctgctaacttttagaagagtagagtggcttatttcttcatgtgtgtttattctgggctgtcatctgatgaagttaccagtttgtggtcagaaattgagaaagaggagtgaggaaacgaaaaatattgacacgtacacatcaccttgcagtgcatgagagtgcccttttggactggttaggaaactaacatttgagcatatttgctcagcagaaactttttatgtgtgaaagttattttttttccagtgttgtgaccacttaaaatttatttatttgttttgtttgtttgtttgtttgtttgagacagggtctcactctgttgcccaggctggaatgcagtggcacaatcatggctcactgcaacctggacctccctgggctcaggtgatcctcccacttcagcctcttgaatagctgggactacacatgtgctacaccgtgcatggctgattttttgtagagatggggtttctccatgttgtccaggctggtctcaagcttctaggctcaagcagtctgcttgcctcaacctctcaaagtgctgagattacaggggtgagccaccatgcctggcctgaatttctttttttttttttttgagatggagtctcgctctgtcgcccaggctggagtgcagtggcgcgatctcagctcactgcagccttcgcctc

SEQ ID NO: 104702 - DNA, 1045 bp, Homo sapiens
gcaaaaaattctcttaaagttatacttgctcacaaaaatgttaactttataaatgtagaacactctcctactaatttttattttattattctattgttttttatttttttgcgacggagtctcactctgttgcccaggctggcgtgcaatgatgcgatctcggctcactgcaacctctgcctccttggttcaagcagttctcctgcctcaccctcctgagtagctgggtaggcacactccaccacgcccggctgatttttgtatttttagtagagatggggttttgtcgtgttggccaggctggtctcgaactcctgaccgcaagagatctgcccacctcggcctcccacggcctcgctgggattacaggcatgagccactgtgcctggcctaaattttaaatataagtaatgtactccccagtcttacagaaattggacgactatagaaaacaaacatcaaaaaaagtgtagaatgtgagtatttttagtttaataagtgtattttataaactatttatttgtattgacttctcggataacaacctgttataaaatctttatccccataaacataattttcctaaaatagctataatattgtgattaatgtttatgctaaagtgactattatggaattaacagacttcagttgcagtttctaaatcttgctttggttgtgatgattatataccactgaagaacattcaggattattttggcttgtttttacccttatcactcaagggctaagctgtttaaaatgcaacataaacatttgacccagttgaatgctgggatacttggaaaaataaacctgttactgtttctgtactaaaggcttatcttttaaagatatgtggtgtttttttagcgcagtggtgcgatcttggctcactgcgacctctgcctcctgggtttaagcattctcctgcctcagcctcctgagtagctgggactacaggcgcctgccaccacgcctagccaacttttatgtttttagtagagacgggatttcaccatattagccaggctggtcttgaact

SEQ ID NO: 104703 - DNA, 1019 bp, Homo sapiens
tgtgaacgggttctagggggtcacttaatctaagtggaaaatgaattcaaggcacgttcattgagcgtttctgcttgcctggtcctctgtgggctgagtggagagactctgccctccctgcgctcctaaggcgtgaaaacaatgcagtgtgataagaattggcttatcaagtgttatggggatttagaacagttagttttgcttggggaggagttgaggaagcttctacactcgaggagacttctgagtcgagttttgaaacacctgtgagtaagtgctcatcgggtgaggaggagctcagggaacagctggtacaaaggcttagagccatgtgggagttgggatgagtttggggagcagcaaattgcctggggtgcaggaaggaaatggtgagagatgagagtaaaataaaagttgctagaattgtgagggggctgtctttgttgtagatagtgaactagttgaatttggattattgtacatgggttgccgagtcttcattcttgctgataattttctccctttgttgatgttgaagctgatagtgattgaacatatttagtttaacttagttaatgacttttaaatttttttttattttttcagaacaatgcaaacttttttttttttttttttttttttttttttttttaaaggaacaggatctcactctgtcgcccaggctagagtgcagtggcatgatcatagctcggttgcagcctctaactcctgggcttaagcagttctcctgcctttgcctcctgagtagctgggactacagacaggtgccaccacacatggctaattaaaaaaaaaatagtagagatggagtctggcagtgttgcctaggctggtctcaaactcctgggctcaggcgatcctcctgcttccacctctccctcccaacgtgcttgctgggattacaggggtgagccactggccaggcagaactttttttttttttaaataatagagagggggtcacactatgttggccaggctggtcttgaactcttggg

SEQ ID NO: 104704 - DNA, 1053 bp, Homo sapiens
ggcctggtggcgcatgtctgtaatctcagctactcgggaggctgagacaggagaagtgcttgaacccaggaggcggaggttgcagtgagccaagcttgtgccactgcactccagcctgggcaacagagcgagactctgtctcaaaaaaaaaaaaaaaaatttccttatgctcatgttttcttcctcaccactttcaaggtcaatgtaaggtcactggcaaaaccctgtgggaaaaacaggcagctccatacaatgcaacagcaacagtttaaagtgccaaagaggccgggcccagggcacacgcctgtaattccagttactcaggagattggggcaagaggattgcttgagcccaggaattcgttcagcctgggcaacatagcaagactctgtctataaaataaataaataaaagtggcaaacaaaatagaactagccagatactgaaaacaagttagttaatggagttgggaactgaatttggtgagtgagtttcctgccactacttctgctgttcgtggttgttgtttttagtaataataactctagtaccattatctaagcttaacctgctgcctgaagttccaccatcagagctttgtttgcatgagttaggcccttgtccagtggtggcctggtgtcccttgttggggcacaaacttaacttacttttttctttgcttctgagcagtgtaccgtatccacagcgtcctccaaggcttcatccccctcttccagaagtttaggctgacaggtaacttttaaagtcttcctgtgttcactcattttctccctagcagggtcttcatttagaaagaggcttagcatacaggaaagaacacagcctggaggcagaggacccaggtttgagtcctacctctgccagtttactagctctgtgaccctggatgagccgtgtagcctcggtttcctcaactggaaaataggtgtaatacttttctgctgcacaagtgtgttgtgaagatcaagtgaggaatggatgcaaaggcctgaagtgtgaaacagtagaaaaatggtctggttagtcttcat

SEQ ID NO: 104705 - DNA, 1034 bp, Homo sapiens
tcttggctcactgcagcctctgtctcctgggtttgagcgattatcctgtctcagcctcccgagtagctgggactacaggtgtgtgctaccatgcccagctaatttttgtatttttagtagagacggggtttcaccatcttagccagaatggtctcagtctcttgacctcgtgatccgcccaccttggcctcccaaagtgctggtattacaggcatgagccaccgcgtgcggcccaaactttttcataattgggaagtttacctgaaaacctggcttctctggggaaattgacagacctgtaagagtgggtaggcgttcctacagcagctttctgtggctggtgggtggtggctgcccctttagttggaacaggaaccctccagccggctccattccccacctggccgactccagattaagtgggaagtctccgagcaggatccaccttccctgaagcatgacttctccccccccagaggatcatgggtatatgatcactgatttcctttctgtgcagatgctcctggagaggtggtaccctctggggaatcaggtgagtgtccagttagaggagagaggtcgttggtgctggtattgagccaggtctaggcatcacctctcccccaagagagccagcacctgttgggatacctggctctgagaaacaggagccccaggtccacttagcctaggctcatcaagcaggctgggccagctgtggcatgaagcagggagcctggggagcttggaaggctgtcccagcaagaccccaggagattacaaccaaccagccatcaatagagagaaggataccgtgggggctgcagaattccatggggacatttttttaggtcacctatagccttccccagggtggaggcacctgttaaggaccccaagcggggttgggcactaatgttgagtttcttgtttccaggactccgaaggagaggctctgacccagcaagtggtaaatacacaagctcaaataggagagccagagcgggtgtggattccagacgatgggttgggtc

SEQ ID NO: 104706 - DNA, 1063 bp, Homo sapiens
gacttagctgagtttgggcaggtataaagaggatgctggaggggagactgtccccagtccagaaggcagagacaggggaagacttggggtcccagagtctgccaggggtcgtggggcaggctgtaatgtggagaggtgggtatgcagagctgaggtgcagggctggccaggagccatggggcaggggtgagtatttgtgtgttctaccctgatctttctctctgcagtggagagtaggtgggaggggattgaacaggcaggggactggttaagaggctgctatagggaaagcaattcgggttgtattcaggagggggactccacaggacttggagtgggcaggggaggcagggactggaggctgacccctagggttctgcctttagtaactggcgggggcagacagaggtgctgtgatggggtgcactccgggagccagcagcaggtgtgtggggaggaaggtgatggattcaagctggggcatgttgaacttgaggctcctgggaggcactcactcaaccacacactccatgagggcagctcccaggatcagtctgtcttgttcaccctggcttccagcacagtccctgtcacttagcaggtgaacaggcaaacaaatgaaacctaggagagggggttgggtaggacatagaaataagggagggtaaggtcagcgtgtttctgtaaagtgagaaagaaaaggtctcaagatgtttacaggacagaaaatgcacgggcctcgtttgaaggtgtggatagaagctgctgaggcaggcaggagctgtgctgtgtgcgcagaaaccattgtctggtgttgcctcttgtcttgagcccagagctcagcatctccaaaggcactagggagccatggaaggagttaagcagaggagtgaccaggtgagaagtagactttatactgctctggtctcagcgaggaggatggacagaaggggatggtattgaggcaaggcctagacttccaagaaatagggacagccttactagatcctctatgctttcccctatcaggtctttctccctaggctgggagccaggctttgca

SEQ ID NO: 104707 - DNA, 1041 bp, Homo sapiens
ggagtacggtgacgctatcttgtctcactgcaacctccacctcccaggttcaagcaattctcctgcctcagcctcctgaatagctgggactacaggtgtgtgccaccgtgcccggctaatttttttttttttttttttttttttgagacggagtctcgctctgtcgcccaggccagactgcggactgcagtggcgcaatctcggctcactgcaagctccgcttcccgggttcacgccattctcctgcctcagcctcctgagtagctgggactacaggcgcccgccaccgcgcccggctaattttttgtatttttagtagagacggggtttcaccttgttagccaggatagtctcgatctcctgacctcatgatccacccgcctcggcctcccatagtgctgggattacaggcgcgcctggcctaagctatttatcattatataatttatcttcacaaaatctctgcccaggaggcactgttatccttgttgtgaagattagctgactaaggtcaaagaaatgttgtgacctgcccaaggtcccatagcagttgggtggcagagtcagggctagaacccacatttgcttgactatgaaacctctgagttgaatctacagtggtcagggctgcaggtgcatagacagtctgagtgctgtgggctgggggaactccgggagagtgtctggcttgggttcagtgatccacctggccctgcaggggctcacctggaccgcctggtgcccctggtggaggatttctgcaacctggatgatgatgagctccgggagtcctgcctccaggcttttgaggccttcttgaggaagtatgtatggtggggttgcctggggatccctttgggaagttggtggggatgctggcccaaagcagtaaaatttcaggactcccattgggccctgtcccccactcctgtcctggctggatccagcaaagcattcctcatcctgccccacaggtgccccaaggaaatgggtcctcacgtgcccaacgtgaccagcctctgcctccaatacataaaacac

SEQ ID NO: 104708 - DNA, 1111 bp, Homo sapiens
gccaccatgcccggctaatttttttgtatttttagtagaggtgaagtttcgccatgttagccaggatggcctcaatctcctgacttcatgatccgcccgccttggcctcccaaagtgctgggattataggcgtgaaccactgtgcctggccagtaacatttacttctgatggcatttgtgatgcttgaatgaaacgtcatcagtcaagcagtcagcacagtgcctgccactcagacagtgcctgctcagtagattataagaataattgttcttattgccactgttatcacttgggggaaatgacactgcaggctgagcaaaggcatggagacttgagagtataaggcacgatttggggctggcatggattgtggaatagagatgtggggtttgtagcagaagctagaagaggtgtccttacaccctggggccatatcaccaaccttcatccctcctgcaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccgggtaagaccaagccccctgccagatctatgtgcccctgtaccaagggatagtcgggcaccattggggccatgcttgtttgtccttgctccctactccaggcacccaatgaaaatagctgcattgttgttttctgataagaaaaggaacctgtgtctcaaacacctttggtgggagtctacactgggcaggctctttggaggatggtttcacagcaaccagaaaaaaaaaattgtccaggtgtggtggcttatgcctgtaatcccagcactttgggaggctgaggcaggaggatggcttgagcccaggaggttgaggctgcagtgaaacatgatcacaccactgcactccaacctggacgacaaagcgagaccctgtctcaaaaaaaaaaaaaaaattcccagacgaaatttttgaccctgcagggcactttcagctgtggaatactagcagcattgaggagcgagctgcatctcttcgtgttgtgac

SEQ ID NO: 104709 - DNA, 1125 bp, Homo sapiens
aagagctgggattacaggcgtgcaccaccattcctggctaatttttgtatttttagtacagatgaggtttcaccatgttggccaggctggttttgaactcatgaccttaagcggtctgcctgccttagcctcccaaaatgctgggattacaggcatgagctactatgcctggcctggtttgattttagagatagacaggctctgtgttgccctggctacagtgcagtggctgttcacagctgtgatcatggcacaccgcagccccaaactcaaggtgggctcaagctgtcttcctatctcagccttcctggtagctaggaccacaggcacactccaccacacccagctagttctaggtgttttgagtaagttagacacttggtgagctttgtgtataaaagactcagtgacctgcttagattaaaactagggcagtggaatgaaaaattctcatgggaagtgacagtttattttcttcacttactggtaaatgaaagccaaaaagctgaattttcctaagtaaactagaaagaacatggagtgtgtgtgactaactaggatgtttgtgtttacgtttacaaagataactttcacctacagtggttgtagatacaagtaataaaaatgaacaagaccagtattctaacgtggttaccttccaagattggaaatttaaccaggcgttgaaatgctgaaaatttctgttagaaaagatgggcgaaggaattaatggtggatactgaaaccacagttggctgtatgagttgaactgtaacaggcaatacctgttgtatggccaacatgattactcagttgcagtgcacatgttggctggttggcatatgctctgtaagcgcagcttggcagtctttaagatccatagaaatactctttgacgtttgatctctaagttccatttctgggcatttgtccttaaggaatggaaaagcaggcaaactaaagctagtcattgcagcaataacccactggaaacaactgaaaatataatgagagaattgtagagtgctggataaaatgttgtgggtccactcaaaatgattcgagtgttgtagtgtggaaaatgcccaagccaggggggacacatttaaaatggtgggtacactc

SEQ ID NO: 104710 - DNA, 2662 bp, Homo sapiens
cccatcagcccttgcgcgccaccgtcccttctctcttcctcggcgctgcctacggaggtggcagccatctccttctcggtaagtgttaatccgtggcaatccgcattcctgcgggattcatctggccccgtcgcccagtggtgcggaggcctccccttcagcgcggtagtgtctgtgggtattgttattgtcagcttactggagcgtgtacaggaacagaacgaagccgccgagttgatagggctttgcgtcccagagcctcctgccctccgcctgtattcagagctgcgggctgcttgtttgttccttggcggtggagggtgctagttgaggccagacttcggggtctcctgggggccgtgggacgaccaggggtggcccagcttgacagctttcagctgggatctgtggatcccagcgctcaccaatgtcggcccacgtgtattcgttcatgccatggccggcttcttccgctgcagtctctggcccgagggctgctgctgcgggaccgccaaggaaagacgagctgtaggtcggctggtccagctgcaggcagaaattctggtagtatctctgggaatatgaagatgcaactgcccccaccttgccttcgaggatatcatgggccagaaggcagagtcgttttgaatacgtggttcattgagtacccactctgggccagttgatggctgcgaagagagcagaaggggtgctgctgtaggaaatcaatggctcggaagaccacactgaggaaggtgtgagttgatactggaagatctccaggtttgaggcatcttcagaggtatatggtggttttgtgtgtgttgagggtgtggtagcgcagcagctccctagggaattagaaggttttattgaacatttaccctgtgacaggcactgcaggcattcagcgcgcagtgtcatcttcattttacaggtgaggaaaagactcaggttcaagtagatggtcaaggccagtactaccggaaggaccatctgggggttcggacactggtggggtgggatttgctgccccttgcaaattgagagtgtcttggggtcagttttgatttgctcagctgttggcattctttgggctctgagtgggtgaggtgacccttgacctcctgggatcgcatctggagagtgcctagtattctgccagcttcggaaagggagggaaagcaagcctggcagaggcacccattccattcccagcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaaggtatgtggtcctgggatggaaatgggtgtggggtgaagaaaagagtttccaacagtttctgacatcacctagtcaggattatctttgaccgatgaactggcttgtggaagagctttctgtagaaatacaggtctcccccagtgtgccctagtgctggtacttatgtctcttgatgtgtgaagcgaaactttaatgaaaagggacatttggccgttttgatgtgttcagagggctttgcatttgtgtcctgtattttgggttgccttgtgacagcaggatccctattttatagacaagaaaactcaggtgctgagagcagtgtctgcagctgtgcttgccatctcagtatctacacagtcccctcgcatcccattggtgcctcctccattgcttgggagtggcaatggtgggggtgccttcatccctagtggctaaagccacgagctcctggtttttcccaccaaaaaagtaaggaaatagtgaagtcctgttaccaaaggcaactactgtgtggcatacttccttttcatttggtcctttttttccctccccaaaaggaagagttcgcactctgcacagacgctaacccacctgtgtattatttccttcagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaagtgagttgggtcccacctctagttttcagtgatcagaagtttgcatctgtgtgagcacttctggcaggaactctacaaactcttgggatgcattttggcggggggtgttgtacattctctgagggaatcagaagttgttccttgcaggattttagagaatgcttgttggggaattcaaggtgtttcctttgctgaaggaggtgacttggtcttctaagtgtagagacccaagaccaggaaaagactgctttgtgaacactgcaataatagccactttccactactacaatatcctttggctgttgtttccaaaatgttgctttctttatgaaggtgtcaagcaaaagagttgaactctgaaatattcgaagagatttattctgagccaaatatgagttgaccatggcccgtgacacagcccttgggagaccctaagaat

SEQ ID NO: 104711 - DNA, 1034 bp, Homo sapiens
ttccttacttttttggtgggaaaaaccaggagctcgtggctttagccactagggatgaaggcacccccaccattgccactcccaagcaatggaggaggcaccaatgggatgcgaggggactgtgtagatactgagatggcaagcacagctgcagacactgctctcagcacctgagttttcttgtctataaaatagggatcctgctgtcacaaggcaacccaaaatacaggacacaaatgcaaagccctctgaacacatcaaaacggccaaatgtcccttttcattaaagtttcgcttcacacatcaagagacataagtaccagcactagggcacactgggggagacctgtatttctacagaaagctcttccacaagccagttcatcggtcaaagataatcctgactaggtgatgtcagaaactgttggaaactcttttcttcaccccacacccatttccatcccaggaccacataccttaattttgacatatcggtctgactggtgccggatgaacttcttggttctctttttgacgatcttgggcttcacaaggggtctgagggcggccatgatgccttttggggaagaagcggccccaggtgaggaagaatcctggaaggaggctttcctgcccagggactgaacactgtcgcagagtgtcttccaatcgccagctacggagcaagctgggaatggaatgggtgcctctgccaggcttgctttccctccctttccgaagctggcagaatactaggcactctccagatgcgatcccaggaggtcaagggtcacctcacccactcagagcccaaagaatgccaacagctgagcaaatcaaaactgaccccaagacactctcaatttgcaaggggcagcaaatcccaccccaccagtgtccgaacccccagatggtccttccggtagtactggccttgaccatctacttgaacctgagtcttttcctcacctgtaaaatgaagatgacactgcgcgctgaatgcctgcagtgcctgtcacagggtaaatgttcaa

SEQ ID NO: 104712 - DNA, 1091 bp, Homo sapiens
gggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctgtctcgcaattttgaggaggctgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcc

SEQ ID NO: 104713 - DNA, 1407 bp, Homo sapiens
tgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaacttgctgcattattgctcttttattgacaatgggcaaaaaaataagtagacctgatatggttgatgaaaatacgtaagtaaactttatataaatatataaatatataaatatatatatatatatactgtataggtagtacttgtgtgtgaaaggcaggcgtttcagtccacattagcaatacccaccttacaaggagctccacttacctaataggaagacagtaccttagctgggtgtgtgagacaatagaccaaaccctaaatgctaggaacaaattcagatacttcatattttcatacaaagaagtccctctaggactggctaaaatctttacacaatcattactaactgtgccaagtaacatagcatctaactgtttaaaaagtccagtattgctttgtataaatccttattttattaacagaatactatcataaatagtattataatgctgttatttcaggtaagcaaatagctaaactgcagtacactctacagtagcaactcaggacagctggttacaagctggttgtcttaggacattggttacacggattcttagacactttaatggctgcgataactgtgactctccatgatccatgtttcttttatgcgcatatgatttgacgcacactcattcagagtcctccgagaggggcacccatacacggcagaagtgttcatctccaacatgaaagtgaccagctctcatcctcgtctccccaacaccataacgtcctcatcccgcctccaacccacaccaggccgaagccctcagagagtgttttcatcaggaaccactctcgaacctgaaggttgactttagcgtttagcaacccagggcggtgtgtgtgtttcccgttttgttttctgagtggtagcagtgatcaccgtaattccatgtagccatgtgctagcagaacccctgtgtcctcaccgtggcccgtgtgaccccagccgacgagtgcccggcggagcccccgctgccttcccatggtccagtgagctgccagggcatcacatgactctcagctgtgctcttgtcgcttctgtgttgtggtgacaccatgcgctccccagggccagacctgcac

SEQ ID NO: 104714 - DNA, 2083 bp, Homo sapiens
gtggagtgcccatagtgcaccccatgggagctgtgggccacaggccattcgggagaatatggcgctcactgctgtccagaactgagatgactagagaagactcccacctttctcaggacgcaacctctgtcctcctccaggacgcggccccagcagcctcccctgagctcgaccacttttgtccctgagtcacatgtggagcgacacagaccatctttcccaagtcgggagatgaggttgctctgcacccctgcagcctgccactgcggaggctggactcccggcacttatcccaggctcacgcacaactcagccctaccattgtttcctgaccagagaggagattgcagagaacacactgagacccgtgggcctcctcccctctccttcccttttgcagactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtgtgagtaccaggcctcatggacagaaggccgagacttgccagactctggcacttgcctccccatgtcagggcagtgacttctgagctcacagagacaagatgtcccccagtcttttctggccttccctatggccacatgatggggcagtctgtgttcccaggctgcaggaggcacagagggagtccaatccaggacccgccctacctgttgcctgttgtatgtccatcaaaagaccctggctctctggtcatcccgtgcgcaagagcccgcagagttcccagctggcctctctgcacctcgtcatcttctgcatcaggctcaaccgactgatgggtcacacagccaaggccatccctggctccaggtctactccctggctccaggtctactccttggaggcacatgggactccctaccactgccctctctgtggaagaccctggctaatctttgctcatctctcagacccaggcaagtctgtgcctccctgtccactcccgagcctggaaggtgactatccttcctgcaggtcacaaggccctctggtctctctagcctccctcctgggatctcctttctgctcttttgtccagggtggccatcacaccctctttcccagaaacaacccttccccattccaagcagatggtggctcaggacagtgctagctccaagcagaaggccccgtctcctgcccactctaggctgtgctcctctcaccaggaccctcaccctctctgttccagcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggtaagagcttggcctagaaccaccttgctagcccagcgcatgcaagaccgaggcagggcgtctgcattcagggcatgcatcacgcggggcagggcctgcggcgaagccagtgcggcatttcccctgaccttccgcaaagcagagcagcgtgtgacatacagaaagggcgccccaaaaagacacagggaaacaggacccaaacgtcaaaaagaaaggcattgcacacgaattagctggggaagtcacccccattttccctttcttcttccaggggttttatttacttgtttattgatctgggaagtcgctctagcccgagtgagccggcggctgtgtcccgtgctctctgtgcggccgcgtccctgtgcttcatgctgatgaatgaacttgcgcggaaccctctaatctgtctggcgcccccttgcccactgtccccggtcttgctttccctgcggggcctcctctcctgggaaacccgggcctcgtccagcccagaggccattgagcagcagccagggctggctccggggtccgggaaagccctggtgggaactgtgatgttgtggttgtttctttgtttctgtgtgtgtttaattt

SEQ ID NO: 104715 - DNA, 1160 bp, Homo sapiens
gtagagctcactgcaaaacgagtttgcatttcccatatgtataaggctgtttctctgctcacagcggttttcagagtggggaggaagaaagaagcagtgtgtgcttgtggttagggcagccccgggtcagagcccagcctccagcctctgcccatgtgatgtgggccagcaacagcaaccactgcagcactcccaccgctcagatgcagagctgggcacgccccaggcgcccctcgtttcctcacaacaagcctgtgctgtgggcaaggtgttttagaggaggacaccaagcatggttgaggcagtcactcgcccatagtcacacagctagtaagggtgaaagtaggacgtggccccaggtccatcggagcccaaacaaaccccagcctccctatactccagcctccccacacgtcagcctcagtcttcccatctgtggaatggagatgattatacccacttcgaagggctgtggttagcatggagcagggtagcatttataaagccctctgaaaatggcttagaggtggctcagcccctgacacccatcgcctactagaccgggtcggatgtattgggcccgttctggtaggaggactgaggaaatttgtgttgactgaaaatgtcctgttgctgtgggcctgcctgggagttctttggttctgttgggtctagtggaaggttcgctcctctgatttgctttagaaactggtaaatcgagtgagcctggggcccaccctgatatccagctgcatcccctacccaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccggtatgtgatgggccctggtacgtggtgggccccagcaccacccgggcggggctgcctgccaggccttctcactcccacccaccccactccgtgtggtctcttccagcagggctggtgaattctgccagggcttggggttttttcgagtgtctcctgtcatatttgggaataacagctattggctctgcgttacaatctgaagagagctgaggctcttaatgatctagcaggccagggttgtgcagtggctgagt

SEQ ID NO: 104716 - DNA, 1025 bp, Homo sapiens
ggtggtgagatgtccagcagctgagctcaagaggtcggggcagggatataggagccagtctggctgttctctaacccaaaagtcccacctagagactcatgtatgctggtaaaatgtgaccatcactttatagccaagctctgtcactaaggtatctgtgtttctgccctagaaagggaaaggttgacataggatagttcttcctgccccaggaagaaactgggtagagctgagtcctaatcaggaaggtggggctgagagcccagagtgttgctgtagagcaaaacatctttacgagttcagccagaaaatagtcaagcgtccacatcatttaagttcgataacttcctgtcctgatttatactcctagcagcagagtcctagagtgcccatggctgcatgtacttgtcaatactgggtattttcacttaaattgtatttttatttatcagttcagataaactcagaaaagccacttttttagggtctaatactgcactgcgtagttgctgattggggccatcaagaggtgatgtcctctggctcaaatgggttcatagctatgtggaaaattccacactgtgctcacttttgtccacgtttgctgaagaatcctgtggtgccacactggttgcagtaggatggcccagccatttcttttttttggggtggtttgaagttgggtttgatttttttttttttttttggagtgtggaagggctgccacattgcacaagctgatgctattcaatagactggacaggacccggtgacagattgaatgggggcgtttgagtcgggggagggattaaactgatgacccccaggaccctggctccaggatggaagggaagactgtgggtgactgtcaggccttcccttcctggagagggaggcccggccactcccaagcatgttctggacctgctgacccagggcagccaggaacccaggagtgcccagagcggaatcctgggctgccacaggcccagaaagtctgccccaggccaccaccattgcaatcc

SEQ ID NO: 104717 - DNA, 1073 bp, Homo sapiens
cagcggagatctggggagatggtccctgcaaatccctcttttccttccctcctgctgaggggaacccctctcccccatgtttgccacgcagcccccatcagacgccctgtgctgccatccacatgccccagggcctctcccagccctgggctccacactgccattgatccacagccaccaaggccctcgggctctttcccatgcgagcccctgaagctgtgaggggggagggagatctgattccaggttctaggggctgccctctcatccccagcctgtctcctggaacctgcattctcatctccaaaacccactcaggttcctgggctctttgagtgagagagggtctcacagcagccgtggagggtgtggcctggcccctgcaggctgacggtactctttatgtttgggagcgaggcctgggctggggaggctggagccatcacctccctggggccggaaagactgcctttgacaggacaagggctgccttggctgtgtggccctgggttcacaggacacggagacctttctttctgtcccccacccgactacgcgctgatgagaaccagccatgtctgaggaccagaggtctctcctgaaataattaccctctaattaggcatggcattagctgttggtggggcttcctggaacactctcactgactccactgtgatgctgtgaaggggcggccttgcccccactgtgcaggtaggaaaccaaggctcagagaagttggggttccaactcaagtgttggactctagcccataatgttactgtcactcctgtcatgacaacattagggtggtagatgcctgacggagctgtacagagcattcgggaccagagggcaggggcagtgcgaaaaactgcatcttccttcatgtggttgggtggcctgagaagccccctgtacgctgactgctgcccgactcctcgtgccgtctgcccatctctccagcagctgctgacacatagggagatgctcaatgttggatcagtcagcaaagctctaaaaatagcctcccgctttgaaaagttcattgttcgagtcctatatttttctat

SEQ ID NO: 104718 - DNA, 1024 bp, Homo sapiens
gtggcagcagtctggacatgggggtcatgttattcatatcccacacacacccgcggccctcatagtccatcagctgtcccacctggtattacaattgcttcttacccttgtggtaccagcatcctcatattgcaggagagcaaatcgaggctgagcattcagtcttgtcagtactaaagctctgtggtttattgagtgcctgctatgtaccagtccctgctctaggcaccagagacacagcagtgaacaaaacatggagtctttgtcctcatggaaccagcagtctagtggggaacaagaaaccattagcgtgctctcctggctgcacctcccgcctccctctgagctgaaagtaactggggaggggtttctgcccctccattaggaccattccagttgacatgtccaggccacctctcttgcatacttctcagtcccacatcccttctcattagaagtccctccgggcatctcatctcaatcttccagcttcagggaagcctgcttggatccttctgtggtctgggttggtgatgaacagctgctcccccagtctcagaacatgaggcagaggtcttggaggttgagaagcctcgctcaggtgtagcccatagttcacgcatcagcctcagagcaggtggatcccatttgctctggagcacctggtatgtggttccatgggaagcttgggggaggggtagaggaaatcaacccagtccttggcctgtggaggcagagctagatgctccttgggctggctcccaggggccagagccctttaagctggccgtctccccctctctaaacccggatgggatgcagcacggtccagaaacctcaggggaccccccttagtctgtaacgggcccaagataaccactcccaagtccagccatgccaccatgcaccactctacaaataacaggcttctttccaagagcgtgtgtggcactttgctgtttgagccttgtgaaacacaggactcttcttatcctcgtttttttaagggtacacacactaagag

SEQ ID NO: 104719 - DNA, 1029 bp, Homo sapiens
gcttggctggcctggggctcggacttggggccggagccgcgggagccggcggacgctggaccaggagccccgacgtgatcgcgtggcgggtggtcgggtctccgggtggccgggtgtcggccccgggatccggcggctcgctggcgggagtcggcggcctctgctgggcctgggtcccggctcccggcccggcccgctcccactgcggccgccatgtggtgcctgcactgcaactcggagaggacccagtcccttctggagctagagcttgacagcgggtgagggcgcggcgcggggcgagcggccttcccgggtgctgagcggtgggctggcgcaggctgtggggatgcctgtgcgggagtgcgggtgaccgtcgggaccgggcgcccggcgtgcgagagaaagctgcctgcggggcggggtgcgtccgccagactgtgggtttgggtgagagaagagcaaacaggacccgagtttgtgcgtgggagagagagacgcgcccttgggacaggagcgctgtgtgtgccctgggagggtctcaggatgggagtgtgtgtgtgtgatcgagggcctgttggagtgcaagttggtgtgggggtgagtttgagtttgggggcttgagagggaaacagtgggactcggtgtgggtgtgaggtgaggggcaggagggagagcggagagttggtgggagggtgcccagcgggtctgtgcctgtttccaactgcaggcagggccggagctgccaggaaggcctcttgcaggcctgtctattccagacattgggcctatgtctggattgatgtgtctgtcctgtctgcaagaccccaagtgtgtgtgagggtggatgaccctgaacaaacaggcgtcccaggtgtgtcagcagcttctgtcgggtactctgcccctggcagggccacttgggggtgcactggggtgtgtggctgctgtttgtggcagagtgtggatgtgaggggctttgtgtggtgatgcgtgtgcacctggtgtggtcagggatggagtctggtgtgt

SEQ ID NO: 104720 - DNA, 1065 bp, Homo sapiens
ccccactttgaggctgaagatgctgaggccctgggaagcagagtaactgtgtgaggtcacatagcggggctgggatatctgctgggcctgctgcccacaggcctgcctcttctatctggggcacagagagtggacacgggggacagagctcaggggcgacagctgcaagggcctggagccctgttccaggagctgtgccccagggggccaagcccacccagcataagtgtcctccctccctgagggtgctgctgtggctccctgcgccacctaccagggaaggtgggatgagtatgaagggctgaagtgggggcatttttgatcgtcagctggggctggcaggcacctaaatgggaagggtgatagcagtgtgttggggggagtttagggaacggtcctctaccgatagaggcagcagctcagtggaatttcctcctgaagttgtcttgccccttgaatcctgcaggaaggctggcaaatggccatttcccttccacttgaatagagacccataactcaagtagctgcccttaagacaccacaggactgttcttcgcgggccctgcccctggatttgggagaggcagtccagctcacccaactaggctctgcagggggaccaggagggatgggttgtgtccacaggagcagccagactgatgagggatgcggcaagcatattctcaccaccttctttcacgtttacaacagaccagcattccctgtgtggcaggggttacattggtcaccgaggacctagaatcatggagtgctctggggatccgggcttggagggcttcttggaggaggtgaccattcctggctgttttgtgtgctaaagaaaaccctcaccaaccactgagcacccatcatgtgccaggctcctcagagccctggcagagccacctgtacccgtgctgggtttcatttctccttgcgggggacactgtggcctagctgcagtggttctttattgcagcccttccctcagggtctttcccatgcatcctcagcaggtgagtccgtttgtcaactaatggcaccataacagctgcgtctaatttt

SEQ ID NO: 104721 - DNA, 1058 bp, Homo sapiens
gctctattgcccaggttggagtgcactggtgcaatctctgcttactgcaacctccacctccagggttcaagtgattctcctgcctcagcctcccgagtagctgggagtacaggcacccgccccacgcccggctaatttttgtagttttttttattttagtagagacggggtttcaccgtattggccaggctggtctcgaactcctgaccatgtgatccgcccgcctcagtctcccaaagtgctgggattacaggtgtgagccaccgcgcccggccctgtgcaaagattcttaaactgctgcaggtattacagtcatctggggggtgggaatttgcatttcaaatgattcccagctgaggctgctgctgctgctgtttctaggaccccactttgaggacaactgttggagtgcaaggaacacaggctgagtgtcagcctactgggctctaatcccagcttcatcacatgggctgtgtgtcttagtgcaaattacttaccttctctaggcttcaaggcctctgtgataaatcagaaaacaatccgcaccttgtagaatttctgtcaggattatgtgaactcatgcaggaatgtagttgacgccaattgtgaattactttcactccccttacccaaccgagtttcctgagggcagggcccacatctgcagcctctgagatgcctagtgcctaacacatagtaggtgggaaggtatgctgggaagttattgagcacattcaggaatgcacacattctcaatgacagatttattcaaacagtgaatcacacgtcacacatgtcctgcctccattaattctcaatcagtggagttgggtcaggtcttccttccactgggacaaaagaaggtgttgtttaaatcagtaacataaagatgactgcaaaaagggatgtttaactcacttaggagacgctgttgatttaggagcacttaatggcatccatttacaaaacaggtgaacccagcacttattataaatgaacgtatctattcattacagcagaggccctgcattcccttggtagctgttctttggtgtgaa

SEQ ID NO: 104722 - DNA, 1090 bp, Homo sapiens
ctggaggtgagtcatttaacccctctgtgcctctgtttcctatggactaagagggcccacttgaaggggtggtgggagcattacaggagataacagaggtgcagccccttacacctgccctgtgcagaaggtgctcctgggcccaagcgcctctccttctctctgcacagctcaggaggcacacagtggggcagcagccaagtcttgttcccaggaagagtggaacaggacgtggaggcctccagctgcatgcccctggcaccaggctgccttcccccacctcaggtagtcgggaaatcatttctcgcttgagtatgctgtttcttgttgcgcaaaatggattcttagatccttgttacccaccaagcagggtttcaggaagtatgagatccaggccgcgaaacgattccgggtgaggcacaggctcagctcttggtgacatggagcataccacctggaacatgagagagagttctccttccggtgctctttccgcccttctgatgacatcagacaggagggtcggcatgctgacagacctttaatgtctctttatcacccacaaaggcttaatgcaatgtattgattatatagggagtaatacagtcatggttcaacagttaaacatacagaagggtacacagtgagctatgcgccacgcccttccacgtcccattcccctccccagagacaaccgctgtccagggacatcttagagtgtgtgtgtgcgcgtgctgcgtgcatgtgtccgccttttttgtaacccaaatccagcattcttcagcttacctttttcatgtagcactatgtcttgtatctcagtccctatcaggatataaaaagcatgcttctgttttattggcggcgtcctgtcatgtggattctctgtgcttgctaatctgtgttgtaaacaaaacacagcaggcctcagggatggggctgataacaggatcaaagcaggagtttataacagcattttgtttttgttgatttattttcatgggaaaattcaatttatgcttagtgaggctggcttttcacttgtggagcagatataaagttttcttgatagaatgaagagcgttaagta

SEQ ID NO: 104723 - DNA, 1021 bp, Homo sapiens
ccgcggctatgcagacggcttatcccgaagccttgcgaacgctaaaggcgcgatattgggggtcggggaggggcggggtgctccatctcttcatcagtgcagttggttgcctccccgaagcgggggtacgtgaatccagaccccgagggtcgccatgcaaagcattccccaccccccgactccgcactaccctgcttctcttccccacccccaccccgcctccaccaccgctgctgcctccgggcggagaaatcccgccaccgcgtccagggtcccgagcctgcgagcgggaggttgaggcatctcaggaattcgctgggagccacacggacgcgccttgggagggagggagaagctttggcagggctggagggctgggtccaacctggccctgtccctgcctcccaaccccgtgtgaccttgggcagcccctcctgccattaccacgtggggaagagactggttctcagtcttggggtggagggagctctcccggtagacctccaggagagttggcttagggagcagtcttggggaccagaacagccttggcgacctctggaccctgacccatagggggcaggtggcagcagggggatgaggtgtaatgggggctgttgttggaaacctgtcccacctgccagcctgaggatgagacactcctgggccagggtcttagagtgtgggacccccgcccccaccgcaacctcccgctacaaaaccacctgcccttgggctctaagcaggcagggtgggttggcagaggtgagtcaagcttctccccacccctaatagtcctggggaacttcccctcccatgtttctgccaggcagttgtcactttaaattgccaagctctcaactgtcacagctgatctgttcctggagcaaagggagcagaaaggtgacagtgggtgtcccctccccctggccttgtccaggagatgaggctcacaaggacagcagtcggctctgcctggtcagctttgtgagtgttgctctgagcatgcccagtgatctgt

SEQ ID NO: 104724 - DNA, 1054 bp, Homo sapiens
actgtggctggcccgatgctgggtttttggtgggaggtgaattagcctccccccttgataatgcttccctccatccctgcagcccctcacctggacagcccccagccaccctccctcccacctactcttgctgattccgttctgagctttgctggtggaaagtggccctgcatagatgccctgtccctgctctgggcctttcgaagcctgtgggccccagcggtcaaaagctctttgctgtgtggagacagtttgacttccttataatccaaggagagggaggagggaggcggggagagtgcacagaggtgattcagacacaaatccctgccctccaaggctccagatctggtgggaggctggggcctgggtgtagctgaggggtttccacatcggcttccccctcctgcagagcgctcccccggcccccagctgcatctcaacacctgagggcagggatttgatcatctctgcttcacagctgattacccttgcacatgatggcacccaggaaatatttgttgggtaaatgactgaatgaatgcaagctatggcatatacagacacatgctctcaccctaccctctggctgtgtctttgtcttctctttggggtgcaacagacatgatgagcaggggcaccctctctaggaactctgttcacaactagctcagggctttttctccattcagggtctatagatttattcaaggtcccaacaataattttttaaatgtgtggattctttaagagttgtaagttattttgaagtgatttcaatcttaaagaagagttacaacaataatacaaaacaaaattctcccgtgtaccattcacccagactcatcactaataacattccaccaaattttgctttctcttaaaaaccgatttttcccttagaagcatttgagatgtcactgcaaacatgccatatgtaactttcacccctaaatactgctccagtacataattactaagaacaaggacattctcttacataaccatggtccattagtcaaattcaggaagtttaacatggacatgatactag

SEQ ID NO: 104725 - DNA, 1045 bp, Homo sapiens
agtttttatctggaggagttccccaaaggcttcctggaggaggtggcagatgagctagattttaggagcaatggaggaggtagcctggcaaatggcaactgagggagcaggggcctagggtcgggttcaggactcatacacagtggagctgacctggctgtgctaggttcttggaagtcctggctgaactcagagaactggttcttgggccatgccgggggtgcaggcaagtaagcctgcatgtgggtgaaaggtagccccagcagcaaggctgtaaggaaaagagggaatgagcacttagtgtacacctaccgtgtgccacaccccctccatatgttgcctcattctggccactccgcagcctctggtggtgcctcatgcccactttgcagaggatgagccacaggttctgatcaggtgctggaacaaaccacccttcttaagtgagtcccccacgaacttagaatttgagactcactcattggccaggctcaatggcctctgttctgctatcaagaggctgctgggatgttacccatggcagggatagatggggaagtcaccatattcaaaacaatcatgtgttgaaacacctccccagcttctgatctaccggtagtggcagcggaagcaaatacagcaaatctgaaacccgatgcctacagaacaggggtgtgaaatgtgacgccagaggcccccacacagaagtgggtgtggacagccacctgcctgtgagcaaccaggggaagctagcttggtgccgagtttacacagtgaatgttaaaaagacttcgaagctggccccagtgtattcgcacacagttgagaaaggccagggaggataacaagggctagaatatagggtcagctccctacagttgctgtaaccccctgggcagctccctttacttctctgagcttcagtgacctcctctgtaagtgaggataacatttcccagagtgaggattaaataacattatgcatggacctgcccatagacaatgacctagcaatggctcagtgagtgtcagtgatgattatccc

SEQ ID NO: 104726 - DNA, 1082 bp, Homo sapiens
tctctgggcactcacctctgggcccctggcagacaaaggccttgctctgggtacagggcagtgccctgataaatccacagcccctctcaggtcaggcaggaagatcacttttgcatctggcattatattgaaaaagaaagatcgttttgtgccttgagagccaatggggcgtttgagcctcttcgtgggccagggcagctcacttggaacacatggggcccagggtgctggttgataaggagtggggtggccttggctgccctggccctgcccccctctgccttcccaccgtggctgcatctgggcaggagggccgtgaacagctcagctggcagccagcctttgagagcttccagggagcttcctggacaattagccatctgatgcccctctgcaggagggccagtgggcgttcctcttgggacagagtgctcaccacctcccagcctgggccatgcctaggcagctctgacgcgaggacatttgttcccacttggaactggcaccatccttcctgcggtgctcgctgccacccacccacacactgaagtggcctggccctgtcctctgagcctcacaacccatctgctccccagctctggacagcctgcagagaccaggactccctgaggctgaggaaggggtcaccagcctcctccccacccacgccttctggacacaccctggctcgtgctgtctatctccgggaagagcccagagctgagtttgggatgggcaggaggtcctgggcagagcagagcagagccgccacttctctggctctgggcactgcctggagcacacataaattcccttatggctgctttcccctttcacccgtgggcctcaccattgcctcagccctgccagcctcacctccctctcctcggttcccatctctgctagtgactgccgccccctctccctgcatcgagtcttcgttcaggggatgaagacctactctgtgcctgacactgtgccaggtgctaactatccattcccacatccagccagctagcgcccaccctgtgaggagcactgtcccacagcacagaggaggacctgagtccaaggctttgcgt

SEQ ID NO: 104727 - DNA, 1054 bp, Homo sapiens
ccccccttgacctggacggcaagacccagggagtcaggatacaggggctaaagaattgaggcctctcagcacaacaaaatggagattgaagggagcagctttcttctttgtctaaggaagggggtagtgaataggcacagcctgcaacaaaaaggatttaggttagacattgagaaagacttccaagccagccgaggagagccgtgttatgtagcggttatgaagcatgtctcagaacaaagctgcttcagttcaattccccaccctgccatgttctatctgtattaaccctgggcgtgtctgtggacctctctctgccttcctttctttatcctatagatcagatagtaatagcacctacctcatgggatgagcctaagcattaaatgaattagtcacacatagagcagtggctacaggaaccattcagtagcccttaggtatcaccgttcttgttgtgttgatggagagctgtgtcaccctggaagttttaaagacggccatagccagaaactttcaaggctagaggcttagaagggcagttgctatatattcgtgatcttctatatagctttacacagtacagtcacacagcgttagctccttccatttgtttcatcttcacaacccctggagatagatcctatttttctccccatgttgtggatgaagaaactgaggtaggccagaaggtgtgaggaacggcttgtgaggatcccttggccagcgcaggtctcagaatcaggacttctgatccggagtcccagatctgcggcttccttactgtgtgacctcagggcaagtcgcctccacctctgagactccattctccatctccaacactgaagaatgaggccagagcctccggtgcctatgttgtctgatttccttgcatagaagatctgagcacaaaccctgatggtcaaacccagtaccatctgccctccccatggctgaaaggaaacgtgtcagaaccctcagaagggacaacccatggggactggctgtcactttgactgattgctaatgtgagtccttccatctggggtgtcat

SEQ ID NO: 104728 - DNA, 1062 bp, Homo sapiens
gagacccctgactaatatgccgtgtgaagacacagggagaacacagccacatacaagccaagaagagaggcctcaggagaaatgcgcctcgctctgacttccagcctccagaactgtgaggaaactcatttctgttgtttaagcctcttggtctgtggtgttttgttacggaagcctctgcaaatcaatacagggcctctctgtcttgatctgtgaagtgggtacgaggacctgtcctcgggctcgtcaggagacgctgtctgggcgtgtattctgtgccctcagaagagcttatgtgcctggtgtttggtggtcagggctgggattagggtgagacaagtgaggtgttcacctcgagcacagaatttaaggggtgccaaaaactcaataatcaagtaaacaaaatattgaattttaaaataaacacaggctgttgtttgtcttgcaacaccacgtgagtattgtaaagcgagaggtcatttccaaaggcactgcagtttccaggccccgaggccctcgtgtgccctgcagagctgctttatgagggttgacggggacatgtgaacagatcgaccaatgtggggctttatatataatgttttaaaaaatatttttaaggcctgtaatcccagcactttgggaggccgaggcaggcggatcacgaggtcaggagattgagaccatcctggctaacacggtgaaaccccgtctctattaaaaatacaaaaaaattagctgggtgtggtggcgggcgcctgtagtcccagctactcgggaggctgaggcaggagaatggcgtgaacctgcgaggtggagcttgcagtgagccaagattgcgccactgcactccagcctgggcgacagagcgagactccatctcaaaaaaaaaaaaaaaatgtttaaagctttattagttttttctacttggttcaaaatatggggggctattttggtgttttaggggtgcacacttgtccttccgtgtcaggatccaacctggctccgtgcagtgcagttgctggccctgggctggcccatccgcatcctgcaggttcggcctgc

SEQ ID NO: 104729 - DNA, 1031 bp, Homo sapiens
gggagcttccactcatggtggaaggtgaaggaagagaaagggcaggggaggagaggggagcaggagagagagaggagggtcacacacctctaaatgaccggatcttgccagaactcactatcaggaagacagcatcaagcatgagggatccacccgtatgacccaaacaccacccagcaggccccacctccagcattggggatgacatttcaacatgagatttgggtggggacaaatatcacagcctctgggggcaggtgcagtttctttaagcagttttggacccggggagtggcagagcttggatatgagctcaggttacctgatcgagggctctgtctatccacacactcaccacccagattggctggtatttgtatttcaccttatttccttcatctctcttcttttaagaaagaaaaagaagaagaaaaaagagtggtgggagaatgggagggaggaggggggcctcggctgctcatagcttccccaccctcccccaggtggaccgtccttatgtcacagcctccaccttcaccatgcagcattgcgcatgccagtccctcggtaatgcctgtacaccaccccgcgattccccagtgagagtcattctgcccacgctctggccatccccttccatgttggtggttggaggccactggagctgcctctgggagctgtttggacgcatgcatccatggccaggccccaggacgcattgaccatgtgatgcctgaacttgtagaggccacactgtctctgactgatgtcctgtccactgtttaccgcatttgccttcaagacgtttcactcgggggccatgacctgcaggtccccctaccccatctccagcagaggggctgtgtgatccacaggcttctgttttatttgtgagatttacacacattctctcagatgatgcttatctggttgcgacttaccctttttgattcactgatgtgtttttaagttttgtccatgctaagcagacccaaatggcaaacacacaggagcaatgaggttgctgctgg

SEQ ID NO: 104730 - DNA, 1021 bp, Homo sapiens
agcgccacactgcactgccagctctggcgggctggttcccgcacctccagcactgcccaagccctgtcctgccaccaccgcctgctccgggacagaccgtgaaggagggaatgcctactcattagatgactgtgatttaagcaacaaggcagagaaaatgacctgggagcaatgacagagagcagctggagggcctcacctggtggaggtgggggtgggaggtcagggaaggtttctctgtgaaggtgatgattaaaaggacacctgagggtacgtagacagccacaaaaagagctgagaaggcacattccaggcaaagggactagcaggagcaaaggcccctagctgggggtttgcttggcatgtttaaggatgtggaagacagatgatgttataaggattcagtaggcaagggtgaggggtggcagaaaccatgctgtagagttacccaggggcagtggggagctgcgcactgctgcaggcagaagggtggtgctgtctgaattttgcgttaaaaggtccctctggctgctgtgtggactggagaaggaggatggagatcccttaggaggcctccctgatgccctggccaaacatgacggtggccaggccaggatggtggcacggaggtggtgagggcgggtggatatggatcggggacctaccctcaccataatgctgaacgactgctggcaggtgctgtgtggggctgaaggcagccactgggaggagggcatggcccatgactgagccaggacagtctgggggggatccaggagctcccatgggacgtttgcccaagagcatcgctggtcttgggtctgatgggcggggcccccgagccaagtacaccacgaataatgacagtcccgccagtgccctttcttgagctcttaacatgtggcagccttgcctagccaccacagcatggatgtctcttcaatttgcactttgcaatccagtgtgtgtggaagggggcagtgccattaacatccccacatcacggatgaacagctactct

SEQ ID NO: 104731 - DNA, 1063 bp, Homo sapiens
tccatcctggcccaggaggatgagggcagcccccctgggatgacagggccatgagggagaagagctccctggccctgccccaccaggccagccctggaccatctgctttcacactgaaatgccagagacacaaatttctatttaccactctcaggtggggctctttgtctcagcagctgagccctgtcttacgcagtacagcagtcttggagggcactttcccacgtacttgcctggggtcaggctgtgccagggaccacaactgtgtgattttcagccctcccgccgtgggtgagagccacactcagctcccacccactgtcctctccaggtgcttgtgaggagatcgaatgcatgaaggtggagactcccactaaaaacatcaggagccaatatcttccagggcaccccttgttcctcctcctgaactcctgctgccccgactcttccccatgcaggcgcttgtttggaaatgtggtgtgctgtctccttcctggctggtgtctgcagattctaataaataacttgggaacaggccacctcacgcatggtccaacctgcttattgctagaaagatgggtttggaactgacaagttccctgctaagctgacaagtttaaaaacttaattcgaaaaaccaaccacattccctttgcagaatgaaggcaaagatcaggacatggtcaagcctcagcctgaacgctcactgtgaggagacagatttaggacttcccaggtgtctgatcttgtccgtataatttcttagatgccttccagcctatgcagcctgcagttttggagaaaaggaactctaatatgtattaaaatattaaacttcttgaccctgttgggaaaaagtgcatagtccatttgttcctcatttttcactcgtgtctctaaagtgtctcatcattcagggctggtctagaggttgtgtattaagagaaaatttgaggtgtaatagggcactgcaggtcggattcttctccctcctcccactctccctctagaaccagggtctggcaggaccgttcccgggagcctagggactgtttgtcaccct

SEQ ID NO: 104732 - DNA, 1094 bp, Homo sapiens
ctacaggcgcacaccaccacgcttggctaatttttgtatttttagtagagacagggttttgtcatgatgcccaggctgaacttgaactcctgggctcaagtgatctgcctgtctcggactcctaaagtgctgggattaccacgcccagccctgaccttagaagcatattgcatgaggtggtcccatgtaggtcgcctccccgtcaggactctgaacgttgactggcattttccaaaggcaacagcaaggctcagggctgggacaatgaggagagcccaaggactgttttgtttggggatggtgggggagattctggagacggtgggcctggttaccagcattgactcagctggaaccaagatgtgtgagtaaacgtaattagtccaaacaaatccagttttctgtctccataccaaggcaaagcagcctttgtaattaactgggcctttttccccaaacccaaaatgagaacacacagtttattttgttcacaaggaggtatgaaaactgctgaacgtggcagacaaagctgggagtgtttgctgtgccaggtagacagagctgaactctttctctccaggaaggaatgggagcaggctccaaatgtgagagacgggctggggctgggccgggtccctctgccgctatccagccatgttttggaggtgctggactgagggctgagccggcggcctctggaggcgagtggacatttcttagcacggtggaatcaaaagagtacagacactgggggcagataatcttgaattcaaatcctttctctttgtcttaccctcatgtcactatgcaacagcccctgagctctccaagcctcagatttcacactcatttaacagtcttcattgagcacctactgtgtctttgtgctaactactaagggtgtgaagaccaatgagatacagttaatttctgccccatgatgaaatcggagcaaagactttagcctcaaggccatggaccaattaaatgaggcatagatggaacagcacatgccatgtcatagcattcagttaacatccatttcctttcttctccctctgccacagtctgtggagacgcggctgctcagaatc

SEQ ID NO: 104733 - DNA, 1007 bp, Homo sapiens
tgcgtgcccttaacagcgctgggccttttccgcccaggaatcccgggcgatctccccgaagctccggaaggctgagcgcctccgtccccattgcagagatggggcagctgaggcgcagcgtgagccgctctcgctagcggtgggcggccccggcctccatcttctaggctgggagccaaggttaagagcagctcctgccttgctggaccgtgggagggggaagtgcgacagtgctctgaagaggcttggcgaacctcggccgatgtggggcggtgctctgtcgtacaggtgtgactcttctccgtttctccgtctctcttggctgggatcatcgggggagtcagtgggcaccagcgctcatttgaatccacccccgtcctggcgctggcgcccgcgctgctcactgaggttttcctcgatgacagtcgcacgtggaggcggcgggcgggtgtgaggctgcacgcggggccccagctctccgcagctctccgcagctctccctgggcttggcgtcttccctgcccggtggagagttacccctgcggcccatgaaggtgtagagtgcctgcgtcctcccttctgaaggccggacagccccaccctggagggggttcacagatgggcggggggaaggggagctggggacattctgagcccagttctacctttggctcacttggagacaggccaggggcctagggcaggaaagccgagtcccagcctgggacggggtctgccaggccccacatacccctgcccaagcctccgtctgttcactggcacgctcagggccccgcacgtgttaggtgctcagtaaatgtgaggaaccatgagaggaagcagggagggaaggatgaattcttggacatggggccatgtgactcagtctggctgatgggcaggggctgtcagtctcttccaccagtggttatctgcccatcatttgccagcacagggctccctgacttgctttgagacccaccacgtcctctctgtgcgcgtgtgac

SEQ ID NO: 104734 - DNA, 1151 bp, Homo sapiens
cccccgtcatcacaggtgtgaaagcagaggctggatcctcatttcttcaggctgtgcttacactgttctcctgccctgtgtcttgtccacacagactgcgagctccatgagggtggagatcactcagtcatccgacacacctttactgcacacctactgtgtgtcaggcactgctagccagaggatgcatcagggaacagcatacaaggtctctaccttctagcagactcttgtctctctcaagtgatagtacaggatgatctttccagagggaggcatctggggtctgtgctgctgtgtttatagagtcacagcctcctcgcctcccactcggcctcccggagtcattgactggccatgttcctttcagtccacagtgggccgtgccctccatgtggatggcgtttgtttacaaggcctcagggcctgcctccttccccttctcccctaggagtgtccccatcagggtgggcacagggagaaacacatgactcctgaggctgcctgaagcccactcagctctgtggagttcggcccccgagacactctccttcttaggaaaactcagagcggaggagccccggctgttagtggactccagtggctgtggcatgtgtctgcctgcagtttccacgggcctggctttatctgcgtagattgggataatctagagtagttgctggagctcctggggttaagccgcatggacacgcatcaaccccctccttctgagcactacaggcaattatcccaggggaggggcgggtggcctggcagctggtgcctctgcagtggaggtggcagtgggggcttggagattgcggttcccttccctgggcagcccagggaggtgcaacccctgccagctgcgtgaaacattctcctgcaatgagtgtgcggggctagatgagaagccgaactggagccctgggagggcacccgaggataagggcacgacctaccctgtcccgggcacttggcgttcattctacctcactgggtccccccagcctgggggataccacagccaggccacacagcccaagccacataagtggcatttgatgaagccaggattaaaatcctggtgcgtttgtgtccgaggttgatgttcattcaccaggctgggctgcctccccactaactccctg

SEQ ID NO: 104735 - DNA, 1004 bp, Homo sapiens
ctctacccgtctttgagggcatcatcccctgcacatggtgtctggatgtttaggaatcactaagagaagcagactttggctgtgagggctgagacagagatttggtttggaagccccgggcctggtctgctctggggctcggaggatacttgttctgtgagctccacagcagatcctgcctgaaggtccctggcccttctcaacaggagacgtttgagaaacgggctctcctctcagcccagctgctccccagctatatggcatcagccactgtggaggggctctgagcttatgtgggaattgctgatcataccggcctctctgcccagcccgtgccaggggtggagtgcagtggccatgtcggccttctctgggccccatcaacacatccatgtgtcatccatgctgagaagatttggtaatgccctggtgttttattatctgtgcaactttgcctccctcggccccaggaccaaagaggcgtttatcaagcctctcaaatgtgcagagagctctgtctggctaattgcaattgtgaagctgttcagacttaacatggattttaaacgaaactcttgcagttcttgttctttgcttttctgagggagcctgaggctgcccttcatgatgtctggcatggccagagcctgaaggtgggcgccaaagctccgtgtgctcctggagcaggtactttggttgtaggctgatgatctgtgctaatctagttggcgtgtcctctcgatttcatcaggcagccgtgtggatttctctgtcctctgggcaaggcctctggtcagccattctgagccttggccgctggtttatttggaaaccttttccatcccactggcggaggcttggtttgattttcctccatgctcctgtcttgtgtactgcaggagcctggcacaggggaggggttggtggtaaagagtcaccttctcttcccttgccagatggtgcacaaggagctgcatccccaccacctgcctctcgcctctgca

SEQ ID NO: 104736 - DNA, 1616 bp, Homo sapiens
agccttctagaaccacagttctcaacctgtctgacaaaagacccctttttgttatttcccatccatcacgatcgacaccttggtaagtggatgccagggtgctgaggggctggagctgagtctgggcactgcctcttgctttctgagtttaccctgctgtgggcctgtgccatgggggaccagccagtccccaggctgcccctcagagagcagttcctcagcagccctaaaggaagcagagggtctggggccccacacacgtcgccctttgtgggtcctgagctcattggcacatcgagcactctgaggagtccggtggggaagaaacgtgatcagtttcccaagcctgtttgacctgggagtgctttcaatggcctctaccaccgagcttggcccccagcgtctgctgcgagaggccattctctggttggtgaggatgtggagaaataagaacctctgtggctccattgctggggggaggtaacgtggtgcagccgccgtgggaaacggtgtggtggttcccgaaggagttaaacatacaatacaattcccatatgatccggcaatcccacttctcagtgtagacccaaaagaattgaaagcaaggcctcaaacagatgtgtgcacacccatgttcacaacagcattactcacaatagccaaaggtggaagcaaagaaagtgtccgtgacagatgaacgtggtctgtccctacaatggaatatgattcaccctaaaaaggaagggcgttctgtgctgcgctgcaacagggatgaacctggacgacaggatgctagtgaatgagccggccacaaaaggacaaatactgcatgattccacttctgtgaggtccctggagtagtcacattcacggagacagaaagtggaatggaggtgccaggggctgggggaggggggctgggggttcgtgtttcatggggcagagtttcagttggggaagatgagaaagtcttaatgccactgaagtgtgcgcttaaaatggatgaggtggtaaatgtgtgttatgtatcctttaccataatgaaaaggaaaggggacactcctctgggggttgcagggctgtaggctggggtgtttctcctccctcctgcccctctgctccgcggctaccatctccaggcgggcctggtcatggttgaggaaactggctcattttcggagcacactaaatttccagatcaggccctggagtcctttatgaatctagtttgggaggctggctttccagatcgctgactgcaggggagttcccggttttgtggcagatgccaatgccggaggcagctccctgccgaggaggcccggcctctgtgatacagtcatggagccacacgctgccccattggagggatggaagccccacttgggcaggagacggagagccgccgtgggctccaggcgtctgttcctggggccctgggagacctgcagtgtctgagcttgttaggcccctgggtttgccttgggagggcctccttggccaggcggcctggggtgggcgggcaggggcttggccgcaggcagttggggtgggagtccacaggtgggggccctctacttggccttgcctggaaggcccttcctgtgccccctgag

SEQ ID NO: 104737 - DNA, 1067 bp, Homo sapiens
gttccgtctgtgaaaatgtgtttcacagctgcttcctacggcctcagaggctctgggaggttagcgtgtgagagagaggggtccaggggccagtgggtccccctcccggggctatccccctctgggatgagcccagctggcaaggacctgccagccctgtttctgaaacacggaagcccgggaactgggctagaatgtgctggggttggtctgtcctgaaaccagcagatgcatcctcatttgtcatgaacggtggggacattcgggactcatcctgacacctctcctattcagaagaggaagacaaaccaccaagcactcattggcctggaaaccagtccccgagggagaggctgtgacttcaagggctgggcaaggtggctttgggtgaagcgtctaagctgaagctgccagcatcctggttaaaggacgtcacagcggacacacctgctcccaggcgtagaaaatggagaaggaaaattgctccagggcagcctgtggtctggtggacagagcccagctcaggtagaacagcaggggatttccaggtcgtccttcgaaagcttccaacttgacatattttgttaaaagctgctttcgcctgcttgtgtctggcctgtttgcataacaaggtcccggaattcagcattttccaaactcagatgtttttagggtcatgaactaaaatatttcattatcagttcaatcgtgggaattctgggtttctttactgcgggacttctcagagcctgcagtgggcccgtggacatgaggcgttgacaaggtgaaattggactgtgcggcacattctggtgtcttcagaccatcaagtgcctggtttggagacgtgatcacacggtgggcccacctgtgcactgccaaacagaaactgggacatgctgctgaagttgatcacttaggagaaggaagaagacttctgtttttttccaagaactacgttaacaaatgactgtagtccagtgtggagggcgccccttggatctggtactccaaatcaatgaacgtgaagtccacccatatccaaagtgtgtcggatttatcatctc

SEQ ID NO: 104738 - DNA, 1061 bp, Homo sapiens
tgcagcctcgatttcctgcgctcaagtgatcctcccacctcagcctcctgagtggctgggactacaggcacataccaccatgtccggctaatttttttaaaataattttctagagatgggatctcactatgttgcccaggctggtctggaactcctaggctccagtgatcctcccatctcggccttccaaagtgggaggattacaagtgtgagccatcacacctggccctgagttctagattttttaaaaggttttttgttgttgttgttgctgtttgttaatagtctttacttttagagcactttaggtttacagaaaaattgagcagtaagtacagtgagttcccatgctcctgccgtccctgttccctccattattatcttgcattagtgtggcacatctgccgcaatggatgaacccactttgacacatcattattacccatagttcatggttcaccacgggcttgttctgccattgtggcatcacacagagcagtgtttctgcccccgccccccgcaaaatcctctgtgctctgcctgttcatccctctctccctccaggtcaccttctttcacttagtcatatgcattgaagcttcctccatggctttttatggttgatagcacatttctttttagcactgaataatattccattgtctggatgtagcacagtttatccattcacctgctgagggacatcttggttgtgtctaagttttgacagtcatgaatgaagctgctataaacacccatgtgtaggtttttgtgtggacatacattttcagctcccttaagtaaacagcaaggagtgtgattgctgggccgtgtggcaggggcgtatgtagttttgtaagaagctgccaaactgtcttccaaagtggctgtgccgtttttaattcctgggcttctagattttggacccctttaaggggctccgggttcagaggatttcacaggctgtagtgccccaccccatttctcagaccagctgcagggtgcggagccctacccaaactgagtggtctcaagtgagctcaaacgaggaagatgtcccg

SEQ ID NO: 104739 - DNA, 1032 bp, Homo sapiens
ggttgcaactttccttccctccaccctcttcccttcctcctccacgctttcacctctcttttctgtctccctcactctcttttctcatcctccttccccctcttcctccagccctgcaaggcactgtcctccaggcgtggtgagccaaggctgcttcctgagatccagctcctggttttgcctctggcaggcacaacttttgctagaacaatgtgattccttgcagaagtctgcctgccagcacgactgttctaattagtcatattttgaaagcagatctgcttaattgcaagcagaactaaatattggtatataaataaagtcattaataactgtatatggtagaaacttctcccgctgagcgccacaacaagcaagccccgttgaccttttcttgggtggcattggctgcatggcttgcatccccttgtggcatctgtggatgaccagaggtggaagcaggtggaggtaagcattggaggctcccacgggagggcaggaagaaaggaggtttgtgggagaccccatggacccaaggagatggttgtggagctgctggttttgaatggcaacgaacagcctagtgggtcttctgcaatcatcaagttaatgaacacttagtgaaaacagttatggcttaaacactgcatccatcagcccgcctcgaaggccttggggagtcggctgtatttccctgattcggaggttgggcttctggaaatgaggacgtggccggcgatgacagtgctatctcacccgccactgttttgatggggtgcaggggagaatatggcactgggcttagtgcaggccagcagtcagttcccctgacgctgctcacaggcttggtgacctcgggctgtgccttggtttctgcacttagagaatacagatgataacatctgtgcagtgcattgtgggcttcttcattcattagaacacccatcaactatttacagagcacttcctcttgtccaggtcctgctccagtggaaactgtcccgtcccagggcctgcatggcagagggtggt

SEQ ID NO: 104740 - DNA, 1053 bp, Homo sapiens
ggtaccagggtgagggaggcttcaggagatgctgcagagctgggtgctgggatcctgggcagaggctgctgggatgggcaggagcacgtgggctggggctgaaggcacacggccccaccctctcttttcccccaacaatcgccagttcagatgggaaggagagagaggagtggaaccaaaggagtggctccagatgggaggggccgtgcccatcttggctgcctgcagcagttcttggaatggggagttcttgaaacggggagttcttgaaacagggagtgaggtggttggcgacacccctggactctgcctctggcttcccacacccaggccactcccctctttcaccttgagggaggagcagcccaagcagagatgttcacttcccttgggctggccaggacttctagatggcttgggtgaggctcccggtggagtatttgggcagcacggtggccaggagccaggacacagactctggggccaggccagcagcctgaatcccagctccctccacatgcaccacctgtctttgtcttctctggcctgtggctgagcctctctgtgcttcagcttcctcacctgtaaaatggggttataaaacctccctgctagaggagtggcaaggattacatccttgatgtatgtaactgtgcacagagccacttgtatcattattgtttcttctttctctgttgagaaggaaagtgattttagaaagtcatggaatttagaatcaggtgacttgggtttcagcacatgtctcttatctacccacttctctgcatagttaatgctgctgattttgaatccaaccctttgtacgatgtgttatctcaatccctttaacgctgcagcctcttcacatgttttaaagttgtggagtcttaattttattaaattgaattagggcctccccgacaaaaaaggaggagcctggaaagttccatccccctcccacagcccatgacatgctcacatctctgtctttactttctgtgaggctttactcttacccagctcagcagttgccggacatcgagatgtgtaaaa

SEQ ID NO: 104741 - DNA, 1002 bp, Homo sapiens
cctagcttgaatcctgattttgaagtgttcagctttccctcttggatgaggcgagatccacaaaggaacgggttagagactgtcgttctgcacctgaacttagaatgtgttgattgtagtgaggccacagcaataaccgagcccgttctaggtgctgcctgctgggcacattcttctccatgtctctgttgatgctctaaccctgtgacaagtgtgaactgtcctcatcccatttcgcatatatgaaacctgaggctcaaagaagttaagtggtttgcccacagtcacccagtggcagcggcgggattcacacccaggtctgtctgcctccagggctggtgcagttcaccaccacgctgggctgcttcagaactgttcattgcattgtgtagatgttttggaaacattgggggccgtttccaaatgtggcatggtcccttccccagatttttggcttcaggagccagaatgaatgtagctttgtcacccacctggagacagcccaagttccttctctgcaaagcagctgacagtggttgcacccagctggcagggctgctatgggcagtgggtgccagtgtgcttggggagggccctctaagccatgcagcacacccagcagccagtgccgggtgttcctctctgagttggtctgacctccccactccgctgagatgaacacttgctgagctcccagaaagttgctgttcacgtcttcattcatgcaggacacacttgggacatgtggtcgcaggggagggttgggatgggggcccctcttctggctttgccccagcttttgctggaagcacctgtggtggtttagctgtcctttgctctgcataccacttgcatgaagagcgtcacacccgtggagaaccaaggggcctgagcccgccccctccgtgggaaccgcaggagcacagcttgccaagggcagaagacagggcctgcccagagggtgtcctgggaccggtagggcaggagggtccttgcaagtca

SEQ ID NO: 104742 - DNA, 1377 bp, Homo sapiens
ggatgcctgtggttactttgattatttggctatgcttttaccctgacatcagaattcatatccaatgtctggttggctacatgctagtgatctgtttctagaattgctctctgctcactagaggttcagacgcataataggcactcagtaaagatttgttgagtggatgaagccagagggattgattcaggccattgcattttcctttagaaagtcagttgaacttcagcaggcccagctgggattgaaaatcacccagacccaaatcccagggagcaggggtggggccgatggctgcatccaccgggggcttcctgtgtgcctgccctgcttacggtctatgccttggtcaggtcatctccttgtctcatcactcctacgaggcaggtgcagctgctgctcccattttatagatgtggaacctgaggctcagaaatcatggccttgcccaagctctcccatctggctacggggtggagccaggatttgtactcagatggtctggcttggcctccctgctcttccctgtccccccccaccctgcccctcaccaagacggagtcttgctctgtcatccagagctggagtgcaatgatgtgatctcggctcactgaaagttccgcctcccaggttcaagcaattctcctgcctcagcctcctgagtagctgggattacaggcgtgcaccaccacgcctggctaatttttgtatttttggtagagacggggtttcaccatgttggtcaggctgctctgaaactcctgacctcaggtgatccacctgccttggcctcccaaagtgctgggattacaggcgtgagccaccacacccagcctccccccagctcctatccacccaccacctgcccttcatgctgtcgaatggccagaccatctcccaggatcccagtgactcctggcctctcaagctggagaaagcccagatgggaggtttccaccctgccgtgtgcaatcttgtcaccaaggcagggctcacggtgtcacgtggggtggcagtgtagagggggcaaggatttaatgagatgattccttccagcctttgatcttccaaagttccttggcaaaaggaaacatcgcctaaggaggctgggggtgggggggggaagcccagtggagtggcctgcctcgctttctggtcccctccagcccttaagtgctgtcatatcactgggagaggacgtttttctgaagctctgagttggtgactcactccgggggaggttttcagtggcattcagactctgttgatttaccaaaccagtattcttgccgggttcatggtgacattaaccgtacggcggcacgtcagttcagaggcaagctcaggggtggccactgatgagggggcagcagcgga

SEQ ID NO: 104743 - DNA, 1381 bp, Homo sapiens
cctgctttcatgggaagcagtgacacgttggtcagcacatgcctcacaacaccaccctggggaatggcttcctttttcccttcagcgtcacccctggtgaccacgcaggggacaggaggatgctgagagggagcacgtcgtccttccgtggggcatccccctgggttgcatccaggcagccgccttggccgggaagccgggatgggaaggctgggattttgtttcagaagtccctggttctgtgtccacctggcttccccttagtggagacacagccaaggcctgtgagggagagcattgcctttagggaaagcagagtggcagcacagtcctcagcccacggtctaggtcaagcacagcttccaaacttgaatgtgtacaccaggagtctgggaatcttgctacaatgcagatgctgagccagtgggtctggggtgggctggagtctgcatctctagccagctcctaggacacccgctgctgctgggcccggaccccagggtgagcagtgaggctgtggggagtcttggtgtgagcaggagctgtgggtgggttcccttcaagatggagcagccggacccatttttgtgcatctgattcactccctagtcttttgggaaggagaatgctggagtctcctcccctcacaggagactcacagggacgggggcatcacatggcctgctcacatgcgtggggttctgggcccccccggggctgctcagcaaaccatggattggatgtatcccactgcccatctgcagagcaaggtgatttatgcctaaggaacatgggataaccaatccccttgaggacttttattaagcacctgctgtatgcagactcattatcaatgtgcttggaaacataagaggaagaatggagaggaagagaataagcaactctgtgtagagagagcaacatgagtggacaaactagggtcctaggcccagccctgcacttcccagccggtgaccatgggacaagtcatactacccctcgtagcctcaggttttctgaaatgcacgcaaagcaggaatgatcatagctgcctcccatacttttttgagaattaagcaaagatgggcatggaggaaactggtatacagtaagtgcttaatgcaggtcagattcttccattgtccacctgtttgtcatttcttttgggccaactgagcacaggcagggggtgagacctttggagccaggggcaggaggcatggagagggaaatggggtaccgtgagaagggctgcccagaggctaggtgggggttgagcatgggtttcccaaggtgacagggccatgcaaggccacagcatcaggattgacttcctgctgaggactctgctcccctttccccctacctgcacacagaggcc

SEQ ID NO: 104744 - DNA, 1068 bp, Homo sapiens
ctggtgaccctgcacagctccagggagcacctcactgtgtgaatgtagtttctctctcaaacaatgcagtgcccagcctgtactgctgtacgtgaaggccctttaatgtctcctgattcccatttgagggttctctcccctacacaaagagtcctcgagctcgtgtctgctgacatgggggcccatggaccggcttcaggggggtccctgaatttttttgaaagaagacccagttgtgtgggtagaagcactttcctgggtaaggagagcccacacgcccttgtcttctgcctgacgacttctctacctgcaaagcggcacccaggggaggccacgggtgctcggcctcctcgcggctctgctgccttctgcagctgctctggcagcaggtgcctgccctttctagctgcctctctcagcgtgctcctccctgggttttgggagccacacctggatctctgcaaggtctccggagcactgcagaatcgctgctcccctcggggtctttgttcctgtggcgctcttgcccgaggctgcattgcattcagatgcacggggcctccctgcctcatgccccctggacagatgctgctgtggtcctgaaacttgagacacgttctccccggaaggctctgcgctcctgggtgttagggtggcatcccaggcctctctgtgtgaatgaggccagctcagcaggtgcccgtggacttccctctgctggccggggaggcctcggggcatcactgtgagagtgtcctgggtgaggcaggcgcctgctgaatgctggctgtaactgaagagtgcgccgctttccctggctctgctgctaacatcgtctctcttcccaccctagatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggcc

SEQ ID NO: 104745 - DNA, 1369 bp, Homo sapiens
tgctggaagacatgcaggggcaggtggcatttgcagcccagccagcctgtgcaggcctggtggaatttggtgtggtggccatcgggcctggcccacaccctctcgtctctcccctctctaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggtaattgcgaggatttgaaagtgaaagggacttggagacagtctctgtcttctgggcatcttgcggcttccacgtgcccagctcaccatggccgtctgtccagagggcagagattgtcaggagcccagcctggggattgacgccagggggacttgggaggactgctggtcacagagggtatcctagcttggccaaggcctttataggggattcccaggaggactcctggaggaggtgacttctcacctgggctttggaggatgcataggaatcccctggttagagaagcagggagaagaaatgacatcagtgcacgggcaggagaggggacaagacaatacacccttgtcttcgcaggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgagtggcatctgcatgcctcaggccaggccggagtcaggggcatcaggaaggccctggaggaagagggaatgtggtgtggatgtcctgggccagctctctttaaaatttatttttacaattagaatttttaaattgaagtactcttttctttttccatagcactgttgctgtctctcaggctgcgtgattgtattaattgttctgaccgctgctggtcttccccagctacaagttaagcttgtgggggcagcagtgagaaccccagaaaaggtgccagtgagcgtgtggtgcgtggcatcgcagaattcagtgcaggagcatctgccacagagcagggaggaaagccctaatccctgctgggacaagtcccctctctccaggcctcacttcccccatgactaagtcacggggtgggattggtgggtgaatgatccctcaggcccagagcctggcaggctgggaagagttcgggggtgagagaaccaaggag

SEQ ID NO: 104746 - DNA, 1052 bp, Homo sapiens
agggacttgcccagggttgcccagcaagccagtggggaaatggtactgggcaccagcccctgtgactctaggcccaagcccaggtgggccttggacacacaggacccaagtggagggtggcttgaaaggtcgctccctgcctgattcagggacagtggggatggaggcctggaaagagaccaaagcccagggataggatttcctaaaggctgcctgaagcttgtctagtgtgggacgaatgccccccgaccccacccagtgggaacagagtcctgtccctggtgcccgggggctcccccagattgctcccatggaacacaaacagtgagacttattagcagatatccccaaacagaatagtctgcagggacacactgcaaaacccagcatcgctctgggtgacctagaagcactgaagtctgagggacatcctgtcatgaaggcccctggcttacgtgggtgggcccagtgttttccaaatgcatctgtgcatgttgtgcgatgcaggcagggcaggacccgggcacccatgctggggaagccgggtctgcacagctctggggttagcagacccaacccaggcaggaaggcagagcccttgagaacaggccagcagctaccaggactggggggctggggggtctggggctactgtccggctctgcctttttgaggacacaggggcctgggccttacccctgaaaacgtgtttgatgtcttcccaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtaggaggcaggtggaaaggccacagggaagggggagaggaagtgccagctgcccaatcttccttcggggccacatgttgcatgggcaggggctgagagacctgagaagctctcagtccgtggggatgacagtggtccatcgcagtggggtaaacatccgggtgtgat

SEQ ID NO: 104747 - DNA, 1317 bp, Homo sapiens
tgaagctgggcttccagagggttgcggtcaggttcctcagtggatagaagggctggtaattaaaaggggagtgttcatgtggcttaggctccttaagaagctaatatgctgtacccagcctcacatactccttgtataatctcatttccactgctgtttgctaatcatctgtttcttcgctgtgtatttctgattcttatttcctaaagttcttactgtattatacactgccaggtgtgagctgttcagtcagtgagcatttattgagctcctactggatgctgctgttctaagtggtgtctcatctccctaattagtgtattagttacttaagagtagaatgtggaatttatgcctctaagtatccccaagctccccctcatcgattttcatttgctgactggctgatagtccagaagtcaacctgggtgactctcctgattcccaggtctgtgggttgaggttagtgatgctatctcagaaagtcacggagcaccatagatggtaggattggtcttttggaggctgcccctgaacctctgtccccatgatgcaggtggagattgggaagacagtgaaggcatacgtccgcgtgctggacttgcacaagaagcccttccttgccaaatacttcccctttatggacctgaagctccgagcagcctccccgatcattacattggtgtgagttctcctaggggtcagaggagggcacctcagagacagtgctgaccccagctgcagcctttcccacggggtggtcttggagaagtcccagcccttccctctgtttcagggcccttgatgaagcccttgacaactacaccatcacattcctcatccgcggtgtggccatcggccagaccagtctaactgcaagtgtgaccaataaagctggacagagaatcaactcagccccacaacagattgaagtaagacgagttcttcccacaccatgtgggatcagcccagtgctgggggttgggagtgtctttatagtacagtccaggaagctactgtagagaagccatataaaaatctgtgtcccacaatgtcctctcatcaaaaggcagctgttacgagctctagggatctgggaggcagcaaagttagactggcagaaccagagggagggggccaagtgacttgacctttcctctgtgacttgggggattgtgtggctcagagaaggggtgtgcctggtcacatggcaaggggacacaccaggactattcccagaaagcactgactgggtggaagcttagacagatgctgactcatgtgtagaagaactccttaaccattggtcctgagcct

SEQ ID NO: 104748 - DNA, 1050 bp, Homo sapiens
agtggcacagagtgcccattgcaggcaggacccgggacgagtctcccctatggcaagcagcagcccgtgccacaggccctgcgaactgctctggtccagaagtttccttccatggaggcgccctgcccactggggtcttcacctcccttcatttcaggcttgtgccaaagactctcgcaactccaatcaggccctggttcctctggtctcttctgaagcctgcaggaggaattttccagggagtattgacgtcagcagcaagtcctggttgcttcagaaacagttgcaggcgactgtttccgagggatgtctactcgtggctgtggctttttccagctgcagagcagcagcacagagatagacaagcccccagcgctccccagttagctcagagaaagggtttctttccttcctgttgatacatattcagcacggaaggatggcttgcgggaatgtgtggctttggagtgtctctggggggctctctggggctcacgcagcaggggtcctgtgggggtttttatccccacacagtggacatggactgtgcagggccgtgatgaattttgctcacacagccccagaacgctctgtaagggcctttattttgttttcggctggtttgcacataggagtgtttatccgatttaagcctaagttttccttcttttcaacgattctttacatttcaatcaagtcctctaggcggaacccatgagatgaccagagcaggggaaggagcctgctgggcactttacatttcccattaactcgtgcactcagagacgctggagtgcttatcgtgtgccaggtgctgtgttaagcactgcggattcaggagggaatgaagccggggggcccagctcctgtgagccgcagctgtgtctctccatctcctgggtcctatgagctgcggctgcttctctccatctcctgggtcctgtgaggcgcagcccgtcatggggccattgttcaggtgaggacatgtgtccaggatgagtggggagtgggtggcaattgcagggcctgaagtcaggtgcatccaccttt

SEQ ID NO: 104749 - DNA, 1697 bp, Homo sapiens
gtgtgagttgcccaccactggggcctggtgggttggggtggcgtcttctaagctggattgctcccaaccctctcctcagtctggagtggaggagccagcaactcattccacctcaggaggctgaagggagacctcaaagggtctgtggccattctgctgggctcaggagcaccaggggcttgtggccaggagcaaggccaggccctagggcttttgggcctgttcttcccgaggggcagcctaatcatgtcctcctggatctaatggccttgcccttgtccttcagcatgaccctctggtgcctctgtcggcctccatagagctcatcctggtggaggacgtgagggtgagcccagaagaggtgaccatctacaaccaccctggcatccaggtacagtccttgccctgccaccttcctgggcaagacccacggggggactcctcgccctcccacatgcggcccaaccctccctgcatctgcctcctgcaggcagagctccgcatcagggaaggctcaggttacttcttcctcaacaccagcaccgcagatgttgtcaaggtggcctaccaggaggccaggggtgtcgccatggtaagcttgggccatcggtccccactgttggttttcattccttatctgggctgttgtgtggttaattgattgatcattttgaaagctagcacttgactcacactcggaatcccagaactttgggaggtcaaggcaggaagatcacttgagcccaggagttcaagaccagcctggacaatatagtgagacccccatctctacaaaaaaaaaaagaaaaatcaaaaattagctgggcatggtagcacaggcctgtggtcccagctacacaggaacctgaggcaggaggattgcttgagccccggaggttgaggggtgcattgagcagtggtcatgctccagcctgggcaacagacctgggtgagaaacccagaccctgtctccaaaaaaaagctggcacttaatcacattagctataattagcaaggtctttagattctctgattcattctacaactttagtcattctcatgaaacctttgtgatttgtattccctgtccacaaactgttagttacctaatggtttcctttcaatcaatcctttaagattaaaatattattccataaggagcactgtaacagccataaagaaaattgcttttaaaagatgtctcacctttctctatttttcctgtgtttctctcttgaccctctccctactcttgcaagcattgactttagctgtgctcatggcatggaagaatttaatgttctgcttttattatgttattttaagtttttatgtttttgcgtgttgctaatgtaagctggcagtccatcttcaagtttgctaatgctttcttttgccagtttaaatctactcttgtgcgcttctagtgaatttttcatttcagctgttatacttttcaatttaagaatttctggccgggtgcggtggctcatgcctgtaatcccagcactttgggaggccgaggcaggctgatcacaaggtcaggagattgagaccatcctggctaacacggtgaaaccctgtctctactaaatatacaaaaaaaaaaaattagccaggcgtagtggcgggcgcctgtattcccagctactcgggaggctgaggcaggagatggcgtgaacccagcgggtggagct

SEQ ID NO: 104750 - DNA, 1051 bp, Homo sapiens
atggggtgttgaagccctgagctggcctgagaggagggccaagcagagatgttgtctgctgtttcctgtgtcctcttctctcttctcttgctggagggctagaatgtcccacttgtggggacagtgaatgggtgactggttaggaagctccgcgggcttaggagagtgaatgtgaaagtggtcaggctctctggatcagaacgccagctctgttttccactagctgcgcaatggtgagcaggctgctcatcttgatatcctcagtcccctatccccaaaatgtggctctcagtagcgtgttcccagggctattgagggatatgagggaacgtgatcatgagacacctcattgctctgaggcatcttgatccctgctcagcagtcaccattgctgtcaaaagtgcttgtggtctctgcccacagagcaaggaagatgtacatcgatgttgctcactttatagaactcttacttctcggggaaactcttctccatcctagcccacgttgggcaagttatttttctgccaagtgggtgtgaagggcaggggaacactgaagctggtgaggatggcagcagggttcattgttggcaattatagaccccatgggagaccagtgaccagagcttcttgggaaacccctagaggctggacggaaccagcaagaaccccagtgccccctctacgtagaagcaaagagttcactttgcaatgttcagaaatggcataatgttaatattctccaagcagttggcaaatagattgtggttaattttttttttaaacagcttacacagaaaaactgattgcctctgaaaattcatggagtgtcagttttgtccaccagcatgcagaacaatattaacatttaaagcactgaaaacaattaagaaaatgcgtcagctgtactgagagcagagtgcagagattcggggtggcagtgggagtgtattggcttctaacatttcctgtctttgctctctctttccctgttattttttgtttcttggtggccagaactctccatgccttccgatcagtacgagttgcag

SEQ ID NO: 104751 - DNA, 1011 bp, Homo sapiens
ggggaaggggtcaaggaatagcagccaaggctcatcacagcatatgcctctcctgctttttatgttggcctggggcttctcaagttccctggaccttgggcttttgtgtggagagaacttgagctcccggtggccatagcatccctagagttcaccctggctctcctcttttactccagtttaatcatggtttcacatagagataaaccatgcacaatgggcagtcagtgtgagggctcagtctgggtaatgccctttttctgggtgcctgctatacttatggagctcccctgggacctctgggttctgaaagtgaggatttgggaatgatatcttgtttctttcctcttaacttccctattcccatgtttaaaacatctctttctcttgctcacaccaccacttccccattccctgtccgcacctcactttgtctgccttttctttatgccaagaatgtacgccctgcagaagtcaggctgctgattttggaaaacatccttctgaacccggcctatgacgtctacctgatggtgggaacctccattcactacaaggtgcagaagatcaggcaagggaaaattacaggtgtgtcattggctctgccatcatgacagatgcttccttcctcctttttttattgtggttacatacatgtaacaaaatttaccatcttaaccatttttaagtgctccatcaggtagcatcaagtacattcacactcttctgcagccatcaccatcatccatccacagaactcgttcatcttcccaaactgaagctctgcattgttaaacactaactccccttcaccctctcccagcccttggcactcatcactctatttcctgtctctgtgaatgtgactactctggttacctcatgtacgtggaatcatatagtatttatttttttgtaactggcttatatcacttttttcctagcctgatgtcttcaagtttcatccatgttgtagcaagggttggaattcccttcccttttaaggctgaa

SEQ ID NO: 104752 - DNA, 1075 bp, Homo sapiens
gtgaagagacaagagtcatgtgacactagacagtttgggtaatgcccctccaccctgggtcccctcccctgcacagggagggagaggagtttactcccaggaagtggtgagcaggaatgaatggcccaggtttccgagcagactcctaaattgtaaaccgctcacagacgtgcggggcagcagtgttatgcactgcactgagctggtcctgcagtcaagggcagggagtcacagcaggaagagcacaagctttcatcggacagccctaggttcaaattctggcctcgccccctggtggtcacatgaccatgagtaagtgtcttcattcctttcagcctcagtttcctctcctgacatacagtttatgacacctgcctggtgggtggtgatgtggagtgtggttcctgcatggggcagaagctcccatcacgcctccctccaccctgggaaattaactccatatctgtctgcctctcccatctgctcttatagggaacaccttcagcactctggctggactggtcttcgagtggacgattgtgaaggactccgaggcggacaggttctcagactcccacaatgcgctgcggtaaggggtgcctctgctaggcctggcccctttgaagggaaggggaaagggggacacctgtgagctcctcaccagcggggggctttcatctgggtcattgaggagtctgggagactcctaggatgcccgtaacattccgagtgtctgattgaggaatgggatccactcacaccattgtgcgggagcctggctgcttctgcagcccccagagagtgtcctgtgagaagctgtcagaggcttgggatgtccagctggagaaatgagacatgcatggctgtctcagggcacagggaaagtgtgggtggccccaggctgcacttctggggggccagttaaagggcagccaggtttcggctggggcacaggccagctgtgccggtgggtctcaggtggaacaggctgagtcgcccatatggcggtatagtaagaccagttgtgaggcggacaccttaagcatcttgacctgtgtcatcctcctggcagcca

SEQ ID NO: 104753 - DNA, 1050 bp, Homo sapiens
ccccttctgtactatacttgatagtcttttataaaaacaccagcatatgtgaaaaccaaaaaccaccagcgtaatccctaatctcagtgaagggacagggttctcgtctttgggatgggaactcatcatactataacccttgtcacttcacggaatgcttacaccctgaacgaaactaagttttcctggagttttttttgcccacagctttaaatgctggtgccctgctggaaaagccagaatgggtggtgacaaggcccccacagccctttctttctggtagtccctgttaactgtcagtggggccatgtgtgaggcagctgcttggcttctgagggtgaagctggtggttgccgtggtctttgccagagtgtaagcctgcaaggcttggaagtggagccaggggcggggactgtctttggtgctgaccccttcctggggttcctccagccacaggccaggtcctgcgctgtgatgccattgtggacctcatccatgacatccagatcgtctccaccacccgcgagctctacctggaggactcccccctggagctgaagatccaggccctggactccgaaggtgagaacgtcccctgcctgtttgtcttctgcagcccatgctagatcatccccccaccatgactctggcctctctgcattccccactcctctggcatccaaccctgcaggtccctagagggcagctctggtcaggcaggtgaagttggtgctgggggagatgctgaagaggcagaaaccacctctgaggtgggcctcaagccctcggtggtgtcgaatcatggtcactcctggccctcaggaacccctgcagtggggcctgtgtgctcagagctgtggctctgtgaccctggagccagaccctgcctgcatagtgctggtccttggtgcagcacatcttggggaagctagcattcttggcagcgatgggaggcagggagaggctccctgctctggctcttagggccagtggtggcttcctgttccagacctcagagcatgtttgtgggtcaggtcacatttatgctgc

SEQ ID NO: 104754 - DNA, 1092 bp, Homo sapiens
cccttgagcagctttcctgctggtactgaacgactcccacatctgcaggagtcttggacggtggccatctgttgagccttgaggtcatttccaggtgtgaggtctcctgtttgatttgctccatgggaactgtgtgcacaggcctggagccctcagcttgtggaggtcttaactggagaggccttggcagggccccacgtctcctctgggtttgaagctggtgttaggtggcccacctcacttctgtctttgggtccaggactgcgccctagacgggtgccacagcctggtgtctggaccccactgtgccttgcagtgcagctccagagagtaaatgctgtcttcttccactgcaggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcagtaagggctgagtgctgtgtgtgatccccggtgggagccagagacagggaaacgcccactaagacccagggtcctagaggctacctgagcccatggcagggctttctcttgttgagtggcaggacacccaggcaggagacaggcacccagcaggcaacacccatcccaagccttgtgccagcacttcgtaccgtgttcccttttgtggaggctggcttgctaaatttctaaattattatttgttacctaaataactcttaatgggtagcaactcattactatgacagttgtcctaatctgtgagatcactccttttccttccccatatctaatttattatattagttgtaaaatagtttgacaacaacaatataattttctatcatgcttttccctacttagattataggacatgttccattttaccatacaatgatttttttttttttttttttttttgagacagagtcttgctctgtcgcccaggctggagtgcagtggcgcgatcttggctcactgcaacctccgcctcctgggttcaagtgattctcctgcctcagcctcccgagtagttgagactacaggcatgcgccaccaca

SEQ ID NO: 104755 - DNA, 1032 bp, Homo sapiens
aaagtgctggggttacaggcgtgagccaccgcacccaccctattttttatattgggctgaagtttaagactctggtctaagtacttctgctgaagttttgttgaaaattgttggtctaaaaactaatttgaaaccctcagggctcagcagagaagagaaacaagtgggagggccggtggtagagtctgaggtgaactcctgccccttcccaaggggcggctcctcagctccactgtgggcccggcatggccagagcacctggtcttcaaagagaagccaggaatccagattattaagtgacatttcctgattttttttttgagactgagtctcgctcttgttgagcaggctgaagtgcagtggcacgatctcagctcactgtaacctccgcctcccgggttcaaacaatttttctgcctcagcctccgaagtagctggaattataggggtgagccaccacacccggccctgatttcttaatgtggcactcattataagattgtaaaagcccacctgtagaccaaactgggcacactggctgcctgcttgtgacctctttccagagaaggacacagctcctattagtggctgaagttctgagggctgaggcattcagttcagtgctctttgtaggaacagaggggaggttggggcgggggcttgcattggaatctggtactgccagcctgccttggtgggggtggggtcagggatgcctcaggttatctgccccaagagtgtgggagccctgacccccaggctccctggctgagctcaccttagactcagagccacagtggatgcctgaggccagcaggcccctctgctccacaggtggaaaagcctaggtccagaaagaggctgtgctcaaggtcacctgggaagttggccgggccttggggagacccctggcaggtcatccagtccagtcttctaggttcccagtcagggctgctgcctccctgctccccaaccgcagcctgaggtgtgagaattctagatagggccacgacagtgtgagcacatgaaaga

SEQ ID NO: 104756 - DNA, 1084 bp, Homo sapiens
tctgcctggctaatttttgtatttttagtagagacggggtttcaccatgttggcgaggctggtcttgaactcctgacctcaagtgatccgcctgcctcggcctcccaaagtgctgggattacaggcgtgagccactgcgcctggcccagtctactgtatttctgtgagcaaaactttgcctattttccctttgaaagccatatcaaaattattgtcagctcatatgtgatggatgataagtacttttattttttccagtttccttgcacaatttcaaaggtgcttatgcactgtacatctcatatgccagccaagctggcacttacttcctggactgttgcttggggtagggagttccttctatacccctgccttgtagctcagctcatccttcccccagagctggctagaagcagtgtttatggaatgagtgcatgaatcagtgaatgaatgactggtggatcggctgcctgcgccccctcaccctctgcttgtctccaaaggcggggaagctggctgtggagcgaggctgggccatcaacgtgggtgagtgctgggaatgtcctcgggaatgtccagcccggcttggtggaactggcctgaaagggggctgggggagggcgggaggatcctggaggtggcagctgtgaattcagaagctctggttttcccaagtcaccctagcctccttgtggagtggcctggaggttgatgtgtagcctcctaggtacctgggagagactgaccagtgcctccatctgacgtgggatccttgtctaaggaggtccccgggtggttccccagccccctctttgcgtacttccggtggcagggagcttcctcccttccagagagcgtgtgccatccttgggcagctcagcatggtctgaagcctgccttgtgtcttccctgaaggactccacctgtgtcctggggcccaggacagcccacagaggcttggtcatgttgggttgggtgggcacatcctgggtcaataccaccaccttctcaagggtccagagggcccgtgctccccagcccccttgaatctcccacaagattggctcatgggagggctgcacgg

SEQ ID NO: 104757 - DNA, 1278 bp, Homo sapiens
gctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggtaagaccctgtcctggttccttcagggcactttgtgtgggaagggcagccttgggctctggccgctgccccaggtctctgcctggggctggggatgctggactgtggggccaggcctagggtggccaccccaggcccttggtttgggcaggaggctgtgagagtgcatcttctcccaggcccagctcttgggatgggatgggtgggtgggagtggggttcctgttgtgggaggtgctgggccccctggtagggctgcggtagtggtcaagggtccagaaggtgcacatcttcagagctgggggccc

SEQ ID NO: 104758 - DNA, 1026 bp, Homo sapiens
ccacctctgccccaggcagcccaacagtgactggcaggcagtgaccagggacccggaggctgtgctcctccaggctgacctgccagccttttctgggattaggtctctctgtcctccccgaccgttgtgggggtggggactctgatgccaacccctctctctcagaggtcatgaacacacatctccgagtctagtgggacccaggcctgcatctgcatggttaagccaagaaatgaaacccatgcaacccagtggaggttgtgccggctctgccacctgcaccggctcccttgctgtggaccttgggcagagcttccctcctctgagcctcactcactttccactctgggaggatgaggtgggcgactgggggctaagttaccccctctgtttcaggacagcccagaggcactgctgtgtctcctacttgcaggagaagagctgcatggccggcgtcctgggagccaaggagggtgagacctgtggggctgaggacaacgacagctgcggcatctccctgtacaaggcaagcctgacctgtggccttcaaggcagggtggggtggggcggggcgggaggctggcctgggcctgaaggtcctcgtggcccaagaagttaggctgtccttggggctcctcctgggagtgaccctcacgcctggggtggaaggactcttaatctgcgcagaaaacatcatcagttattatactgaccaattaattcacagaatatttgtagagcaccactgtgtgccctgggcatcagggatgtagcagtgagtaacacagatggcaattcccgccctcccagggatttctttctggccaggaagacagaggaagatcacgatgaatattttagcacctggcgtggttgcaggcgattgtgctaaggagaaaaacttaaggagaggtgggataagtagtgtcagggctggggagggactgcagtatcagctgacagtggccagggacagcctcactgaggaggggacatttgtgcaatgcccggggtgggggatgtctg

SEQ ID NO: 104759 - DNA, 1024 bp, Homo sapiens
tccatcttcagggtcacttcatggcccaagttggctgctaaagctccagccatcacatatgtgctccaagaaggagaaagagggggagcaaaaacgatgtacttgattcaagtagagtcatccccagtttaaagccctcctgaaggctccgctgagtgaatctaactgcaaaggcccctgggaaatgccatcttttaactgacttgaatagaattggggtttgctagtaaacatgaggggataatgagtgtggctggggggttatagttccttcaactaaaggccatttacttgttatctgtttcaaaagacttacattagtcctacctgtgccagacttgggaaatagaggcagaggacccctctgccctgggagagcgcatagtctggcagaggagataagataatggtgaattcatctccatttatcagtccctcccctgagcctagctccaggctggggccagagattgggcagtgataactgtctctccctgcagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagaggtgagtgctgctcttccctggctgcggcatatagggcgaaggctggttgacctctggccttctgtggggaccctgggtccatcatcacctgtggcttgagacacaagttctgctctaaacagagttctgaggatggtgatttcattgttttctgtggactacccactccaccaacttaaccaccaactaccacccatcaccctttcactgtccactcaccaccctcccctctctttgtctatacatcttcctccctgtctactttgtctatacatcttcctccctacccacttatcagtttgctctttttccatccattgcacttgtctcccacccatcctcc

SEQ ID NO: 104760 - DNA, 1037 bp, Homo sapiens
agcacagccggcatctccgtgctctatgtcgtgcccttgtgtcctggcgtcttgtcccgcttggctgccagctccacccggaggctgctttccccagggacgtgtctatgtgtcagggaactggatgtgtggcctggtggatcagggaccccacctgggctgcaggaaaatgagggggtcagacatgctgggagcaggataggatgtgtggggtctggaggcaggaggcctagccaagcaggacccccagaagctccgtggccttggatgaatgactcgtcttcccccagctgtggttttctcatctgtagtaaggaggctgttgatcctcttttgacgattgtgtgacatgtatgtggggtagcacagagcctgggcaccgtgagcatgctacaacagctacgtgccttccccagggtcccccgcagagctggtggatggaggatggggtccagcagagcccgcctcgcataccagcttggcgttcctttgctatgtgaccttgagcagcggagctctcctctctgagcctgcctttcctcccctctgaccgtggggccagaggactgggtgagggctcatacccggcacctggcctgcacatcgcccgggttggtgctcagtgatgcctcttccttctcctctcttaggccccatgtgggccaggcgccgtggctctgggagtgctctgtgcgtacatgtctgcagcctctgatgttttcagagaactgtaaacccttgtgtcctccagtttgtggtcccaaacggagatagacccaaagtagctgggactcagggcagacggtggtaaatgccatcacagagacacgcgcagagggcgaggtcattccagctggtggcatcgggttagcatttggaaatcagtaagggcatgcagcgtagaaggaacagctcaaataaaggtatagaagtaggatcagaacctagtgcgttcagggcatgtgaccagagccccgtttgtcttctctgtgcttggggaccatgtccagcctggacatatccccttccttcctcgc

SEQ ID NO: 104761 - DNA, 1776 bp, Homo sapiens
gaaggtgagaagggcccagaaggaccaactggaggccccgccccatggccagttttgccccgcccctccctggtcccacccctgtcctgccctggccacccttaggcctggccacgcccctctccatcccctcctttctagcaagctccccttagttgggtttcctgctggtgggaagaccccacaatggtggtgtttggggcggagatgggagtctgaggcagggtgagggcaggctaggtccaccccggctttgctcctgcctgctggtgtctgggtgccagttatcccccttgctgtggcctggtttgtacattgaggtggagcccacagagggttcactctgtcccttttactggaaaattctagccttctaatcagagggaggggtttcatccaaccctttcaacaagtacgtcctgagctgctcttatgtgcctgccgggtcctgggtaccagggatccagggtggggtgctgtggcccttctctgaccttgtggttggggcagcggggtccacacaggcaaacagagatggcagagtgactgggggctgggggcccctgtaagtggtgggttcaaggaggcccctggaggaggtgacgttggagttgagacctgaatgagaagctcctggggagggtgttcaggcagagggggcagcgtgccaaggcctgttgggtgtggggaggaagcactcttggcatgttccagaaacagaaagacagtctccggggttggagccttcttgctacctgtgctacctccctaaagtgtgaacacatgaccttaccttagagatttaggcacacggtggggatatccccacttccgccccctgcaagtgtgggacagcggctaacaaagcaggcttgggagccagtcccccgggttctggtcctggtccagtgctccccagcagtagagccttgtctctgcctcagcttccctccttgtaagatggggcttgtcatgacatctacttcttacggctgtgtggggtttaaggaaataaatccatctcaggtgctcagaacaatggtgggaccaaagagaagcgcagtaaacatggtcacgttgttattactcctgggacaaaggccatgccggcaacaatgtggctgtgccagcttcccagggagatctttgtggccatcagggtcatgggtctgagggcggggatgtgtgggcagggctgctgagtgtaaaggcaggacctgccccccagcccttgacacccagcctctccgctgcagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtgggtgagcgggggctgcagggctggggatcatcagcctagggctctactggaggcattgtgggggcttttagggctttagagaccagggaggcctggcttgctgctccattcctctcccagcccccttgtccctacctgtgaatgggcatgtcaagtgttcaaccctgggggcaccactgtccccaaagtgtagctgctcctattaccttgagctgtgaaaccttggctgagttattattcagtggcctctgtgaagctatctgtggggttggactggatacgaatgagtatcccttttttttaaccagtcagcagtggctatgtgatagatcatgacctggcacagacatctacacacatccaggaagaactgcaataccagt

SEQ ID NO: 104762 - DNA, 1063 bp, Homo sapiens
tacagatgccggcctagtccccaagtgggtctgagattctacccgctctgcgccccccatcaactccttccaaaaaagggtttgcttagtctctgtgcctctaaaacttcttgttaatgtgctgtgcttccctggcagctagacccctggcacgtggttggtgtagttatcctagcactcagcctcgatcccgccctgcctccagctgctctgttgggcagatgtgagagggcgtagggccagccatcaggtgcttgggttctgggaggtgtatcccttgggtagtggggcacaggggtaggacagtctggccctgcaactctgaccagggcaggtctggagcccaggaccgaccccctcccagtgtggccctgggaggggctggggcctgggaggacaccatgccgggctccctgtcacctacacctgcctctgcagacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtgggtaaggccagccgcctccgccctgccagccagcccggcctgcccgcttccccacccctgggaggtgtgtgtggagggagccccaggcctcaaggtaccctgctcaccccccacagacgtgaatgagtgtgagacaggtgtgcaccgctgcggtgagggccaagtgtgccacaacctccctggctcctaccgctgtgactgcaaagccggctttcagcgggatgcctttggccggggctgcatcggtaggtaggctggtggccaggacccctggggaacacctggctggtcccctgccctctgtgcactccacctccccatgcccagcacctccactgcctgagtggggcccacctgctggagtccacaaggtcgccttccagctggcctcatcctcctgctgggcctgccaggacctggctctggcccccgcccccaccttctcagtccctcctgtctcatctctgtgcctctgcccctct

SEQ ID NO: 104763 - DNA, 1027 bp, Homo sapiens
gtgggcgagctgtgggtgacccggcctatcctccctgcaggaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaactataaagtagtacatgtacattatataaaaaaaagttcaactagtatgaaagggttataaagtaacagaggaaaacgcctcttggtccctttacttttgtaaagtgttcagagtttgacaacgttgtccagatgtcacagggctctatggcctggccagcatgtcaattcattgatgaagaccttgatgtccttctcaacgagccccgaacctgaagtt

SEQ ID NO: 104764 - DNA, 1051 bp, Homo sapiens
cagtacgcccgcgtgtggcagtgcaactgtaagttccactggtgctgctatgtcaagtgcaacacgtgcagcgagcgcacggagatgtacacgtgcaagtgagccccgtgtgcacaccaccctcccgctgcaagtcagattgctgggaggactggaccgtttccaagctgcgggctccctggcaggatgctgagcttgtcttttctgctgaggagggtacttttcctgggtttcctgcaggcatccgtgggggaaaaaaaatctctcagagccctcaactattctgttccacacccaatgctgctccaccctcccccagacacagcccaggtccctccgcggctggagcgaagccttctgcagcaggaactctggacccctgggcctcatcacagcaatatttaacaatttattctgataaaaataatattaatttatttaattaaaaagaattcttccacctcgtcgggatccgttttctgcaatcaaagtggactgcttgctttcctagcaggatgattttgttgctaggacaaggagccgtgtagaagtgtacataactattctttatgcagatatttctactagctgattttgcaggtacccaccttgcagcactagatgtttaagtacaagaggagacatcttttatgcatatatagatatacacacacacatttttttttttttttttgctgtttgctgctacttatccagaaatttaagctggtccagatttggagacgttttttccagagtatgttttccatccttttgccctccccagttcaaacttcaccattagaaaaatccagtttggaataaatagagaggaaaaataataaattcccagcagtttccatctttcggaaagtgagccaccggataagagagaatattttgtaagagactatttttatatgaatattttatttatatcgagtctactgtatcattccacggcctgtgcttcttcttaattctggtactcacttaggggtaaggaggggcgatgcctggttgtggcgtcaggccccatggggccccttgc

SEQ ID NO: 104765 - DNA, 1748 bp, Homo sapiens
taaacctaatccaaatcgaggtgtgggtccataggcaacaatagttcctgttctgcaccccctcagtagcctgtgaggactggactagttttgtattttctgaaactttagagaacatctctctatcttcctgttctaggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcagaacaagcagaagaaacagctcccattgaggccactgcaaccaaagaagaggagggatcaagttaatgaaggccacaaggcactgggcaccagtccttttggagtggaccttttgcaaaaggccttgtcatcaccttccaagaaagtttccttctgttgtcctgtgcattataatatacaaaataacttattttgatgatcagaggtcttgaggtcttgacatcttgacatatacactgaaaaaaatgggggttgtatgtatgtgtgtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaagggagaggctggcttggctgttccttgttattccgaaagccctggtttggggcccatgttcacactggctctcagtctagtcaggtgcaatgttcttgagaggtggggacctaattattaccagagtagcagcaagagaggaaacgttgtgaattaagtattcaattaaaaggaaacatgatttctacctgattttgaatgtgtcctttgttttcactagttaaaaatgttttctatataaaaaagtataaattatgaacaattcaattgaaattcctcttgaaagatattggtaaaccaatttgagtccgttaaaattttctgtgttgagttcaaaggaagcttacttattttatatgtgagcagatgccttcacacagacattacagttagtctatgaggtggggaaggctcttcctgtttgaaaatagattaacttgcctaaggtaactgctagacagttttcaggctgtggcatagtaatgcctcatttgtctcaaatgtgttaagttatttatgtaaaaaattgccttaaaacttaatagcttgaaacgaggaatctgggcatggcttacctgggttctctggctcagtgtctcatgaggctatgatacttgtagtcatctcaaggtgggacaggcctttcaagatcgctcgaagtggtttctgggagggttcagtgg

SEQ ID NO: 104766 - DNA, 1055 bp, Homo sapiens
cctgggcattgtgaccccagaagagccttatccaatctagtgcccagtggattgcagggagaaccctgcctacctcccaccccaaagttgagctccgaccacctactgcttccttgatgttactctacccaagagctcagaagtacccgagccacaggtcggagggcctccccacacactgccacaaactggctccttggccctgagctcccacctaacccctccaggccctggtatccagtgttgtaaaatgagatgttgggcttcattgatacggcaaatactcatgaagcaccttctctgcgccagagaagggggatggatggttataaaactacagagagagttggaagtcccccagaaattctttggtgaatactccagctccgtcagttaattcaagcaatctgaagcccagagaaggaggtggcctacctgtagttacacatccagttaggagactagctcagcctaaaattctgagccttttccctggtggcgctgtctgcttctagaacctctcctcctctgggtcgtaaagccataagactcactctttaatgagtactattatatttccgctgattactacttaatgtgtgccataagcaaaagtcctctgccctcaccactcttgtttttaatttcgagtctttctctaatttacttcatttagcaaataatttttgagcctttgggtataatgaggctgtgctgataaacaagaccctcctctttgaggatttacaggaggcagttttctctggaaaggggaggctaggtccatctgcctccaaaacatggagccctatcttttcctgcttcaaagatctctcttagttcggagaggagtgagaattgaaagcactcacttataggccttccttagtatttatcttgtgcataccactgtccccgtaagaagtccctaacttccccccctccgccccccactgatcctttatgcttcccataggatttttaaaaaatgatcccaaactgcttactgtatcagagcttatgtgatctggccctgtctgcctttccagcctggt

SEQ ID NO: 104767 - DNA, 1631 bp, Homo sapiens
taagtcctgagtgctaggactgggaggggatgtgtcactggggatgtccgtctgtgtgtgcgtgtgtgtgtgtgtttatataatgtgtgtatacatgtaatacatactatatgtatatataaatatgtgtggatatatagatcctttatgatcctccatgtttactgggaattttggttcagaatgtgggctgggtttgtcatgtcactgcccacctcacccctcccctagcctgaggggcaccctcctgtacctctcttccttccctccaaggccgtctttgagccccttatcttgatgctggctgaggggaggcccaagaggaagacacgccttattttcctattgctgcctgcagctggctcccaacattcagctcacattgtagcccaagagatggggagcacagactggaatgagtaatgggagagtagcctccagtctgcccggatttgaatcctaactcttcctcttagaagctgtgtgatctgggaagatgacgtaaccctgagcccgattttcttatcggtgaaatggggtcgttatgacatcccgctctttgggcttgcctgtgggctggcctgtgatagacccggtgtgtttgccattgtcatcattgtgatggtcacctgcccctatgtggtgattcactcacctaatgtttccaaatggcatggaaagtcaagacgacttctggattcatggacatctggtcactggaggccttggctggtggtactcaaagacaatcagaatgcgacatcagctttgttcaagcagagattctgagtcaaatcactcctctggcccccaataccaggatggggcctgtcttagctgggccccactttacatctttgtgacttttgtcagctcacccccagcctggtgccagcccagtatcagttgtagggaaatctggtaacatttctactagctaacacgtgtccagtgcttaccacgccctaggccctgagctacccaataactgtgttctttggttctcaccacaaccctatgcacagaggaaatggaaggcacaaagtggtgaagttgcttgcccaagaccccgtagctggtatgtggcagagcataaatgcaaacccagttcttctggctccagaatcctgccctagacgatgacacttttgatcagcagtggatgcaccccaaatcatgcctctgttattgaccaaagcctgatccactcacccttgagtttgaggcccactgtgaacctgcccagaaatgcctacctccaagccctttcttcctccactgctcccacccagccaaagcagacaggcagctgctcccccagaaccacttcctacttcctcatcactgctgatacggttctccctttagggatgctcttcccctaagatctgcctctaagattccactcaagggagcctccttgataccccaggtggaaggggtcactccttgagcaccaagtccacccccatcacaggaccctctgtgtgaccttctagtattgtttatggttgtgacctcactgccctaagactgtctacttctgaccccacaagggctagcactgccctcagaaagctcagccactgtttgctgaatttaattaaaaatacatctctaataacctcttt

SEQ ID NO: 104768 - DNA, 1054 bp, Homo sapiens
ataaatgtgacctgtttttgttgttacggactctgagagagggcccgattcagatcagagggtcagggaaagccctctgaagaaatggggttcaagcaaagctcaaaagaatatgtaggaagctggccaggcatgactgcaggcaatcgttgtaggcagagcaaacccacgcgcagatacacaggcgagaggacacttgacctggactggggacagcagccagcagggtcagggcactggcagcagggtcggtgtccggggggtgtggcagggctctggcaggtgactgtgtggagaacacagagtgggtgatagaagcagggccagtgaggctcctgcgggcagacagtggtaagagactcgggaatatgtggcctggactggatggggtggtaggggaggagcgagccatgtctttcccatagatgtgagtgggtgggtgggtgtgccatgtgctgagatggagaaggcgccagtgtcagcactagacaggctgagatgtcaagtggaaatgtcaaggaggtggtggaggtggtgggagctgcagggctgtgaggcccgggagagggccagagctgcagctttaaattggagggtcacggcatgtggaggccaaggaagcagatgggatgtccggggagagagtatggactgaagcagctaaagaattgcagcatctaatggacaggaagaggggcagcgacagcgatggagcctgagaaggagggtgcagtgtccccaagccatgtggagaggttctgagattaaacagatcacacacatagcgcagagcatgctgcccagcagacatcctccaacctgctcaggggtggtgggcagggtcctgctcattccaggtgagaccgtgggctgagggctccaggtgctggcaggctctgagctgaggaaggcccgtacgttccacagagatctcatgccttgccctgtgctctgccagatgggcagaaggacttagccctataggaggcttgcccccactccgtctggcctgttcagaaatggccaacagctcccgagttggtacagccccctc

SEQ ID NO: 104769 - DNA, 2086 bp, Homo sapiens
gctgggcacataaatcattagtaacagcctgctgcatgaatgaaccaacacctctaggaatggctgagaggcccaaataggcaccttcaggaggctccacccacagcctcttgtatgagtgtgcaggacccaggttatttctagcattacaggcaaatgtctttatactggcctcagactactctccacataaagtattaaagtttacaaagcactgctacatcctctcccctggatcagggtagagtgggtggcttaggcaatgtgcccaaccacgcagctcatagcagaggctcctgtgctcccttagctttcagaacgaagctccttgccttccacccactgatcctctcccctcctcatgcatgtagcaacatgggcccatcctcatctagggacaggagagatctgctgagctggtgaggtgtagagcaggtggcacctcatcacctttctcctttccacagtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcaga

SEQ ID NO: 104770 - DNA, 1065 bp, Homo sapiens
gcgcccagagatcatggcaggaatggacatgagagctcgcaggccacccccaacctggggaatggcttttcacatttttaaagggttataagaatgagaagaataaagaatatgtgatggaggccacgcatgaccctttacagaacaagcttgtgggcccctgcactagaggaagtctgtatgctgaggcccaggggccagccctcagccgcacgcccatgcctgactcctctaagagttacgtgactctgtccttgcctgtcctgcgcccctctcaccacttcactccccagggaagatcttggccttggccactgcacgctgttggggagcacactgggagtcctgaactgtcagtgctttctagggcgtgtgagcagacataggttatatgttgagacacaggctctactgatggacagttacctgaattgtaaatcctggttcttgtcacttaccagccatcagctcttaagtgactttgtctctcagtctcagtcactgctatcagtgatgacagcacagaatataggctagtggatgaaagtgtgggctctggcccttacgagctgtgtgactttaggcaaatcatttaccccgtctgtggtgttcatctgtaaaatggaaacaataataagacctaccttgtgggtttgttgaaaaaattaaataataacatataaagcactgaagataggctgggcgcagtggctcatgcctgtaattccagcactttcggaggccaaggcaggtggatcatttgaggtcagaagtttgagaccagccaggccaatatggtgacaccccatctctaccaaaaatataaaaattagctgggcatggtggcgggtacctgtagtcccagctactcaggagacaggcacgagaatcacttgaatccgggaggtggaggttgtagtgagctgagatcacaccagggcactccagcctgggcaacagagtgagactccgtctcagggggataaaaaaacaaaaaacaccgagaatagtgtctgggacagagaatgttccataaatgttagctagtgcttgtagtaagaaaag

SEQ ID NO: 104771 - DNA, 1036 bp, Homo sapiens
cggtggctcacgcttgtaatcccagcactttgggaggccgaggcgggcggatcccgaggtcaggagatcgagaccatcctggctaacacgatgaaaccctgtctctactaaaaatacaaaaaattagccgggtgtggtggcgggtgcctgtagtcccagcgactcggagaggctgaggcaggagaatggcgtgaacccgggaggcggagcttgcagtgagccaagatcgcgccactgcactccagcctgggtgacagaacgagactccgtatcaaaaacaaaaaaatggttaaaatggtgtattttatgtgactgtgttttataccacagtaaaaagaaatagctaaaaaaagagtggaataagagcaaaaaatgaataaaatatatataaaattaaaattgaaaaatgttaatacaattttgaggtaagaaaaaaatagaaacaggaattttgagaaatgggaataaaaagcaagtaaaataagtgattttaaaagacatgggatgtacaagaccaagaaataggagatgttcttaataaatgagaaaacaggaaggtacagaaaagagaaaaaggaagcgtagggaaacccacatgagagtgggcgatttgagtcctcccactggggatgacttcctgcttgtcagccccccatgggagtcatgctggaccctctcttcagggctctgccctgtcttggagctttctgtttgatgtcggtggggggcatgatgccctgggcaggggcagggctttgctgttctgggactttagcacccagcagtcaaaggcagcagggggcctgggctgccctgatagaggcttcctcttatgggtatgtacgggtagtcgggagaaagcctgttgggaagagaatgcaggcgtcgtccagaggcaccatgtcagtgacagaaggaagcattagaggtgcatatttattgatttattttttattgtggtaaaatatttataaattttttataataatttataatatttataaattatatatatttatatatataaataaattta

SEQ ID NO: 104772 - DNA, 1010 bp, Homo sapiens
aagttctagaaaaccacaccaaaccaaagaccagcaaaggaaccaaacaagaggaaacctttgctaagggcacctgcaggccaagtgccaaagggaagaggaacaagggaggcagaaagaaacggagcaagccctcctccagcgaggaagatgagggcccaggagacaagcaggagaaggcaacccagcgacgtccgcatggccgggagcggcgggtggcctccagggtgtcttataaagaggagagtgggagtgatgaggctggcagcggctctgattttgagctctccagtggagaagcctctgatccctctgatgaggattccgaacctggccctccaaagcagaggaaagcccccgctcctcagaggacaaaggctgggtccaagagtgcctccaggacccatcgtgggagccatcgtaaggacccaagcttgccagcggcatcctcaagctcttcaagcagtaaaagaggcaagaaaatgtgcagcgatggtgagaaggcagaaaaaagaagcatagctggtatagaccagtggctagaggtgttctgtgagcaggaggaaaagtgggtatgtgtagactgtgtgcacggtgtggtgggccagcctctgacctgttacaagtacgccaccaagcccatgacctatgtggtgggcattgacagtgacggctgggtccgagatgtcacacagaggtacgacccagtctggatgacagtgacccgcaagtgccgggttgatgctgagtggtgggccgagaccttgagaccataccagagcccatttatggacagggagaagaaagaagacttggaggtaaggccttggctgccaggggctccaagacacagtcaggttattaaaattattcctgtttttgagcaccttatatatgcccagcactatgttgggtgtttttaatgggttgtctcatttaattgtcacagccatataaagctggggcagttgctgccttaattttagtgtaaaaagttgtggagttgaaag

SEQ ID NO: 104773 - DNA, 1033 bp, Homo sapiens
gcgcggaacgcgcgcagcaacctccaccaggcctccgcgtctggactcccgccctgcctctgggcctcctccgcccaccggcggcgtctcccgcgaagcccgctgggcctcgctctcaccctcctcctcctcctcacgccgggccttgctcttggccttggatttctggctgcgcagttcgcgtccccgcggctccccgccggccgcgcgtttccgagccatgttgcttgtctgggcaaattccacttcgcgagtgacgcacccggccgcgatgcgctagaacgccggccccgccccgaggcggtgcgcttggccacgccccttcgttggaggcctagtcacgcccctaaaggaagctccaccccatacccgtggccactaaaaaactgcgggaagcaggaaagagcacaacaggtttctctctatttccggtgtattgtatcctcacgtttccggagattgacgttgctcttgtgttctcgcgagaggcgggaaagggcgcagggtttgaaacatggcggacgacgtagaccaggtaagtgtattttaaggaggtcgctcgaaggagcttcttgtactaggctgctttttccagactcaggaaaaatggccagtcgtgcctcctctctccaagtcaccatggcctaatccaccctgtcctttccgtaaccccccctccgaattttgccgtaggccctgagaccttttcctgttagaagcccacctgatgactattctcacactcttcgcttcatttttttaaatctgtagattattatccttagctacctcatggagctgtcaggattccaatagaaagccaggtaataaagttaggagttgttatcattagtgagcgcaacaattatttattcattcagcagatagagtgaacatcagctttgtatggttaggcactgttctaagggccagggacactgacatcgacatataagagatccttgccattacttggagcttatatttgcgaggagaacagataaaagtaaatataaatatgtaagacttccag

SEQ ID NO: 104774 - DNA, 1068 bp, Homo sapiens
gacatgtggtctactgtgtgcctttagaagactgcaatggcattatcttaccagtaaacaaaggattttatcttctttactgtatttttcttgtcagattgttataggtgaaattgaaggatgtctactgataaatgatgaagatgaatctgctgtttttcataattaaatattataaatgatgtgactgccttagataacaagtggggtggagactttaaaaataatttcaagtgatttgaagtaaatttatttttggcaatataagcagttttatatttttatcaggtcaattaagtaatcattggaagtgacttgtgaagaaacagtatattagtactgtaggattactttttatttgcatgtaaaagtttgtgatgtaagtatcaaatgccctagttgtaattgagcaatttgcatattgttaagcctttatcatttttgtaatttgattattaaatttcttggttctgtaccctcccactttaggcttatgatcaacatttaaatatgatcttgggagatgtggaagaaactgtgactactatagaaattgatgaagaaacatatgaagagatatataaagtaagtcatgcaattctattcattgctttgcaaatatcagctgttctctctcgaacagcttaacccatatttatgggaagcctgtcatgttttgacacctacttatggactcagtagagcatagcaattaaaagcaagggttctggcatctgacagaccctgttgccagtactggcttgaccacttcctacttgggctaccttgggcaagggaattaagttagctgagttctcattggtgagcaggaatactaccacttacctcatagggttcccagattcagtgagatacaacaatgcaaggtggctatgtataatagtgtgtaacagtaatagtggacagtgttctttcgttttctgtggatttgatctattaatacttaatttattagaaactgaaactgaaaaattttttaaatatttattcattaaaaaaacctgggccgggcgcggtggctcacgcctgtaatcccagcactttggg

SEQ ID NO: 104775 - DNA, 1053 bp, Homo sapiens
ggtaccggagggaccgggagctgggcgcgcagccggcgctgcccgccgtctgcagcccctccccatccccgcgtcgccgcagtcccggcctcctcccctccgcgtgcgcccatccggcgcccctttcaccaccgcggaagggaccgagagtcgcctgctcagtcccgctggcggggctgttattgtttccccggcaaaagggctccggctcttggtgcgggcggcaggagagtgtgtgtgtgtgtgtgtgtgtgtgtgtgtgtgtgtgtgtgtgtgtggcatatctgtgtgcctgtctccgtcaggatgcctacatgtgcctccgtatccctgtgtctgtgtttctgagggtgactgtttcaccgtgtccccagcagcgtgcacatgtgtgttccggtgcatgtctgttattctctgcgtgctgggctgtgtgtgtgtgcctctctgtgtgtgatacctgagtgtgctgtctttggatgtgtgctcttgtgtgtccccgtttgtgtctgcatgaatctgtgtgtggggggctgcgtcttccaggccctggctaggtgcacgtgcgtgtccctgagtgtggttgtgtctccaggtccctggttgtgggcactcgtgtgtcctcggctgtacccaagagggtgtccctggtgcctagagggtccaatggccagagctggttctccagggccggcgctgagtggggagaggtgatagggcagcgtggctccataggtgcatgcactccataggtggtgtgcaggtggcagcgccagcgtccagcagtcctgagtggtgggaccaaggcccggaggggcagccaaggggtagtggacagccggcagggccagcaggacacttccccctccagactatttctcttccttctgtgggttcctcttttgagtaggagattctcgtccccctcccactagggaagccacacagagagaattccagggacctcctcctacagcctcaaagcttcagcctggacttcagcctggactggagaggagacctgtgggcagctctcccaggcagggaggtgtgtgc

SEQ ID NO: 104776 - DNA, 1222 bp, Homo sapiens
tggcacagctgacgttcaagtaaatgtcactgaggagatctttttaaaatttctttttaattttttgttggctagaagggaggggatcttgtccagagtctcctagccagaaggagtttatttttatgagagagagagcgggtgagtgcttagcaaccacctgcctccctctcgaccagggagtcacccagggattgtggggtgggcatgaggaggtggggtgggggaggaatttcatcaagatggtgttggagaggatccaaagggggcctagcacggctaagaacccccaacagggtgggactggtagaatggtgggaggtgttaggcctggctcagcccccagttgaccttgggcaaccctttttctgcctcagtttccttacctgtaaaatgggtggggcagactggttatagagtaaaccagggaccagaggtaggagcttgtccccagggaactgatttaagtcctatgctttgttttaatgggtgggtgaccttggttgattcccttggtttctttgagcctcggcttggctgcctgggcagcaaggacaccagtgccggcctcactacgtccttgaggggattgagggagatgaggctgaataagcttgtagtaagctgtaaagccgggctcggctgtagagctgctgattagagggtgtcacgaggtcctgggtcactgtggtgtatggcaagggccaaggtgcattctggaggctttgtcctttggggacacccttgtactaacccatggctcagctgcaatcatcctcccctgcctccttcccgtcacctcaacctgtggtgattggaccacatctgcttttcagagtctggaggcctggtgagcagtacccattttatagatggacaaactgagagccacctaagggactttgccttgactggacaaaattaagtttcaaaaggttttccctagctcagctgtgagttttggccccatggggctttggtcactgatatcctcgggagttgaaattgaaccggggcctggggaaaatgaggaacaaaggtgtcccagtccttagggcaggaaagtgagcctatgggacccatttgcaccttgcttctgtccctagttactcattctcccttccttgtgccttcccctgagccctgctacccattctgctgcaggggtcagccctccacaaggcagtccgggctctggggactctgttttctaacctgaact

SEQ ID NO: 104777 - DNA, 1036 bp, Homo sapiens
aagtggggcctggggccctgaatttctaaccaaatcccaggcactgtggacggtgctggtctggggaccactctttgagtcaaggagataaatagtgcagttgtgagcctcctatacattaaaagccagatcctgtgcttcgtcaactcctcttcttaatcctcaccaaagacaccactattcccattttgcacatgaagacccgaggccctgctgagggcaggtaacttgcccaaggtcacacagctgggagcctgccggcattcgtgctgggccagcgccaccttggaaaggttgctgttggggaagcctttcactactgaacagtgtcctcgctccaaaagccacaggaggcttttcaaggcagccaagtcggatgtaaatcaggggagagcccagggctagccaggctgctgacagcagggcggcctgggtcactgtgtccggacaaggcccacagcgggatttggggctggcatgatgcctgggagtgggggagccactggggatgctctgggcgcctggaaaaccagcctggagcctgctggagcccaaggaagcaccttagcctctgacagcctcccccattatttaaatacattccagggaacacagctggctggaaggggcagtgatgggaccacaggagctgggacctgctgcttccgttgtttaaaggctggttcatccctgcagccacgcaggcattctccgtaatcgccgtctgctttgaggacagagaggtcgtggtcttctgctggctggggctttatttttgcactgagcacctgtcctcagcaaactgggaaaagtagaacacgtagtgactctgagtcctcaaaatgctgtccctggcccagcagtatgggcatcacgtgggagcctgcagaatgcagaacctcaggccccaccccagaccttctcatttagaccttgggggcagggctccgcattctgggttttcaagagccctccaggcaattctgctttgtatttaactttgggaagggctgatgacctctctggctgtgtgcct

SEQ ID NO: 104778 - DNA, 3189 bp, Homo sapiens
gggactttcgggaccatggctgcccacctcagtgaagtctgaggggagttcctggaaggcatttccatctgtccatgtgttctaagtcagtggacaattaagtccagaaacctcctggacttaaaaagcaagcaccgccaggatccctggggctgcagacagcctcgggggttttggagggctggctcctcaggcacccatgaaggaaggtgtcctggggtcagtattcagacccaaatgcccgcagggaccctcagggtgcctttatctactcatgtctccacacacttgctggcagagctgggacaagtcactaaccctctgtgtgacctctgattcgccatggaaaaaagagtgaatagaataaatcatttattcccagggtaggttcttggggtggcagtgccgagcttgggtgagtctccaccccttcgatttaggagccgatgccctggtgcggatctctcctctgagctgagcgtcctccactaagtcaggcacagagcacgtgcagcatagggccggtgtccaggccccaccccagcttggccgcttagtggctcaccttctgggggcctgcatgcaggccaccttggcttcctgtcattgcttctcacccccaccctcctcccagccagaggtagagttgcatccctgctcttcagcctttcaattcctagccccagcttggctcccacctccaaatccctaccctcactcctcttgctctgtggggtcccacctgggccattgtgttgcaaaggactcacgcctcctacctcctttgctacctctgtcacaaggagggggctaggttctcatttatattttctgggttgagttttcctgagagcttctgctagtctcacagcccctcaagtctcttctgggcatcctgccagtcctggacaagggttcccagacaagggtctgtctcttgtcccttaagttactggggacccagagagaccagattctgatgaggaatccaagactgggtccacatcaatgagaaggaagccaggattgattagcagtgtctgtcaagggggcaaggtgggaagaggtggcatgtgtgttgtccacatgacacccttagtaatgggcatttgctttggaaaaactgtagaggaacccagaggacttcaaaaggactctacagccagcaggcaagaggtgtcttctggataggaagaaggggacgaagtgcctctggaaggacagacagtgtgtccaggggagggagccctgctgtgccaggccttctcatgcctcggtgtgatctcacacctgggatgagtgtgagacactcacacatgaatgttgtgagacaacattcattcacttagtaaatattgagcaaccactatacaccaggcacagtgcagttggtaaagagccaggaggctggaccttgtctcaggtgggtagaaggaagctgtttgtgactgtgggctcatgagcctgtctgcctccaccttttcatccactttcctcataataagcctcctgaggctcagagaagtacagtgacctgctcaaggtcacacagcaccttgagacctcaggcctctgctcctctcagaaccaccttcctgttttggtgctgtcaagagaatagtatttggtgctacttctttgggcaagtccatcttctgcctgggcctcagttgccccatctgtaaaatgggccctatgataactactgggttagcaagtgcatgtaggagaaagcatcttggtattttgaaaataccaaatgtgtcttattaattaatattggtcataattcaggggtgatttattcacatttaacaatccagacattcagtgaagtctctcaccctaaaggagacaaaatcagggagtgtggccttctgtgggccaagcgatccctgtgtggccgagtctggaagtctcatggctgggttctggacctgcaggatgattctggggagaagggtcgtcccagcttaaggtcatggagtcaagaccttttgttttcctttggcctttctagtccatttgagaaagtcaccttttcaaacccctgccagctctgcctagtactggaaaggccccagcaagagtgtttgacgttaggggaagtttggggaaaaatctctaagcatataaacattgagaattgaaagtctgatcagtcatccaaaagttatggacttttgctgtggttcaggccccagctggggctagggaccctgaaatgagctgccctctgtccagcctgggagcttgtgtgggaagatgctacaaatcaggaccctgtcagggatggggagggcctcttgaaggtgctttgggcacgcaaagttaaaaaaaaaaaaaagctccctgaggtcttgaatatcaaaaatatgccagttgggcaccagacagtgagggcattcccagtaggggaaacagcccgtggaaaggcctggtagagagtggaagcctgtagaagccctaaggagtgcagcgtggctggggtgtcctgctctgggcaatggggaggggagaggagctgcctggggtagggggtggggttgggtctggctcagtggcctcggatctgttcagagtggttggtcttgattcactctggggaaccagccagaaacaggaatccttatttcatggttccaactgccccttaaaggtagtgcttgttgttttgacaactggctcctgaacagacaaaccctgccttcaaccaaacaccgctgcaggagaatcacaggcacggccacaagtctccagaggaaacccactctaacgaggtgtctaacccagtttgctgactcacgtggttttgggagcccgtgaagtgcattgggagggaggggacggggacacggcgctattgaaggaagctcggtcgaagccgcctgtttgacacacaacaccggctggagaaaccgttcagctggtattttcccagtgtggcagatctggagcccaggggtgtttgtttctgcctctctctgcacttagctggatgctaagaaggggcggagtcaaggtcaagtgttggttgaacgaaggcacgccatgaaagatggctaatctttcttgggcacagagtatcctgtttctcctgagagcaaatccaattgtgtattcgaggcacttccttgtaccttccttgtgtaattcacgacgatgacccattttacagatgatgcaact

SEQ ID NO: 104779 - DNA, 1033 bp, Homo sapiens
aaaatacttttgatctgggctgattcaagagacctggattctaatccttgagttaatttgaaaaataattcccctgcctcctgctggtttcagtttccccctgtgtcaggttgagggggagagacttcctggtatctaaggtcacagccaggcggtgccccagagcgcagtggttaccgatccagactccagtccaccacttcctggctgtgcaacctcggtcaagtcgcttattgattctgagccgtagttcctcatctccatttggggtaagtccccccccagccatcccaaagggtggctggttaaggattgggtaaaatactgcgtccacctgctgatccccaaactgcacatgcaagcctgcagcccagggagctgggattggccacgaggttggaggattttgcatacatttaaagcatttcgagtgtgcttttaagccccattagactctaagatgctacacagtctcgctactttcggactaattaggagaaaagtaagcagctgtaatcagtgaaaaatgatttaaggaaagaaaaaaatatttagcctgattaaaacatttctattagctagaattatgtaaagtgcccgtcacagtgccagacagacaatgtcagctgcagttattatttcagttatacaagaacaggtggaattaggagaaccaagggttgctatgacaataagccgggaccctcctcatccctacctgggaggagggctggccctgccctagagcttcctgcggtcttggtgaggaagaagaaacttctgggccggcttcccaggggaaggtgcacctgaggatgagcaggaatgtgtccttcagggcctgggaatggcagggcctcccagaaacggcgtggcgatgggggttctgtgataaaggaacccctctctggctttagttctgctgcagagcgttcttatgtggtgtactttcctggaaaacacagcctcccagcaccctgcgctgtgctggaaggagcattgtgacctcatgctcaggtactctgaggcacag

SEQ ID NO: 104780 - DNA, 1047 bp, Homo sapiens
aggtcacccctgccagcctttgccttgatttctcaaactccctttctctttagcaagtggataaaggcatgttggctctgtcctgggtccacatctgggctctgccacttgctatggagtaaccttggccaggtcattctcctctgagcctcattttccttatttgtaagttgagggccaaggtcttcatctgccagggcctggtgaggagcagcagcaatagggaataagagactctctggcaaactctcaagtccgggataaatggctgttgggatgatcctggacttagtgaggctggcagaagtgaaactcagcctggcccagcccctagatgctcacagtctggcagatgagacgtctgtgtgcacacacgcatcacatgcacgcactgtcatgagccagccttaatctctttcctgagctgattttgtttgatgttttgcccaggtgcctcccagttcattattagcaccgccattcccaacctcacctgattttcagattcacctgggaagctggttaaacaggacagattcgtgggcccccaccttgaaaattcagtcagtagggctgcatgggcccaggcatctgcatttttagccagtgtctcaggcaactctgatgttcctcatgtgaggattttggtcatccactagtccctcctaagatcccacagacttcagcaatgaatgactttacagattatgaggcccgcttacaggtcaagaaactgaggtttcccaaggagaactttgaactttatccaaagttgcacagttctgaatgagagtgcagtgtctggtgaatggtgggggtgatttgagctggaggatgctaaacggaagagtcttgggtgggcgggaagggcttttgctgggaggtgacacttggaccagggtcttccaggtgggtgggatctacctaaatgtaagagaacccacaaaccaagcacagacttgaaaggggcagtgccggggagagagtcatgctgggcaaaaggagaaataaggtggcagagattgggggcaagtcagacaactctag

SEQ ID NO: 104781 - DNA, 1097 bp, Homo sapiens
tgactccagccagccctgggccatgggggaaggagatggaaaaggggcttggctccctctgacccttcacccagcccctgcaccctggagcagagctgcaggcagtgtgaccgttgtgctgttattggcctaaacacatagcaacaggaaaacaaccccaaaaccccagccttaagagcaagtccaacagtgcgcgactccccaggtcaggagaagccccgatgtgtgcagaatctgcagatggggctgctctcggccctgcctctggctgtggaaacaggcctccaagtacccaaggtaggcattttggtggccctccccaagctcctctttctcctccagcccagctgtgggtaccaagtgccctggaagtctactgagtggtgtccagggtcccctcagacagcatcccagagacttgaccttcctctgtgtgtccaggctgtcaggcccagctctcagggactctttgaccagagacgtctttgaagcctacccttgaccagacacggaaccttgtccttcctctgaacttgtagaataatttttgtttctttaacaaaacgagcccctccctccttctctagtcgttagtgctgtgaaggtgggacgttagtgctgtgaaggtgggacggtgacccagtacccctgtgatggccctgggccaggtgtgtagcaggtgctcagtcagccagagcttttgttccctcccgccacctcccccagagagaattgccccaggtaagcgagtgcctgctcagagcagagtgggcagatgacttcccaagagcacattacagcaaagggtgaccctgttcctttcaaagcatggcttcacccatggagccggcagggtttgggcttcctgcacaaggatgttgtgtttgtgccaccagtcttaggtgttaggtccttggtcaaggggaagacattctggccacccaccccgcaggttctcagctcatggtgaggaacccaggcggccgaggtgtggggttaacgactctacaggccccaccagaaagtgttagctgagcacggtagctcccatctataatctcagcactttgggaggccaaggcaggtggatcacttga

SEQ ID NO: 104782 - DNA, 1029 bp, Homo sapiens
gattaaaggtgtgagccaccacgcccacccaggaatagcactcttaacaacaactcccttttttttttttttttttttttttttttttttttttttttttttttttttggtgcttaattgttaaacactagggccaaggagagtgcccttggcaggcatcactaatagatcctggccatcctgctcactgagcctgtacctagcccagaatctatggagacagtggtccagggagccccatcagagttccctgtttgctagaggagggctccagtccagcacgccatctgtcctgcctgagtctgtgctgtttcattagctggcctggcccagccctgtggcccttggcactgactgctccccaggccctgtccagcctcctgagccccgtctccatcatgtggcccttcacttccctgtttgcctttgcctagttccccagtttgtcagccggcttgcagctggctccttaaagacaccagaccccatttcatttgatccatagcagctacagtagttgagaacatggacttcagaggccaagacagacctggggggcatttggagcttaagtggccttttcctcatgtgtgactgtggacaagtgacttcacatctctgtgctttatcagcacaggaaggatgggagcagcacccactgaggggattagctaagaaaatgaaaatgtgcttgtagtcagtgctctttttaaaaagatgcatattctgcttgtgtatatggtcagtgcttaataaacacagctatctttttcttaaaagtaactttttttgtttttttttggagacagggtctcgctctgtcacccaggctggagtgcagtggggcaatcatggctcactgcagccttgacctccaaggctcaagtgaccctcccacctcagcctcccgagtagctgggactacaggcatgtgccaccacatccagctaatttttgtagtttttgtaaagatggggttttgccatattgcccaggctggaagttttaaaattgataaataaaaattgt

SEQ ID NO: 104783 - DNA, 1085 bp, Homo sapiens
agctcttaaaatggggaattatgtatctcggctgctgcaaaataaccctgggcccagtgccaaggaaaacagcccttgtcggcgggtgcagggacgcctgtggaggaggactcgctcctgagtactcactgcgcagcggggtgaccacttgtgtgtgtgtgaggaagctggggtgactggcctaattgcaagtttgcagaggtgcacagagatactccggggactccctggagggtgtcctctgaggtcagactgagccgcagagggacagtggaggctaagctcctaagggtttggatacatcacggtcactgttactcccagcggagtgacctcagggcgtctcttgtcatctctgggccttattgatctcaccctggggaggatgaaggctttatataccccaaggccaggggtggactggatagtagtgatagcggtagtaagaggagatagtctcaagtcataatgtagttgctgtgcatggagtgtgtgccacatcttgttctaagcacctcctgtgcaccccccctcatttaaccctcacaacactcccacagggaaggtacagttaccccattttacagatgaggacactgaagactagtggggttgagtgacttgccttaggtcacctgtttggggaagtgactttcagcttctgggttgaggcttatattctggtccctgtaggggccagggtgcctggggcagctggcagggagccagggggctttttatactgcggctccaacagccagtggggaaggttcagaggggactgagcctgagcagtaggagggactaaagcagttctgtgtggcccgtgtcccaaggagaaggggagagggaagatggggccagagggtcggcaggggcatgtgctgggacctggtgggcaatggtgaggagcctgtgttttcttctaggggtgagcaaagggttgggcgggggcatgaggacctgattctgctttttaatctgccttcagctgctgcattgagaatagatcaggggcgggcagagtagcagcagggagacctgtgaggaggctgccacagatgccagtgcaagggctgaggggc

SEQ ID NO: 104784 - DNA, 1838 bp, Homo sapiens
tatccatcaatccaacattcttcaatttagctgtttatccattcatctggccattcattcaatcatccaactatccatctgttcattcatccatctatttatctcatctattcagctatccatccatccatccatccatccatccatccatccatccatccaaacatccaaccatccaaccatccaatcaaccatcctctttattatctatcttttcatccatccatctatttatccatccatccattgttctatcccccctgccccctgccatccatcccatttatctaaccatctgttgtttcacctttccattcaaccagccatccattcaccctataaatatttggtggtcactgttgaaaggcctcttgtggcctggggcctggggataccatggccttccagttgagtatgtggccgtggtgggtctggcctccctcagatgtttactcatctcatttgcccaacctgcaggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagtaaggccacctcattgaagcaaggaggaggacatgggtggggcagagaggatggcccacttccttatctcctcccctgggatacaggagccactgtcttcgggggagtgggaggagggtgcagatctggagataaatttatgcctttggccatagacaggactggaatcccagttctgccacttactggctgtttgaccttaggcaagccactcctcctttctgagcctcagtttctttacctgtaagataaaaagaatgaatcattactaccctgtgaggcaggtatgcatacttatgttgtctaaaaatgatacagttttcttaatgtattttaggaaaaaatatattctgttattgcacagagaaaaatgcatatatgaagctgaagtagttaagtggaaagtgagtaggtagagtgaaaaagatgcatcagttagcttttgctatgtaacaaccatccccagacttggcggccttaaacaacaacaatttatttagctcttgattgttctgcttgttggcagtttgggctgagcttggctgggcagttcttctggtcttggtctcctccacgtgtctgcaggcaactgtaggtcctccgggtagctcttctggggtttggccggctattggctggggtgtgaggggcaactggtccctgtggtttcatcacccagcaggctagcctgggcttgtcaccggccactaagcaagcactctaggaacaagaaacggtcaatccccgaaacccaagtgcttttcaagcctctgtctgtatcatttttgttcatgtccctttggccaaagaaagccacaagacaaacccagattcaagaggtggaggaaataaattctgtctcttcatgagaggagtgaagaactgtagtcagtaactacagggaggatacagaggacaaacatcagaaaggtgggatgtggagtcctgatcttggggaactcttgagtgagctgatgtgtggagacattcttctaacatagtgcttagaggctgatcaaaaataggctactgcatcatttccctcttcttcataagccagccttggggctcagcactcaagtgcagccccttgaccctggaaataactgagatgaggccttgagt

SEQ ID NO: 104785 - DNA, 1159 bp, Homo sapiens
tttcaaggtgtttacccacctcttaggagctggcccaggaatgggccagagaagagggagcggcctaccgactggccccagccatgctttggggtcagggctgggacatcgttggcaaagaaggggtcggttgccctcactggtgtggagcccttacttggtcggtccgtgtcactgtcgctgctccaggccttcagtgtatgctcagggcaggtccttaggcccactgtcactgggggttcctctagtgtgtatattttccacttacaaacaaaagggacattggaagcacaatcattgcccctcggttccccgctccctggggagctgagttcacagacaaagaaaggctggcacttcctttttctcacttgaatggggtccaaggcacagccttgtcctttctctgctgtttttggagtggcctgaaaaccgggccttccccactcctggacactggcactcagccagttactgaaggcgtttgctgggacctccttgcctcagacattgactggcctgcctgggtttgaaccctcactttgccacttctagcttaggcggaagtatcccgctctctgggccgtggtatcctcacctgcacctggggagatggcagtgctgacatcccaaggttgtaggatggccctgactgcatgagatcctgggtggccagccctgagaatccattattattattattattactgttattttgtttttgagacagagtctcactctgttgccaggctggagtgcagtggcgtgatctcggctcactgcaacctccgactccctggttcaagcaattctcctgcctcagcctcccaagtagctgggattacaggaacacaccactatgtccagctaatttttgtatttttggtagagatggggtttcaccatgttggccaggatggtctcaatctcctgacctcatgatctgcctgcctcagcctcccaaagtgctgggattacaggcgtgagccactgtgcctggccagaatccattattatttatcgagtgccctcatagtgcataaaactacccctcagggcagtttctttgtgtgttatgaacttaaagaatcaccccctattgtaaaggggtcatcctcttctgggctctgcttgtctcgctgttgtctaggacccaggg

SEQ ID NO: 104786 - DNA, 1041 bp, Homo sapiens
cccttgccttccagaatctccattctgagcaccccagctccattttctggcctggaagacactgagacagtatttatctttggaaagtgtctggttctgcaggcatcttcccaagcttctgcatgatccagatggatttgctctgtccaaagaaccctggctgccagcttggtactcacctcccactccagctctcacacctctcctacccctgcacccctagccccagattccagcagagctttgtgagaccacctgaacattcacaaataagctgccctctttctagaaccctggggaagattgagggccatggagcaggagcctggaaagcaggcttaggcaagaccagcactgcctcctgtgacctgccttcacagcacaggccgaggccagagagctacaccaggggacagctcagttccagccctgagccaggtgccgtgggcaagaaagacccggcctcctgccttcaagagccttctcttttcttggcatgcaatggtggaaaggcaagagaaccagtagggaatagttgactcctgtgagcatagtactaggaacttgcccctgtcatttctttcagtctctaagtagaggaaatagctaggcatcatccaaaactcttctttctacctcaaatcccacatccaattcacacatcttcttggctcccccttcagagtatacctacaatctgagcactgtccccatgcactgtcacccccatgggacccccatcactctcctggacaccagcactggcctcttggatctctccgtgccttatccttgcacctccgtaaccaattctgaatccaacctgttaattcccagctcagaaccctctcatggcttttcccatgctatgatctcaccctggcagaaaggattgagactatttcaacacagcaagtgctcactgggtgctgaatctcctcattagttccatgtcttcatccacctgcgtggagcagcaaatcactacctctctctggctcacttccccatctgcagatggaggagcatatgagctgggct

SEQ ID NO: 104787 - DNA, 1044 bp, Homo sapiens
taatataaaagcaataagtgatgagaaataggctcagggcaggggaaggacagtgaccagggatgttttttacagagggtggccaggaacagctgccctggggatgtggcctttgagcagagacctgaaggaaaggagcgagggagttttggaacaagtggctgagggaagcagttaggtccaaggccttaaggcaggatcgcgttcgacctgttcagggaatggcccagatagcagctagggtggctgaaggaggaggaagtgatgctgcagtctgggggatgagggtagggcttgggcgcccgcacccgcagcctgcccagaacacttcccctttacacccgttcacctgtgtgtttactaattggcaccccctcgctcttaaaagtgagtctgaatggcagggtcagaagggccgtgttggccggggagcgggagccctgggaggacgtggagcagaggagggatgtggcctgacataggtattgatagattccctctgacttgttggggcaggagtagagggaggaagaccaacgaagaggctgctggaaatcatcctgggggcgtcaggggcctggacaggggcagagactgtgctgggagagctgtgttaacactgtggggagcctgtgcagcttcctcctggggtacttaggaggcacaggtgagtggcagggcgccatggcgttccctcggcacgacactctacagtttactgagcacgccctcactgctgggtagggattggctgggatcctgatcggctgctttctggctgggaagaccctggaagtcagacacggaagggactgtggaggggcctgcctgagattcagcctgcatggctgcccgagatgtctttggaaagaatgtcggttgctctggccctgagcctgtgtcaggctgtgttgtgacaaatcctgattgatgagatacattggtttcagccctagtatgttcacgtggcccgttataaagcttttcaagaatttaaaataacttttataaaggtgatatgtgcacattaaaaacattgaaata

SEQ ID NO: 104788 - DNA, 1158 bp, Homo sapiens
ttgggggagggcaacactttatagacgaggagccagaggtctgggaaagttggctaacttcgttctgtcagtgacggaacaaacagtagagctgagaattgaacctagtgtttggcccacggttggcactgaagaaggttctgctgaagtcccaacagaaaatcagtgcccatttcacagatgaggaaactgaggctcaggggttccttaacttgcctgaggccagactaagttgaacctgggtttgcctgaatctggagtctgagtctatccttttcttttctttccaacaactctgtctcaagacaaatggggattcctgggtttggaaaggtgaggtgacttatgtaaatgcagcgcctcaggtgggatttgacccccagcctgttaatgtccgagccttggctctctctactccagggccaggcccctcactgactcctggctctgtgtttgcttcaaggcgcaacgtgctgagcttgtcccctggaatcgaccacccaggctctctgaaatgggacctcgctctctgccttcttttagtctggctagtgtgtttcttctgcatctggaagggcgtcaggtccactgggaaggtaagttggacttctgtccgtcccctgcctcctggagagctgtgccaggctggccctctcccccacttcccgcctgcaattagccacgccccaagagggaggtggccagtggtggcgtgctggtaagcccgccctctggaaaaaagtaaaactcaggtttgttgtagcgtttgtccatttcatggtgtcagtgctcccaccatgtttgctttcaagctgtccacagtttaatgaccagctcacagaattcctgaatattgaagagccaggctctcaggagcctacacgagctagccccatccaccacagctttctcatctcaaggtattggcagtcagtgcagatggtagcagataactaatgttgggcttctaataaataggttagctggtaacaggaggttagccagcaaccgtggtaagagccattagccacagcatggaccctcgctttgcagagggggccacaagcattcccatcagcattgcagggagcttcgtgggcctgccccaaacctacaaactccaaggctgcgttgtaacattatccccagataatccaa

SEQ ID NO: 104789 - DNA, 2130 bp, Homo sapiens
cacaagcacaccattttattcctttctttaaacaatgagaaaactcaggcttagggaggtcaagtgacttgtccaaggtcacttcctcctctctgagcctcagtttcctcctctataaaataggtgatagtagggttaaaatgaggtgtgttaaacacctggcacaatgcttggcacagacggttctgtaaatgctaattctcttctttttttttttttttttttttttttgtaatttgaggtggggtctggctctgttgcccaggctgaaatgcagtggcttgatctcagctcactttctgggctcaagccatcctcaaaccatcctcccacctcagcctcctgagtagctgagaccacaggcacatgccaccatgcccttcttcactctgcctcagtttccccacacagaagtgagaaagtttctgtggagcactggtcctgagcagtgctagagacatcatcacttacttacgcactagtattttttgagcctctaccgtgtgccaggtgctttgtagaaacagggctgggggacatgcagtggttcacaaaacagacaaaaattcctgtgctccaggagctgatggcctggcaggaagagtcaggttgtaacaaaacgaatgggaaaaatatataggagtcaaatggggatgcgagctatgggaaaaagtcaagcagagaaggagaatggggagtgttgggagcaattttgaatagggtggccaggcaagacctaccaagaaggtgactctaggcaaagatgtgaaggaagtgaagggctgagccaggtgagtatgtggaggggaaaatctccaggtagaagtgacagcctgtgcaaaggccctgaggtgtgtttgacccagacccttggggagcacccagtctgatggaggaggctgatgtccgccagggacagtgagcaacttttgagacataatgcagaatacaggagaatagtgtcaaagccagagagagggtgccaggctgcagctgtggccgagcaaagacgtgatcttccacgggtcctcccttctcacccttagcaacaacctccttcgtggggtggctgtaggcctcccaggggtgggcgtgattcccagaacaatagcagagcctgggccaggccagagaagccaagacaaacacagtcaggctctgtgaacttcctcaagccccatggctgagaggctgcctgctcgctggccatggcttccagccctggccacagaccaggtttgtggctgacgtgggggctgggcccacaggcagcagatggacctcatcctgccaaggccctgctctcgtgtctagtccagcaaggaggagttggagggtaatggagggagagccccagcctgagaggctcaggatctgagttcaagtcactttgcctctctaggttgcagtttccttttttgtaattttcactattccaggaagttgaaactaggctgccattaatccattcaacaaatagtgataacggtggcgaaagcgcagtagcctgtgagtgccgggcagcattctcagtgctgctaggtagctcattgaatcctcctcatggtttggagtatgtgcagttattagtcccattttacagatggggaaattcaggttcaaggaggctcattaccttgcccagcatcccacagcttgtcagtggctgtgctgggatttggacccaggcggccccactcccgacctgggtgccccacactcttccgcctcttgtgcccacccccgtgccagcctgaggatgcagtaagtagggcgtgtggcaggcatgtccctgctgtcacagagtggggtctgggaagggggcagagatccagacactcacacaggaagtgcaagccctgcagacgcacaggggaggaggccccggagtgagcatggacattcactgaggctggggctcttcgctgttggcctccggagcagctctttttgcctggttaaaaacaaagcagggggtagtcagagccaggtccttttagctctggatcccccagactgcatgactttgaacaaggccctttcactttctcagcctcaccttccccttatgtgaaatgagttagtgaagcccctcaccaacagccagggcgctgaggatccttagggcct

SEQ ID NO: 104790 - DNA, 1024 bp, Homo sapiens
ggggcatggtgaggatgaagtgggcttgtgcctgggacgttcctactcagccagtgccctgcctgaaacactaggatcgaactgtccattcagccaggcaccttcgaactcctcccaggcataatctctgtctggaaactccttgtgttgaataagatgggaaaatccatccatgagaactgaagccacaaacagcgcttgcaggacaagaggagagaaggtctttgggaggagatggccacatcgtttctagtccccacctcacacctgatcttggcctgtctggaacatgcagtgtgacccagggaaggccatgggtctcccagaggcccggtgaagcggggagcctttcctattcccagttaagggcctttgagaggcctcattttcttccctgaaggtctcgtccttccagcaaaatcagtgtcaacaacaggccctctttctggagcacctactgagtggcagtgttacaagcatcatcctattgaatcctcagctcaccccttgttgaggggcttctattactcttatctgaattctactcatgaggaaacaggtccagagaggttaagcaatgtgcctaagatcacacagcaaatgaggggacggagctgggatttgaacccttgcttatctgatccctaaccataggaatcataccaacattgtagttagttgttaactaatatgacctgcatgcaatgggcacatgccatggttggcaaccactgggctgaggcttctacacacgcacttgatagcttactctctgattttgctttttccacctctacgccctggaatgtcagttccacgaaggcagggatttgttttctgtcttatccaccactgtattttgtgcttagatggtgcctgggacaaactatttataggatgtttttcatttaatctcagtaaatctgtgaggtgggctggcgctgtggctcatgcctataatcccagcactttgggaggctgaggcaggtggatcatttgaggccaggagtttgagaccagcctg

SEQ ID NO: 104791 - DNA, 1054 bp, Homo sapiens
aaaatacaagaattagctgggcatggtggtgggcacccgtaatcccagctactcgagaggctgagccaggagaatcacttgaacccaggaggcggaggttgcagtgagccgagatcgtgccattgcactccagcctgggtgacagcgaggctccgtctcaaatttaaaaaaaaaaaaaaaaaaaaaaagaaatctgtgaggtaggtacctgtatatacccagattacagatgaggcagctgagacccagagtggttaagcaatgtgccaaaggccgcacagcaagtaagacagcaaacctggctccagaactcctgatcctgaccagtgctcccctctgcctctctgagaggatgctcagacttagcagcagcaagtgatgcccatggcctcctgaatccctctcgcccttgcaggtcgtctacttcacagccacttttccattcgccatgctcctggtgctgctggtccgagggctgacgctgccgggcgcgggcgcaggcatcaagttctatctgtatcctgacatcacccgccttgaggacccacaggtactgtggggctgggacacaccatcctccctcccatccagggctgggccggcacaggacagggcaggatgtagaggccactggcagcacatcttccgtggttcttcagtgcacaggtctagctgggccaccgccccctggtacttttccaccgggcctgtggcgggtgtgcctgtccacggtgctgatggacctttctagctgtgtgcatctcttttcatgtcaaggacgtctgagggtggccacttagagaggctgctttaggccctgcaccaagggggagaaatcttctgatgagcaagtctcccgctcggacccagcttctgcccactgcagccacaagggctgctgcatcctggggatgggagagtcggggcctggagagctgcgggcttccttggctgagggtggaattcagagttaatggccttggagggtccacgggcagataccgaaagcacaccttctggcactcagccttgtgaccttggggaggtggagaaa

SEQ ID NO: 104792 - DNA, 1336 bp, Homo sapiens
gggacctccttctgcattctaactcgggggtctgcaaacagtaacaacaatggtggtgacagcagccttgacttacgggcttgccatgtaactggcactgggctgaatcgccactctttgaacctgggaaatagctctatggggtagggcaaaggagcccattttatagatgtgaaaactatctataaactgcaggagtgatatttacttgcccactgtcattccagggttggaatccagatccatctgcttctgaatcctcttaaccctgatgctaggtcgctgggaggtggggtgtttgatttctggggctccttgcagctcagtactgccttgaaaggcaccttggattcgagcataaatgttccatttgcatgtgcaaggtcccgtccccaggccatcgccaggtggacataaccctcgctgcctcctccaggaagccagctctgacagccctcctctctttccttgccacctccctccccctcataggtgtggattgacgctgggactcagatattcttctcttatgccatctgcctgggggctatgacctcgctggggagctacaacaagtacaagtataactcgtacaggcaagtgttgcgccggcgggcctggtggactttagaaatgatgatgatgatgtttaaagaaaaagagaagtagggagcgtggcttccttgtgttgtgaattaacttgctccctgacatatgtgtaacttagggactgtatgctgctgggatgcctgaacagtggtaccagttttgtgtctggcttcgcaattttttccatcctgggcttcatggcacaagagcaaggggtggacattgctgatgtggctgagtcaggtacggtggtatcggtggcagtggtggtgggcactgccacctagtgtgtaagccaagtactgcaggcatgaagccagaccccagggggctttgaggggggacgagcctggtttctaaaatggaccccccccccgccaccaagatatcccccaaatttcaaagagtacaaagccaaattttaaacatttgtattgcaatttggccctgatgggtggcaaaagcatggggggtggttaagttggggaatttttagctaccttagtgtggtcttccccgcccccccgtccttccccagcaaactcctggtttccacaatagaaaccactttcctaactcaggcccaagtcagccaccaatcggcattccatcaccaccttctcagccttggtttctgtattttgcactttgctcccagcgtgctccctctaagcagacgcattcatccatcccaccgatttctcgtgaatgagtcccaactctgtgt

SEQ ID NO: 104793 - DNA, 1828 bp, Homo sapiens
ctacctggaggtggcaaggtcctgggctgaggctccttccaagccgaagggagagcgtgggggttattaacttcagggaccaccatagactagggccagacacagccggaggccctgccattccactgcccttgacctcctgtgccatctgtatttggaacatgaggcgatgtcccagtccctgagtcctagagccctagcactggggggtcagaaggtgcctcagcatcgcgtgtccagatgttcccttctcagatgaggagaccagcaacctgagagcaagggctttgcttgggataggtggggctacaacagggctttctgaacatcctgtccactatttctccacttgtcacacgctggacaggccttctgacacaagggtgtccccctcctgccatccagcccaccctggacacatgcaacaacctctggcccttccagtgtgagaatttggcccttgtgacctcccagagcccctggcccctcctcactgtcttctttgcttggcagagatgcacactgcccagccccatcctgagacccctgacaacactgcaggacccccttggcaaatccacatgtcacccccacacacctctccactgtccctgcttccaaagtggaccctcagatgtactgttccctccactgagcccaaagagcccccaaaagcaggccagagactgaggacacagaatgtaactccagaagtccccacgccccttagggagtttggcaattagagtggtgagggggagccagagatgatttatacctcctctgtagatggcttgctttcagctgagggcttgcaaaccaatcgcaattgagtgggaatctccaggagtatggagtgaatttggcaatgggagatacagatagatacatacaatgtatcttcctccatggacaacgaagtattttcgtagacacatatattgtcaatctcagttgttttttcctcccgtccacttcaaacaccttgtcatttattccccacggtgatgtctgaacagccggcacatcaagggtgattatttctctaataagcttttaacaagcaccatattgagtgaagtgcatttgaacaagataattatttagcctaacagagtgcaaacaagacgtggcatggcacattgtctgctagcagagaggcatccagaggttctcggagtggctggattatgtctcctggacttctctctcttgagttcaccatgcacttttagagaaagacgctcagaccctctcccagaggctcgcttgagaaaggcaaaactaaaatacagaaacgagcgaattgagaatcttcacaacgtccctggtgggttgggggttgtgggggcccattttgcatctgtcttgcagctggctggactcgattcctcattcagtgtggaccagtcagggccaacgctgatgttctgtagggaccagtggggccccggtctgggtggaaacgccgcggcttttgactccaacttcaactttgattcaaaagtcatctcaccgggtcctggggtccatatttttctgaacctggccctggttcttttgggcatgttctgagcagttttgggcttggtaacccccgctcctgatgggggtctccagcatctcagcgagcaaccactctgtcgctgcccaaggatatattttggtcaggttttctctggattgtaaaaggacacacccttccctggcacactgggggtgttaacaccgtataatgtggtttctggttccaatttattgtaaagttgggttttgctttttgtttttcattcttgagccattcgtctggtttctaatccctgctgaa

SEQ ID NO: 104794 - DNA, 1019 bp, Homo sapiens
atagaaactttccctttgcaaaggagactgggcggtcaggtcaccaccacgctcccccgcctccttccagcaaaggctgtccactcaatggctttgctttggggtgggaggatcctccctttcctttgtctctgcagaccaagccctgggctcagtctgcatcctaccccaaataaccacgccccgatggatgctggtgtgtgaggaggccacgtgtgctgtgtaggagacagatgctaaaaccgggcccctcctgagccccagcgtgtcccacccaaaggcgagacaggcctggtctctttccccaggccagagttcagacctggctccctgctgtatttgggtctgagtgtctttgtgtgagcccagggttcccagtggcttggtggctgatgtctcctcccctgtgcccctccccgttttctttcctttctaggtcctggcctggccttcattgcctacccaaaagctgtgacaatgatgccgctgcccacattttggtccattcttttttttattatgcttctcttgcttggactggatagccaggtgcgtataagggatggccctggggcgactgcccctgtggggaacctgactctgggaaagactccttattccacctgggaggtggtcaacccccttcccccctccagtcagacttccagtgcttcagctgtgagggttcctccaggacaccaggaatagaaaaagctctgcgtccccagaaagtgcatttgaacaagataattatttagcctaatggagtgcaaacaagacgtggcatggcacattatctgctagcagaggggcatccagaggttctcggagtgggtgggttatgacagggacaaccagggtttgtggttacagtcaagccacaaatgacgaattggaggtcatgactcaataagtcatgatgtgctccagtggagcgtcggcggggcacaggaggacatggcagatgggcgattcggagaagggacccacatttctgtgtgagctgatcattgtctggg

SEQ ID NO: 104795 - DNA, 1081 bp, Homo sapiens
ccttatcttccacgaggatggagatcagtgagggaggttgtcatggcaacacatatatgcccctgaatgtgccaggacagagggtcagcattggcttcagaggcgcagttgttctcaagctcagctttggaggatggggaaaggcattctggtggcaggaacagcctgagagaagatgcagaggtgtggaatatttggccagctcggtgtggaccaccgaatgttgcgttgtctggctccgaggagtggcaggcgggactccccaggcacagtcagggaggccaggcttccacacttggacttgatctcacaggccaattctggacacaaggatggtcacgtctgctcctgcattgtgtgttcctgggcccttccctccgagcagcaggcaagggtggcctgagcgtcagccgctcaccagctctctctcttcccctcctcagtttgttgaagttgaaggacagatcacatccttggttgatctttacccatccttcctaaggaagggttatcgtcgggaaatcttcatcgccttcgtgtgtagcatcagctacctgctggggctgacgatggtgacggaggtaggtggctctctcagctgtgtttcaggcttggtgctccagtgccctcctcaaggccatagtggaggcagcagctgggtgagagggccaggtaggggcttcatctcccagccccacccaattcaggggtcctgcttggaccaacactgggggtagcacgagggggctcaggagcccacagctgacccaaactacccaattattttgcctgttgctgtggcaacactgtgaccacccgctgccctctgtcctgggaagaggatcttcagctgaaatccatttcacaacatctctgttcacccctgactgtgtgcccttctcaggcctgggggtggggtggagacattctcaagggtaaacgcaggcctcccaggaaataccacagcaccacgtagaggtgcaccaccttgcaggtcacctgccacaggaccgagtcctggtgggtatgggttgatagggggcacatacactattcagagggtgagcaggggccaggagga

SEQ ID NO: 104796 - DNA, 1644 bp, Homo sapiens
cagttctccgaaaacccaattcagggcttcacttcaccatttttccttaccagaagtaaaagtgtttttctggaggtatttgtaagaacccccaccccagaagtcagattttagggccactcactgagcagctgggtgaccctggagtcttctctgtcagctgcacttggtgtgaagcacctccttgggaagcaggctcccgtggacccatcattttgctttcatttatctgtatgtgtgtttttaattacatttgtcaaacatgaagttgagcatctttttgtatatttatctggtcatcagagtctttgtccatttttctcttgggtttttttaatcttattgatatgccagagctctttgtatatgaaagaaattggagaccaggtaggaaatcgaccttctgtggtttttttcttcacagggtggcatgtatgtgtttcagctctttgactactatgcagctagcggtgtatgccttttgtgggttgcattctttgaatgttttgttattgcctggatatatggtgagtacagattttttcatgtcctttctcaaggctctcctttgggcttctctacttagaagcttcagaagcagagaatactaacagaaattcaatttgagttgaacagtaggccctccctacctagactacacaaataatctcactgtagccacactgaagatcctcctggtgctaaaggtgtgaggtgtgactggatgttttcacagtttcagaacttggttgtgcaggacctggaatactccttttttatctccttgaggccttgggtttgagtttgggctgtgcctaagattgcacacctagggtttggagtgtgcctcagattgccagaaaaatacaagatgcagagttatatttgaatttcatgtaaatgtctgtttttgccacacttgtatatccatggtgtggagatgcagaggcctggatcaggtcccagagaccccactcatggcccctgagctgctgctggccttgaacgctgtgtcagaaaatgtccccctctgtctcttgcaggaggtgataacctttatgatggtattgaggacatgattggctatcggcccgggccctggatgaagtacagctgggctgtgatcactccagttctctgtgttgtgagttccatttctgtggctctggctggtggcctcttctccctggggcttgacattttcacccgctaaaccatctttcatgcagcatctgttcagcgtgggcttataataaacccagcttcagcgctgcctgggagaggggaggaaggctgctccagggagttagcttgagttgagttttgaaggataagtaggaatttgtcaggagtagaaaacaagaagggcatttctggcagaggagccagcctgtgcggggccaaggcatcctaaaagaagagggtgtatctggagcatgttgagaaatccaggggatccagaattgaaagcacattctttccccaaaccttccagagcgcatgagctctgtttgggtcactggggaagtagaggggcctttgggatatctagtagagaggtcatagacattggaaatggggtgtttccatggagaggtgggggtagtagcttagagaggggaagtcctgggttctcccaaggat

SEQ ID NO: 104797 - DNA, 1053 bp, Homo sapiens
ttcttcccacgaggatgctctcgcccaccatgttggagttggccttggcacctgcccatgcagtctgcttcatggtcgcactccagggtgccagtgagtggaattcctccatggcaaagccgtcagggtttgcaatcacttgtgatcattggagcttattgccagggagaccacatccatcctgccattcacggctccactatggggagcacaaatggcccaatattccttggatttaggagacaggtgctgaggacaaataggccctcccctccgtgacctgctatcaggccagactaagtcaatgttgctgttaactcatgatatgacctcaagcaagtcacttccctctgtgagcctcagtttccccacttgtaaaaccaggagactgtgaaggaggaccccggtggcagctgacgaccttagactgttactgttatttaatatgcatatgaagccttttcctctgaagtgcagactttctcccacaaaaataagtaatggtaagagccagtaaccacaacaattggtgagtttatctttggagatgagtttagttggcccacctgtgttctcatcctggtttaatgtttgcttgtgggcagctcttctcagcactctgaccctcagtttccttatctctctccctgaggagctggatacgtcagagataggctgcattcccaggtggtgagatgaggtcaccctcatggagaggaatgggaaacaggcaggcactggctcaagctcctcctgcttgggagggcccagggcagcatctcttgggactcactcatctgagccacagccctacacgtagggacgggaacaacagcagggccagacgtgcagttggtgcccagtaaaagatgcctgcaggctagtgctctcccttgcccatcaccgactctgctttagaaagatgcatcttcctgtcaaatcccagttactaggtgttgaagagttaggccattttcacattatggaacaatcagaggccaccctgggccctcctcagagatgctgtcattctgactagaagcagaagccccg

SEQ ID NO: 104798 - DNA, 1159 bp, Homo sapiens
cactcgctttctggaaggagaggtatgggtggtgcctgggcaagtaaggcagacccagtggagccaagttaggatgagaagatgtgggggaaagagggccaggcagaggaaacagcccatgccaagacccagagttcagtgacagaggagctagaaggaattcttcagggtggctggagtgtggacacggagggagagttgaggcagatgagggaggaaggggtacagcttctgctgacactcccggctgcaccgaggagtttgggctgcatctgctggcactgggagccacagaagggttttgagcagggaaacgacttactgtgtttttaccggggcgggggggatccttatggcagcagagaggggtgtgagttctgagccagtcctttcccaaggagagagacccttccctcaggttgaggccagtcctagtcccagaagccccccaccccccgatgcccaggacccctctcctgactgcccccatctctccgcagggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtggtaagtgcttgggcccagggccaggggaggtgggaggcgcgaggccaaaggtgattgttgtcagtttgctgcgtgatctcaggcaagtcacctgccctctctgagccatagttccctcacccatccagtggttcagcttatgggcagcagagtgcattgtgggaagacgggaagcaagtagagttcacatgggagaaggctttatggagacattggaagccgggctgtggggtgaggaggaacttgccagatggagaatgtgagagggaaggtgttcctggtgttggcagagttggggtgggcagtgaggctggagaggtgactgtagctttggatgccaagctaagagctggggctttatcctgggaccagtggggccatgttcctgaagcggtgggacaaagccaggagcctagggaggaagcctgagccccacccagatgccttcttttattgaggagccaaatttaggatcatcccagcccatg

SEQ ID NO: 104799 - DNA, 1835 bp, Homo sapiens
gagaatcacagggaggcatattttagttccatagaagaaaaaaagcacatgaaggttgagtcccccatccctgtaggaacgtaagcaggggtttggccaaggaaggaaaccaccaacaggaattccgccttgagtcagggcctagtggcaccttaggagcgccttagttcaattccattatttccaaaaaggacaaaaacaggagatcagagagggtgtgagtttaccaaaaaccaaacagcacatgagccaattcaggaggaggcagatggccctggcgaaggggagaccaggccgcctgacgtttcccccctcactcctgtcatccttctccagagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtatgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggagtgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtctgtatcctccactgggggaagtgctcccagttcagaacaagggcagcccgtggtgctgacctag

SEQ ID NO: 104800 - DNA, 1119 bp, Homo sapiens
ctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcccctaacccaacgcccttgttgtaaatgaggtaactgaggctcagggaggcactgtgagccaggaatggattttcttgaaacagctctagctgcaggttctccgaggtaggtgcagggaatggtgagtgtctaaccagggctacatccagcaacatcctcaaggtcttcctgacaaccaaagacaagcctttatggaaaaggaaatgcgctcccctccatgttcagggatgaggggagcagcagcagccacactcccaccatcctcacagaattcctggacccatgcggtggctccgtgagctgggtgactccagcctcacctgcacaccccagccc

SEQ ID NO: 104801 - DNA, 1422 bp, Homo sapiens
ttgagatccctgtttgtgaaagagggaactgaggtgcagagaagccagaggtgtgccagatccttaggcaggatttagatgaagtcgccctggctccagactgaccccgaggctctgcggggagtttccaggcagcaggaagtggccttggatgctctccttccaggacagcataacccctgggccatgtgcagctccttcactgccccctggatccccagcatacccccaaagacagtggggaaacacaaggggagagcacagcatggcccctccagcccacttcagggcactcttgtatcacccgggtaccgccacactggtcccccacccagccagcatctcccagcacagcccctctccctggggaaatgctctgggtagccagtctaaaggcagaggcacctaactgctccccgcagcccaccccacccaagattcagacacaagccaggaaaggacccaagagaaaatccttcaaggtggcctgaggtcccatccctccctcagacccatgtggtcccaggccaggctgcctgggacacggtaaataccactgtgtgcaaaaatcgaagtacaaaaccacaagactaaacaaaacaaacccagagagccaaacttgtagaggtgggcagtccagaaagcagggggcagccctccccctttccttctctccctgatcctcagaatatatattgttgtaataggaagcatttttgcattgttctcttgtgggtgtcactacagacatgttctggcgtgttctccgagggatggagcatcctgttatatatttgacttcaaattgagatgttggcttcattttttttttttacccaattaatctcccaatccctagcaactgtgactctgtatttagcacaagagaaagctgagaatgtgggtcttgcctccttccagaaatatgtctggctcatcaggacatttttttaaaacttcaaaatatttttaagatattttaaacttttataaaaaaaaaatcaaccaacaagagacttttctgaggaggaacatttgtatttgaacaagatccttggtgtgtagttcagtcttgcagtatacaagcttttgtgtataaatgttttatgatatgattccctgtattttgcaggggtttttttctcttttgctttttagataaatatgtatatcaatattttaaattcatctttgctttttttagaggagtttgtaatcaccttataacatgaaaataaacatttcctttttaacatccaacatgtgtgggttgtgttctggtgaggtatttccccctcaacgtttgccaaacgctttacattttataaagggcttcccgtccaatcccaggacgctcctcaaaggtaggtattttcccaggttagaggttcccacatggaggctcacagaggaagcagcttg

SEQ ID NO: 104802 - DNA, 1006 bp, Homo sapiens
gggtggggcaggacacttgctggggctgtctgtctgaccctggccactgtcctgtagcaggatggctgagcctcccccagggctgtccagcacaggcaggcagaacaggcgggtctggaggttccgagggcagtgctcagccttgtagggggaaggctggtcctatctgggtgtgagcgaagccttttgcccaatctcaggatctgcacagctgcctggtgggagtgagtgtccgacccagaggggtgagagcccaaggcccatgggcaaggtggtggtgaggagttcctgtgctggcacagctgggcaggagactggttctcggcaggaggagaaactctggtttgggggtctgactggtgagcccctggggctctgggaatgtgtgggatgggggatcacagctgccacattcctgggtgtgctgaggctgggacccaggggaggggcagacacgattgttccatctgtctctccagcctcagcctgggctcaccctattcctccaaagagggagcttggggcctggaccagaacatactgcattcactgccctggggttgcctcactggtttcttcccacgctcttgacatatctttgcaccacagctccaagggcaaggactgtggtcccagtggacagaggaggaaaccaaggctcagggagggcagtggccgagctgggattgacaccccgatgacttttactgcagagcccccagccctgcttctgagggcccagtggactttgattcccacctcccttcccatggcaaggagcagagccaggtcacctctggacccagccttagcgacccaggaaaaataacactcataatcataatagctggctgttgtcgagagcttcctctgggccaggctcttttctaagctttctgtgcattttctcatttaatcctcataactacactgccacttgggtactgttattctctccattttgcagttggggaaactgaggcagagagctgctaagtgacttgtt

SEQ ID NO: 104803 - DNA, 1051 bp, Homo sapiens
aggtgacgggttgataggtgcagcaaaccagcatagcacacatttacctatgtaacaaacctgcacatcctgcacatgtacctggaacttaaaaaagaaaaaaaagaaataggaggagaaatcacaggaaactggctatctggtctgaaatcccctccaaactgtgtggcctctggtgagttcctgaactattcctcagttttgttatctgtgaaatagggatggtgatactaaaaatacctccctgataaggttgttgtgcagattaaatgagtcaatacatgtaaagctcttggtgcctgactcacaggaggtgctatgtaagtgtttgccactatgattagttgtattaatatcgtggaaatgggaggggcacctgaggaaccacggctgcagggaaagcagtgccagctgatctgaaggcctccttggttgctgttgtcttggtggtgcccagggtgtgttccccactgcaccctacggcctctgagtgaatctcagcatgaccttgtgcgggaggctgggtgaggactgtaagagctgtcgcaggcaggaaccaagctcagccaagcttattcaccaagaggtggcaggagctcagccccagcctggcctccaggcccccagccagcgctccctggggagaggagggagagggctggtgcacttcccaggaacctgccggcctttggagggggccaggcacaacttggtctggtgagggaggagatgctgagccaaaccactggggtgcaggaaggaactattactacttatctttctttttattatctaaaattataaagaaaggaagctttactggtatttagtatatggattgacaatggtacatatgttcagtttacaagtgcgtacacattttgggggcatatgttcccaaatagttttatcaataggagtgagagatcacaaaagttctgaggtccctgtgcaagggtaatcgccctggtgccagtgggctctctgggggacatttgcatgcaattatgcactgacaatcactctgcaattactgcaggacccagcagag

SEQ ID NO: 104804 - DNA, 1034 bp, Homo sapiens
ttttgttggtagtataaattactttccttgttacattgtaggctctttgaggcagagagtatgtctaattcatgtttatgttctgctcttcagcgttatttctacagcatttcactgtagaaataagttgtgatgatgaaatgagtgcagtgctagtcagagagaaggtgcttaataatgcaagtttaatctgaaactaaaagatgcagactttattaatttattttgctttatcactttctccttgcctaaggaaagcctcgagtgttgaaagtcagagtaaaaatgcatttgcagcagaggtagaatgaaacatgacttagcttaatttgtgtactggattctacatttaaacatttagttacttaaacatttagttttttagccatatttgtccatttagcggaacttgaaatattcctttggaaattataataatttagcaatccagtcacctgcaggaatttaatatttttgtttacttactgctttcattctagttggtagatcttaaggctgaactcttccgaaagcaagaagaattcaaacaagaaaaacttctaaaagattctggagtttttggaaaaccaaaaacaactaacaaggtaaaaaataagatctaattatctccattggttccaaacatgggagaattataccatatttaagtgttttaaaattgtcagtggtatctgtacacataaatgttaaggaaaaatctctatcttgtatttaacatctgcatgaaatgttattaaaatagaaattagtaagattatataaaagtacatagtaatgtgctaattctttagcacttcttttggaaaaatgtggattgtttacatttcataaacagatggaaggttatctggttctataagtgttaggtatccaaatagagataaacaattagataatataggaatatagcggaaaatatcagggtgtataagagctgtgaatttttccagttttataggtaatagtgtctactatttgtattactaattctctgtaatatgtacattttcatt

SEQ ID NO: 104805 - DNA, 1050 bp, Homo sapiens
ccgaggcaggcagatcacttgaccccaggagttcgagacccgcctgagcaacatggcaaaaccccgtctctacaaaaaaaaattagtcaggcatggtggtgcgcacctgtattcccagctacttgggaagctgaggtgggaggatcacttgagcccaggatgttgaggctgcagtgagctgagatcgcaccaccacactccagcctgggtgacagagtgagatcctgtctcaaagaaaaaaaaaaaagttatttatataattgagggctctttttttagctcctgcttgccatgtatagtcagtatctttgtaggacacagcttatctagttatctccattgattcataagaactcatgatctcctttgtttttttttttcctgatgcacaagtagagattttttggcaatcatgtggttctgttttgtcttctaaaattattctccagaaaccaagtatctggagcaaacagaatgtaggcgtttcaaatcgagctgagaaggatgctgaacagaagattgaagaacagaagactttagacaaagcaaggtaaagttataagctctggtaaatatagttagctttgaggctacccaggcagagaaatggaagttcaaattttgtcctttttgatttacaaattttatttttaacatccttctagcccaatgctctaagtactctaaaaataatataatttgcagatatatctgtagtcttataaaaaggtaaaacatagtcacagtttataagatgaaacattcttgctgtcagcctttgttagacactaagattatcaatacatttttaagaggttttcccatggtgtgggctaggtgggatgacactagaatttagaaaccctaaacttcccccccaccttttattttgaaaaacttcaagggtacatagaacattctaatattcttcacctaaattccccagttaacatcttgtcacatgtgctttccctctctctctcttacacacacacacgcgtgtgtagagagactttaagcttcatactttccctgtaagtcgttcagcct

SEQ ID NO: 104806 - DNA, 4370 bp, Homo sapiens
atgcagttttgcttccgtatgatgtaattggttggatgagttgcataaaatcagactgttgtgttatcttaaaatgacattctaagatggttttgctcactcaggtagtgtattgatgaggcaatagaaaactttaggctttttcaagatttttttgtgtagtatatgtcagttcccaaggtagctgtgtgtctttgtaaacatttggggagtggaggcattggctgatgagctgtcaggggtgatggggccaccaggcaatgaatgtgactgcttcttgtccattccatgtgtgattttcctttttgatgtctgaaaactgatttttatgtcctagatgaagaagtagaggatatgtaccttgtggatttcacacagaagatcatagacaagcgcaaagaaatggaggcatctggtgcccatagagattctcaaaaggcaggagaaagggacgacgatgaggaaaaccttcctgagggagagatccctcctccccaagaccccagtgaagaatggttggtaacatcatggattagctcagaggaacatcctcagacttgcgctgacattttgggagtgattttgttgggttgttatcgagccatttctctttattcttcctgggtgttcttttgagacttccctttaagttaggttggattaggttattatagttgtaaaaacagtagctcaaatgaagacataattacaataattacaataattacatataattacaaatactgactgggcttctgctgtgtgcccagctctgtgccaggccgaaggaaacccagtgcctggcagacttggcttgcctggctcactaacatgaaacagtgagggcagagcgccttccttttgtacctgtgctgctgccttacccgtgttcttgttctgacatggtggagagctgtcatctaggagaaggaagccggcagaggtggcacagtgtgttttactccgcctgtgacattgtttggcactgtggtgtggactcgtgggccttggatggttccatctgcaccttttactggctgtatgatcttaatcaggttccttagtctttgaggctcaggatcttccattataaaatagagattataatgcctcattcccatggccctttgctttaacacccccccgccccccttcaagaagtaagtgttccaggctacacaagaaagtgcagcctgtggagtataagcaggcattttgtaaacttttattattgtcattttcctgaattttgcctatatgtagatgaatgatagaagaaccaaactcgtcttttccttaaagagactttgtatcaataagtagagagaccagaatgggaattctgttacaatgatttttttctacctaagatattattgtttggaaactgttcagcagtgcttgaaattgctgagagctgtactgatgctctgacaatttcctgggaacccatcctcttgcctttgggattcttcttatcctcctttcaaggctcaaatgtcctccttgtggtgggcatttgttaggaactgctcaggactctttgtagcaggcgttcatcttttgtcagcctttggccttgtgggcagtcattgatgagctgaagagagcagtcccagctactgtggatggcagagaaactgcatcttcattctactgagggtgtccatgttggtttagaaataacattctcattgggataaaacaggtatctttttacctactgtcttaaaaacttagatctaaatagtttgataccatttggaacaggtgtcagcctgcaagctataagaaaccaaaagagaagaacatgcagtctcttcttttggtgtctttcttcatcatttctttctttcttttttatttatttgtttttgaggcagggtctccacactccgtcacccaggtgggagtgcagtggcatgatcatggctcatcacagcctcgacctcctgggctgaagcaatcctcctgcctcagtttttaattttttttgtagaaacaaggtctcactatgttgcctaggctcttcttgaactcctgggcttgagcaatcctcctgcctgggcctcccaaagtgctggtattacaggcgtgagccaccacgcctggcctatcatttctaatgtctaagtgattgctccctcatctgaagtcaggtagcacttaatatacttcctgctcttcgggtattaccttttatttattactgacacatactaggcctcattatcagaaaaagattttagcaaacttttggtagtctttacgtacccagtgttgttaataagcgtttcatgggtgtgtgccttaacttccctagacccttggaagatggcatggctgttagccctcttgtattactctccttgcctggggaaagctttgtttgcctgcaggggttgctcagtgggtgattgctgattagatggagccgtggctgactactgtcttgcctcttctatttaatgagatctgtatgttttggaggccttctccagaaacagaatggtctatgattgcttttcatagcagaaatctcatctcctttgaaaggtctaatgtctttttaaaaatttttgcttattaatgcctgtgtgattacaagcaatttgctagtgatttgaagagtttggagggcaattgaaggtgtcacatgccaccatatggtgaaggaagacgctctgcaagcagttctgacacatttttttgtttttaaattaagctccagaattgtaattgcttgtaaaatccttttgatagttaaattccaggtggtagaaaatctttccgtaaagatactgtaaataattacacagaccatctggctagatggttttcttcccccatccatttggggggaaaaaaaggaagaaagaaactgcttgctgcagttggaggttttatttcttgtgataatcagcttcagtactagagtaaacactcagtttttaaatcacaactaacaattgaaatcagcattgcttgagaggaaaaaaaattgctaacaaaagcaaagccacatacctgccaaatctgaccttgaattggtctgccagctagtacttattggaccttactgtgtattcggtaccctgctaaaggctctaggaggttctctgcccataatttaaaaagtaaaatatctgttgcgtcataatacaaatgagatgtttttcatgaacatctgtccgtattttccattgtaggaagtcagaatatttcactttgccttgctatctgcctggcttagctgtctgaccactgtctagtttgagcaaagatgaggagagaggtatggtgtttggcttcctcctaattaagaagagtccaactctgaaaaatactgtgcatttcttacattaagagtttgctaatacattgggtagaattataccaattagaggaaataagagaaagaataaaaagtcagacttgaagactgtgaggaaatgagcaagttgagaatctcaggcacaaggcaaagttattaagatactgataaaatgtctggaattgtctcaactaggttaaagtaagttcgtagatgctgcagcaaaattccgtgtgggtgatttatctgtgagatcaaaggcataaatgatcaaaattattgttaacagtttctaaaactaatatttaataaggggcacaatgagcttattgtgtgtcagctttaaaaagcatattcctatcagtggtagtggtctctgaggttgggggctcttcttggtagtgaggcctatcttcccccttcactgttcacctactccctgacttaggggcttgtacatgtgtacaagtccttcttcacatctttttgctttcatttcagggtggattacgtggactctttggggcgttcccggcgctgtatgagaaaggatttgccagatctgctggagatggataaaaatcttcaggggagactgtaagtgtgtgtggtatacagagctctgccaaggtctgaaatgcagccacagggattgttttgtgaggggaggctgttttataattaatgatctctgttgctccagtaaggagatattgattgattgattgattgattgaagcactttttagtggttagcatgcacatacacacataatccacacttggggaacaacctgactggtggatgagtagagctgtctcttttacttggaaggatgtctgacaacagagtaacagaataaacccaaacgaaaccagcaaaccaggctttgtggagacaagtggtttgagaatatacacttgattatcccacaaacaagtggctctagggagagaacttactcactttttctttatgtatcattgcatttttgaagtaagggccttataactagatttttcagcagggcctaag

SEQ ID NO: 104807 - DNA, 1036 bp, Homo sapiens
tctgccctagatggtcatctagtcccaggcttcctccaggcttgctgtttctgccatttcctagagtatttttctcttctgcatagtcaaagcttgctcccctgctcacctgttcatgatccagcctaggggtaggcagggagactgggaaggggagccaccttcctttttagagatgtgagtgggaagttacatacagcctatgcatttacatcctgctggccagagctcagtcctgtgggccacacctcactgtaggagaagctgggaaatggcctctccagcaaggtggccacatgctcagctgcaaccggggggcattctgttacccaaaggaaaaggaggagtgtgggtatgaagggacgtatagctctccagctctcacaaagcttatgtgaagccatgggccatttcctaatgtctgaacaaaacagaccagaaacatttaggaatttgaaaaccatctgtttagtttcagataaatgctcgctctataacatgttaagctgtgcagattgtttctcaaattttgctccatctcctgaacatctgtcatgtccagaaaatgtgaagcgccaccacagtgttttttaaaaatccatttttcttttacattttaaaaatgtgaccaaaattgaacagcctacaccagaccccagctgttcatccccttggctctgcttgcttcgcctgagattgtgatgttagttgagtgatttggggatttctggtcctgcaattgccagtttggagaagcagagtggcatagtgaggggcacagagactaaaatccatccagcccagcccaggactccagcccgtatcactttctacctgtgtaccatttctgagcttaattttccccctctataaaatggggataatatggaagtattgaatttattaggattgttacaagaattaaatgacctgttgtatacaaaagacttaatccactgcctgggacatgttaggtacttcataaatactgatggttacttttactttcaggattagcatgttctgtatttttaaa

SEQ ID NO: 104808 - DNA, 1040 bp, Homo sapiens
aagatgatagccttctcaccactgggtgggcacacgagctcgtggctgtgagcctgccctgtaaacatggaaggtgggcaccaggcaggccatcctggaatggcgaacttggggtggctccagagggtttgaaaagggaaagggagcattgtctagtggaaaagaagacgtaggtgtgttggctggagtggttgtcaggataaaaggtggtcgaagagatggttggacagctgcactcactcacaagtgtggtcagaagccttgggccagcagcccttcctggtaagtgggctggttagggttgttggagttgggcaacaggaacaactcgctgactctgcatcaagatgctggagatggccatcagcatctaagtctccctggggttgacctttgctacgtgctgtggattcttgagtctttcacggaggctcacactctcataaagtcccttgggaattacaagaaacaaatcatttttgtgtagcataagatgtgactagttttaatttgatatattattaaagactgctatcaggttcattttgttcagaaaaatgaaactttcaggatctggttacaaaactctgccagtgtatttacaggtttttctagccatttttttgcttattaaattgttctttatgcttcctttcttcaaccagtggtctatttttggtataagttaagaaggtaagaataaaacacaatgtagaaatatgtcagggtaaacattactgtagtattaaagtggaaaaatatttattatagtccattgattttcaggcacattttccaactttaacatctctgaaattgtaatatgtcttacagtcaatggcagcttacattcatttttttcttataagatggtgcatcttttgatcactaatgtcttggatttgatgaaatttggcaaattatattagtgattgagcttagtaaatgcattgtcctcattctttcctgtctgccctcagatgtacacgttggataattccatgcccatcttggcattgcgaccaggagcttctgcatcc

SEQ ID NO: 104809 - DNA, 1048 bp, Homo sapiens
aactaatgatgtctgcagcgaccctatttccaaataaggccacgttccggggtcttggggtttaggacttctacatatgtatttgggggacatgtgttcagcccacaataccacacatgatgacacatttcctttgccccctgtcatctctcctgtggtcacttacggagccctcccgccccaccgcaggcatttgctatggtcagtgttgggggtgcgagtgtagcagcatttgggttagggctaatccagcccaaaatagaagccagggaagccaacctccagcatgtcactgggtccccaaggaggtcagagtctcccttcgctgccctcaggaggagaagcacttgtgtccttgtctgtccaggctcccagaacactgatgggacagcgtgcagtgcaccctgggccctgagcactgcccccgaccctgcctcccctgcagtgttcccaactctgtcctgagcctggaggattctgaatcagtcaagaaagccgagtcagaagatatccaaggaagcagctcctcattggccctggaagactatgtggagaaggagttatctctggaggctgagaagtaggtgaccacatcagctgccagaatgggcgtggctcacagcaggccacctcggggctatttggccttgggcaagtcactacccccaggcgtggcctgggtcatgtccaaccatcgctgacatctagcccatgtaatcaacacaatattgggcgggcatgcaggctgccctggagctgctcgcagtggtctgggtggtagagatggaggccttttgtagactttgcagcagaaccccacagcccagacccattagtctgagaagggtggagactgccccgctgtctccttgcaagaaacttgctgcacctgttaaaggccacttacttgctggtgctggtaaccatgaaatgaatcacacattcggcatggcgtggaaatcacatatttctcatgaagatagaaaagcaaaattaggagcatgtagaaaggtcgcaggtgccaccggggccctctggttggaacagc

SEQ ID NO: 104810 - DNA, 1102 bp, Homo sapiens
gtttggaatggaatgctcattaggagaacctcagaagattctacccgcccggggcagcagctcatgagtgcttgtgcattgcagacagagcagttaaggattctgctccgccagcccagggttgttacagagctgcttatggttgaaatgcagctcgaattacatgcccaggagtttgtgtttgggccacgttgtgcagcatgcgtatgaggagagggagcaggaagacccaggagagtgaatgtgttggctaactggtgatggttgtttgtgaaatgactcattttgggcaaggattgcatggagtgatgtgtggaaggagagagagggggaccaggtaccactgctggcctcagtggactgagagtctgggggtaggaagaggacttagacccaagtcactgaaatgcaaggtagaaaaggcccaggacccaaagagtaggagtccagaggcgggcaggatgtcttcatggacaaagtggcacttgagtagacattgcaggaaaagtaggcttttgacatggaggcaggagaaagaggagagaacgtacaagaaataagactccaatgaaaatgtcttccttcattcagaaggtacctcaatacctttattctggaaaataggtcacatcatctgcagacagggaggaggattatatggaggagatggggttgaaaggcttgaggactaaacacaaataccatctctctctcatttctgagtgtaacagtaggacattgtgagtgagcctagccagttccctcactcagtccgctagcgttcccggagtatctgctggttgtctgtgctgttctaggtagtagaggtactcaaatccctgccctctggagtttttaggctggctgaggagaaagatggatagagaggcaattagagcctagggtgataaagtgataaagcttggttagtggtatatccagttggctatggagtgggcagtaggggagccttcagtatctgtaggacatttgaggtgggtctctttttttttttttttttttgagatggagcctcattctgttgcctgtgctggagtgcaatggcatgatcttgactcactgcaacctctgcctcccaggt

SEQ ID NO: 104811 - DNA, 1036 bp, Homo sapiens
ggcgtgagccactgcgcccagctcccagggcgcttttctaacttcctttgaaactcacagcaaccctgtgagttggaaggacgggattcctatcccaaccagacaagtgaagaaactgaggctgacaaaagcgaagtggcttgtccagggttgcatagctaggggagctgggatttgaacctgaatgtcctgaccctttcagctgtaacatttctcacatcttaataggcattaaaaaaaaaaaaaatatatatatatatatatatatatatatatatatatatatatatatatatatataatgcaggtttccaggcccttcccctgagactcggattcactgggtgtggggtgttgctgcacaatctgcatttgtaacagactcccccaggcactcccagtttcccccttagagaaacactgccctgtaccgtgtggcttcttaactagctgcgtggaaaagtcacctccctttggtcagatccattccaggaatcttggggccaagctgaaggcagaggagaaatagccttgggacccgactgacactgctgtgtttgtgcaaaggaagggatagggagaagggtcccttggggacagccagaccagacaggcagaggtaggttgcggtgctgaatatcttgcctgtcagtcagctttggcataaaaccctggctgcatagttcactgacagtgtgactttgggctagtcacttcatgtctctgtgcctcagttttctcatctatgaaatggagctgataattcctatctcatagacttgttaggaaagctaaattggacaatgtctagaaggagctagcccagtgttgtgctcgaatcataagccccagtctctcctcaatagactgcactcaaatcttttttgttcctggaaagtcttgccctcatctctcctcttaactaaatgctgctggtctggtcaggtgcagtagcccatggctggtgtcccgttaccttctaaggtgtgcaaggaagtccctatgcctcggttctggagtagcagggaaaggtggc

SEQ ID NO: 104812 - DNA, 1080 bp, Homo sapiens
tgtttcttggggctttggcttctgttctgctccattcatcctatcccattaggtccctttgggccatagcagaactgcagaactacctgttctttgtcacaatcatgtttagactgttttgattcattcatgaatcaaggatgcattgattcagtaagcttttgccctgtgttccaggccttttgctgaatatagaaaacatgtttgagaaacaaatacaattacgacatggtccttgacttcaaactaagaggaatctactagtccagtcttttctaggttctgtgaccagagtcataggcagagccgcaaaaccaaatgtcctccctgttttgttttataggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtg

SEQ ID NO: 104813 - DNA, 1223 bp, Homo sapiens
ctgggcgggctcccttcctccttatcctcctcctcctcccgcctgcagtcccttcttccttctctgccgggattttcacccctccgcttctagtccgcctttggcggccgtcgcagcccaaccgccgttttttctgaaggggagggtaaaagaaaaggaggaaggcgggtgcgaggcgcgacctcgtgagcgacggatgggctggctaattggcgcccagataggagggccggggcctgtggcaccgcccccctaagctttgctgattggctgaggcggaagagggtggtccttatggggcgcgggagccctggcggggcgggagtagaggccggggcgaagagtggggccgggtcggcgggggcggggccgggggcggggcgcgaggggcgcggccgggtggagaggccggcgcctggtcttgggtcagcaggtgggctgcttccctccgcctggaacgcgtctcgaatgagtactgaggaacaatagtaataaaggtgatgaagcatttcgagtccacgatgcgctctcgtgggaagaggttttcggaaccaggacacttttcagggctcctgctcgttatttcgcagcggccttggcgaatcccctaatgaggctcaattttatcgactgtaaatggggggcatgcgcattcttgccaggccggacctcccttctgagcattgtttgtggggctctactcagaaaatggaggcaacgctactttgcgagcttcagagtcacttgaaaatggtgttattgttaaaaatgggattacagccaccaggagaggcaagcgttaagggtatttggggtttgagagagcacaattcgggagtgattctcttctcattcgttcgctgaatacatgttgacttagttttttaggcactggggacacatctggagaaccagctgtacaagacccctgccctcactagagttgggggctggggggtgaatagacaaataattccagagagtcataagttctgtgaaagaaaagaagccaaatgacctgctgaagaagacctgaggcgttaatttagatggaatggtcagggtggcctctctgagtaagtgatgtttgaacagaggaacccaagggaggaatggcattccagacaggacatcccgtgtaacggccctggaggaagagcatttgatgtgatcgagaactggctgcttgtggctggagagttggttggaactagtaattgtcc

SEQ ID NO: 104814 - DNA, 1322 bp, Homo sapiens
taacttaatggatacatttgtgctcctgttacacattgtaaaagatatgttcttccttattcgttggaggtttgcttgccttcaacttaatatgccagaggctgagattctctgtcattctctcccatcctgccactctttccccatatcccactattgctacccgaggtagcagtcctactccccttgctcacttcaggtcctgagtgctagagagtaaagcagcaggagctctataccaaaaggaagaactgcccaagaacaacagctcaactagcacagctcaacaatgatgaggagtgggaatgactagagggatgaaagccagatcagggcattggcgtaggcatttgttaaaggtacaataaatgcagatgcagacccctggtacctggaagtcttagaatagaaggatgggaggtgaattgttaaggacagaaagggaataggctagctcagacacttaactgttttttctgtgttacccttggactccagttggcctgtaatgatgaaagtcagcctcagaggcaagtgtgattttttaggggcaataaaaagtacctccttcactgtaataagaggcctgaagtcctttaataggaggtgaaactttctattccataattattaacagttacctcaaagattctaatccctgaaatgttaacatgtagatggagaggaatttcattccaagtgcccaagtgtaaaagaatatttcccccctgtttgcgttagtgagaggtgtgagaaaaggtcttggggcctggaaaatggggtgactgctgctgaaaagtgaagagaaatgagaggctggtagggctagactcaagcctgaaggcttcctggttttacagggagctgctttatttacctttgttgttcatatgttgataaaagctatgcaggggaaaaagtttcctacctgactgcccacccatgttccttaaaaagaaagattcacgtatggccaggcgtggtggctcacccctgtaatcccagcactttgggaggccaaggcaggcggatcatgaggtcaggagttcaagaccagcctggccaacatagtgaaaccccatctctactaacaatacaaaaaattagctgggcgtggtggcaggcgcctgtaatcccagctactcgggaggctgaggcaggagaatcacttgaacccgggaggtggaggctgcagtgaaccaagatcacgccactgcactccagcctgggcgacagtgcgagacttcatctcaaaaaaaaaaaaaaaaacaactgaggctggatggctcttgagaagttacacaatactagcgggcttcatg

SEQ ID NO: 104815 - DNA, 1061 bp, Homo sapiens
tttacatgtgtgttctgtgtgttcagttagtgaaaattcatcaaactgttcatttacgatttgtgcctttttttgttttttgagatggagtctccctctgccgcccaggccggagtgcagtggtacgatcttggttcactgcaatctccgcctcccaggttcaaaggattctcgtgccacagcctcccgagtagctgggactacaggcgtgtgccaccatgcccagctaattttttgtattttagtagagacaggttttcaccatgttgcccaggctggtcttgaactcctgagctcaggcagtccagccatcccggcctcctaaagtgctaggattacaggcaggagccaccgagcctggctggtttgtgcccttttgtatctgcgtgttgtagttaagtaaaaagttttacttagtaaaattgttctcactattttaattaatgtgattattgtgtaggttaagttttaagggaagaatgtgttcaaagttctaaaagaactgccatggtactacctgggtggagcagcctcagaaatttctgttagcaatactgaaacataagtcacatattacgacttagtggttgtgtatatcagttattaaatgatctagcttattgatgtaagcaatttttgttcccttagataattctttcctgtcacttttttttttcattctctccttgacttccttttttctgggaaattattttgaagggcactgtgatctagagggaatgttgcgattttagagtcaaagaggcctcagttggaatcctagctccatcgcttagtagctggatgatttgaaacgagttacaagtgctgagtctcagttttttccatcttcattggtgagctaatattacatactcagaaggtatgctaaggattaaatcatgcctagtttgatttaaagcacattgtggatgtcaagagaatttatcctgctttccttccatccatctaccctggctcttactgatagatatgaagaaagtccacatcacccttacacttgggctcttggtaggataagaaaaaatcatccacagtat

SEQ ID NO: 104816 - DNA, 1048 bp, Homo sapiens
gcttctttgttgttggtggggtgatattgatccacttggatttgaaagaatttcttataaaacctgtcacataaggccaaccaagtatgatttactactatcattctatggtctgtattacaattttttatttttttagagataaggtctcacgatgttgcccaggctggatatgaaatagtttttatatactgtgccctgttgtcatttgtgtgctatcgaggaaaaacacactactttaagaatctgccttcatctctagactttactattgctaccacttcctaactggcctcccatctacagtctctgtcttttctatcatttccacactgcagtctaaatttttttttttaagatccagatttgagtgcatcatttttctgccaaactcctgataattctctgttgtctacagtgtcagcctctctccttccctggtctctgtaataattccacaccacattgccattcctcaaatatgccactcttcctcatacctgccagttttgtatgagctgtcctctctgcttagaactctcttgtcatccatctgtctttccttgctacatttccattcttccttcaagacctagtttaaataattcctctcctgtaacgttttcattggttctcacaggcagagagcaatgtgtcttcccctgggacactcatagcatttgctttgcatagatacttcagtttccttcataagttcatcaaggacaaggactgtttattctcctctttctcctccttgttgttgttaattctcagcagtcagttcattgcctagttcatagcagttacttaataagaactgatggaggtggttggacttgattagtaaaatcaccagaggaagatcttctgtagcactttttttttttaacttaaggtactcagtattatacttcttttggcagctaatcaggttctttcccctaaacattattgtgggggtggggggcaatctttgaaggttaacaagctgaatgggtgaagtactagcctttaggactcaggtttctgtaccaagagcgagttt

SEQ ID NO: 104817 - DNA, 2294 bp, Homo sapiens
cagagcaagactccgtctcaaaaaatatatatatataaaattgtgctagtgaagatagtttttcaaactacatctagacacaacccactgttccttggagcctcttattctagtgggacatctcctaattgataaccattttctggtggtactttttcaaagatgtatgaccttctcactgtgtgatctttctgtctctaggaccgcctatggctgcggtagcagtgagagaagctctcaggtgagagtcttataccctgatgttaccttttttgtctgggtgcattttggttaaatgtccacgctgccccacttccttacattacttgaagattctgttttacttcttacattgtgatatcctggaagaaaaagcctttgtcttccttttttatatgagaataggctatatggtttgtgacttattttcaaaagtaatagaaaatattttttgaaactacttctctcctcctctgactggatttaagtctttattgaaagcacttgctttaacatagtttctctttcaatttctctctcactcttagtctcatttttttgtctctgcttgtttttccagaaggtgcacattcctccttgttcatttttaagcagcttccaaagctgctgttgatgatgcctgatgctgctttgaaggcagaaaaccaacagtgagatcaagaattgtaagaattcaagtgtataaagaaaggttgctgctcaattcaagtgtataaagagaggcgtttaagatgatccaggaagttggtgtgggagaacaaggtggggggcacttgtcctatcagagagcaagacttacgctaacactgcagtaaaaagatagtggtggtgaccaagagaaagacacagagaacttagtggaatagaatagagaacctacagttatatccacatatataggaaaaacagatatggcagagatggcatttcagatcagtggggaaaaggatagattttccccatatagataatccattttccagaactatttcttgaatagaaaatggtaaatggattatctacatgggaaaaaaattagttggatccttacttctcatcagattcaagaatcaatttgcagatggattgaggagttacatatgaggggaaaactggaacatttctaagaaaatatttacagttacattcctgggataggacaggattttcataaatgaaagtacaaactgtaaaagaaaatagggataaatttagccttattaaatttaaggacttctgttcatcaaaagacaccttaaagaaagtaaacagatgaaccacagagtgggtgaagatatttataacttatcaacaaaaaattaatgtccagaatacttagcttttctaaacttaaacagatttactgctgcttctctgtgacttcatatctgtagtcacctgttgttagatttatcttgggatccccagccctacctgaagttgattgatcctgcaaatttaaagtgaattattacagaaataattctgtactaggcctctattaaatcagattgtcatctataaaatccacttttactcataatttgatgtatcaagccacctcttttagggaacccaatagaaagatacacctttctagtactctgtttctatactattcaataatattttcctaacaatattcctgtaataattcaaattcacatatttcttacattgaactatagttaataacagaggagaaattctgttgacatctaaaagtgataaaaattattagttgcagccacatgtttagatttattttttaatgtacagtacctattggctatccatttctttaaaaattcttattttctgttttgaggaagaatcagactctagacttttacatgcaatacttgtatttttaacaagtcagttgacttttctggtagacttaaagacgccttttccttccatctccattagttgtaaccaaactatagcaagaaaaaaagaccaaaaggtatctttgtgtttttttcttgtagaaacaagtaaaagttaagtttttaccatctattaaaacaataaacttatctcctcagtttcagacctaatcatattttgtgaaaatgagtaactgatactggtggtctcatgtcattgtagaagttggtgcagtatctgctgtcacagaattttgactccttgaagacaggagccaggtctttcatatttgtcagtcacagtttcatcctcctgtttctttctcttagcattctggcaataaaatatgaattagaattatcataatagaggtggctatc

SEQ ID NO: 104818 - DNA, 1077 bp, Homo sapiens
ttaaggacattggaataaaagttgttatattcagcaaatactgaattttatcaaatgctatttttaaaaatttttttaatttttaattttgtgaatacatagtaggtgtatatatttgtagggtgcatgagatattttggtacaagtatacaatgcataataattacatcagggtaaatgggatatccattacctcaagcattcatcatttctttgtgttatgaacattccagttgtactccctcagttatactgaaatgtacaacttattgcggactgtaattacgctgtagtgctatcaaatattagatcttatttattgtatctaactatattttgtacccattaaccatccccgccactacccttcctagcctcggataaccatcattccattctctatctccatgagttcgattgtcagatgctctttttttttatgatctgagatgatcatatgatttctcttttttgatcaggtaatgtgaattagcttgactttgtaatattaaacccatcttgtattctgcagttaatctcaacttgataggttaatctggattatactctttatacacacacacacacacacacacacacacacacattcttagtttgctaacattttgtttagggattttgcatctgtgttcatgagtgagattaacttttaatttttcttaaatttatgctagcctcataaaatgagttgggagaaggttcccttttctcctccctcctataataatgtatataaaatgagaattatttggtccttaaatgcttatagaacacaccagtaaaactgttggtgcctggaaaaatttttaactactgatagaatttctttaatggttaagactattcggattttttagttgtgattgactcagttttaataagttgtaccttcttcaaagaatttgttcattttgtctgagttttcaaatttattggcatctagtttttagaacatccttgttttgtatttttttattattatatttttttatttttgagatggagtttcactcctgttgccaaggttggagtgcaatggcgcgatcttggctcact

SEQ ID NO: 104819 - DNA, 1059 bp, Homo sapiens
ccacatctatccctaggcaaccactgatcttctaattgttttagatggatttgcgttttctagaattttctattaaagaaatcatgtgtccactttttttgtcttgcttctttcatttagcgaagttatttgagactcatccgtattgttgcatatatcagtatttaattcctttttacgttgtatccattgtatagatatgcttaatccattcacctgttgatggacatttgggttacttccagtttttgactattacaactaaagttgctgtgaacatttgtgtatgtctttgtgagaacatatgcttttctttttcttgggtagatagctaggagtggaattgctggatcatatggtggtttttttttttaaagagactgccaaattgttttccaaagtcattgtatgagttcatattcctgcttgcagtgcaggagagttctagttgccctacatccttgccaactcttaatattgtcagtctttttactcttaggcattctaatagatgtgtactagctcttaattgtaattttaatttgcatttctctgatgactaataatgttgaacatcttttcatgtgattatttgccatccatacatcatctttgatgaagtgttttatcaaatcttttgcctattattaaaattgagttatttcttttcttgagttttgggagttctttatatattctggataagatacatgtcctgtatgagctatatggtttgcaaatgtttttctcccaatctatggcttatattttcattatcttggcagagtctcttgaagaatagatttttttattttgatagtggttgttttaaatttttatgaatcatgcttttaatgtcatattttaaaatcttcgcctaatccaaggtcacatttttctcctgtgttttcactaaaagttttatagctctaggttttacatctgtgattacctttttgttacgttttaatttaatcacaatgtaatcagaggatctgatctttatgatactgattctttgaaattggcttaatttatttttagtttatgttttcttcc

SEQ ID NO: 104820 - DNA, 1126 bp, Homo sapiens
atggacatctttatatatgcctccttgggctcatatgtgggagtatctctgtagactagaagtagaatttgaaattaaaagctatctgggtcaaagtgtgtcttctaagggtttttcttttttttcccaacagttttttaacagtcacataacttcatatgcaagaagtagcaccattaactagatcagttattaattcagcaggtatgcatcgagtacatactgtgagaaccttcctcttaggggtttccaattccttcagactcagtgccccctttttaaacagtatttttttaaagacccttttactgtaccaaggtgatactcatagaaaataaaagcattcatatgcaaataacttacaaaaatcaatatataataataattatattcaggagaaataaaaggaaagcagcctattatgaaataatgtgtatttcatgtaaatgcttaggaataactaccaaagatgatatgacaagtcacatacttcttaagtaagtacatacttaaataagggtactaagaagatacaattgttttgtagatgaaatgtagagtcagctggaataaatgttaaatggaattaatgttagaataagtgagactagacttacttatgataaaaacggttgacaggaggagttattaagaaggagaaaattgaggaaggatgatgtccttgcaaaagatccataccttatgtggaagtgttgtgccaaaatgatttcttacggtatgtcttgccacagagtaatgacattctgtcatagagaacatctcctttcttgaaatctgtgtctgaggtatacctttagtgtctgatactttaaaaaagaccttggaaagcatatccttttattggtcacagaaaatagagaattagaaaatgaaagcattttgtctaccagaataaaaaatcaaaaattagcatctgctatgggagaagataacatcttattcagggtcacaggttgagcattgcacttgatttcttcagggaaattgttaataggagtgccacccaaacgtgaacgtaattctaagtgtagtgtgtttccatgtaatcagctgcccaccaggatgattcaggttagctttgtaattgcagaagcagcctagtttt

SEQ ID NO: 104821 - DNA, 1770 bp, Homo sapiens
gtgcatatcatctggttgtaatcacagtgtgcatataactttgtgtcttgtgtttttataaaatgttattacacagaataaatatcatcttttccccaggttgccacataacctgctttgatcattatttttctgtatcccggaaacatagcataatttactaacccgtctcctagtttgggacatataaattgcttttgatctttctgtattataaattaatagtatattcatgtgaggatgaaaagatgcacagatggacagacagatgtatatatagacagacaggtaaactttacagtggaagaactggagaagtagctctgcagcttggaacaacacccagaatcacactgcagagccagtctcgtgaagctatggctgtacagccagtaccacaaagcttggagatggacctccagcttccagtgccaagtctctcagaccagtgaatcttattgaccccctgctctcctccaagggaagcaggactgcaaatatctggtattgtctgtttttacaggtagagagaggcactgcctcacccaaaccactgggagaaggaattcttatatttcctagaaaaataatttaggaccacacactgataaagccatttctatatttaggataatttatataacgtgggttcccagaagtataattatcaggccagagggcaggagcaaattctgatgatgaaggaccagatctcttgacctcaatggtttagtcttggaactttttgcttcctttattaatctttccttttacacatacgtaaagcacatttattggctgtacttattcacttagtgaatagagtgttttgtttcttagaactttaaatagttgttgaggtgaagggacttatagtcaaaggagaatcatcatctcttttttttcccctcttgattaattttttttctcttttagatagcggtgcctgggtttgtgctagaatctgaaaatggatgacatattcatccattcatcacatatggtgaatttatttcaccataaattgttttatgttagtgcacatgcaaacttctgtttgtatgtgtggagtggaaatttcatcatttatagcagtgtgaatttattctcaaatgttttctttcagcctccttctccaccctatgtaaaagtaaatatccgtaatacctcttttctcctactcttcccctaggcttttgttttgtttttgctgattggtcagcattcacttcatatcagttgttgaggtataaaaaccaagtaatgagtccccatgtccatcagggggctacagcctgccttagtggcaggtgctcttgtctcaaagccagagaacctaggtgttagtttcagcctcaccactaatgcactgtgacttcaggagctccctcccctcagtggctttggggaaggggtgggacttagagttgaagtcattctgtggacctattacagtgttcttcatttgctctgactacatttgcgtatcttcctgccagaatgggaggcttctgagtccagaactcaatcttgtattcatgtgcccggtgcgtgttgggtggatatggttaaatgagcccagttttgttgttcttgtgggtcttttctatgtaacacagtccatatattcttgcctacactttaagtgaaagaggaacttgtaaagacctcctatctttaagaatattagggccaggcatggtagctcacacctgtaattccagtgctttgagaggcccaggtggaaggatcacatgagttcaggtatca

SEQ ID NO: 104822 - DNA, 1065 bp, Homo sapiens
actgggtgtggtggctcacgacctgtaatcccaacgctttgggaagctgagggaggcagatcacatgaggtcaggagcttgagaccagcctggccaacatggtgaaaccccatctctactaaaaatacaaaattagcagggtgtggtggcaggcacctgtaatcccagctactcgagaggtggagataagagaatcgcttgaacctgggagatggaggttgcagtgagccgagattgcactccagcctgggcgacaagagcaagactccatctcaaaaaaaaaaaaaaaaaaaaaaaaaaaaattactgggtgtggtggcacatacctgtagtcctggctactctgagaggctgaggcaggaggatcacttgagcccaggaggtcaaggctgcagtgagccatgattgcaccactggcactgcagcctgagtgacagagccagaccttgtctttatttaataaaaagaagaatattagattactgcaccgttaggttgaagatgctatatgcagaacatggtgtttctgggctctccaggtctttcctcctctccttgtaggtttaaaaatgttttgagttggttggactccatggtaacattcttgtgaactttcagttgaggaaaggtgatctttaaggggaaaggggtggagggagagagagtttaacagtggcagcaatctaggtgaagggagaactttgtaaagcagagtacatcttccctagaagcaattagtcatattattagacaaactgtttcagcagctggcaaaacagcaggaacatgtcgattttgcttccttggttacaggcagtgatagtgtacttgaccttccgcagagctgggtcacagagagggcatctttaaacagccctgtctggtttgggtgaatggaatctgcactggcagggtttgaaagcaaatgcctgtgagttccctcaaccaacctctggccttttgggttggactctctttggcctgggaggttgctgaggaaaaatataaataaagctgcagggagccattggcatggtaagtgtgagtgtcctaaagaaaacaaga

SEQ ID NO: 104823 - DNA, 1051 bp, Homo sapiens
aatttagcgctaagttttacctttttaaaatctctattgccaactgtaaaattcaaaactggctaatgaattctgatataaatgatgctggtttataatatttaggtttcattccctcattagctttactgtaaagaagagctggatatatatgtcatcaagagaagtagttctttactaacactgttattgtaaggttccagtcctttgaggactggaactgcacataaaagtcagcagcctcctgtggattcttctcgctgatgcaagttgctgcacaaagggggttaatctctttgcccattggcccttcaacacacttactatttaatggtcctttgaaataaactaaaggagggtatgtggtacatttcagttcaagctggaggtgtcccctgcctaacaccctttaccctacttaagggttttacattgttcatgatttcactgaagtgttgagaagtactgagttcctgtttgagatttgtaacactagatctgcacaatgttttttcacagagtgtaactctgttatcctattagtaacccatgagaatttttgtagccaaaatccagaataagttatagatttggaaactcttaatattgcacatttaattcaatgaaatgagcatctttttctcttttttaatcccttttttcttttttttttttctttttcttttttttttttttggagatagggtcttgctatctcaaaggctggagcacagtggtgccatcatagcttactgtcactgtagcctcaaactcctgagctcaagtgctccttccgcctcagcctcctaagcagctgggactgcaggcatgcgacaccacgcctggataatgtttttaatttttagtagggatggggtcttgcaatgctgtccaggctggtactcaaactcctggcctcaagtgatcttcctacctcgccctcccaaactgctgtgattatagacatgagccgctgcacctggcctgtgagcatcttcttcaacctagatgttcatttttcagcaagtgattccatgtaaacgtcagaaat

SEQ ID NO: 104824 - DNA, 1049 bp, Homo sapiens
cttcctcagcagcctcataaacccccctgtgtcggtggaagccagtactccttggtttatataatgaactgccagggcaggtgttgtgctgtacctccagggtgtgtaattagcagacaggcacaagagtagagtaaagcaaagcaaagtctaggcagagtcccaggatcaaaggcttaagacagagactgcttattcatcccctaaggtattcattccctaagtgttcattcactaagcattcattgtgggcctaatatgtgcctggccttgggaataaacagagaaataggaaatgtggtgttctgtggagagtactaaggtgcagggactgtgggaacccagaggagggcatttgtattaacctgaggggtgtcaggaaaggctggccagaggagcatggcttttattaaattatttagtgtttaataaaacatttgtgtgttctgcaagcgtggttacctttacaaaggatgtgaaatggaacagatgattttaccctctaagtatgagtttggagaccaagccttggaaggcctgtgtctaaagatatttcacacccagcttgcccatggttttaattgagtcctttggactggcagttttcctgtcaaggtaaaatgccctaaccaaggtataacacacacctgggtgttgtcaggcatttatacagtgtaaactaagtgatcctgtcctttgcaacttgagcaggttgaaagggtagaaaataggataaggcagaagccaagactgacattaggcactgaggtgtgggcaggaaaaaatagaaaggaaatgcttcaactagtcagaaatgcatctaatatttttatatcctttttaccaaactgactttttattgctgtgctgatgagtctcaataaaatatttctgggaaaaaaggccaagcatggtggctcacgtctgtagtcctagccctttgggaggccaagacaggcggatcacctgaggtcaggagttcgacaccagcctggccaacatggtgaaaccccgtctctactaaaaatacaaaaattagccgggcatgg

SEQ ID NO: 104825 - DNA, 1075 bp, Homo sapiens
tccatcccattggggctgagaaattaccaggacgcttttataagtactaatcccagtaggtttcagtgtaatgttggttttgtttgtcatcccctgctgtgttgtgagagcctttctcgggaaaccatattaaaggaatgttttacaggtggctttggagacagggataacattcaaagatcatctttaaaatgttgttttggtaggtttttactttattaaagtgtgcagagcacaactgcaaattcctttggtttcttcttacattttcaacatttgaaacagctgttttaagattgtattttcctggggggcatcctgtagcaacatctcattgattgctttgtcatcatccttctgggtccatacctcagaaccatacaagttcatcactccaggccacagtgaaagcaagaggcgtggtcttcaggccacctctgggcatcattctgaacccccttgtgatccagcccacttctcacccacaggtaacacgtacacagacctctcggccggaatctccagggatgaccagcccctccccacgcatccagataatctccaccgactctgctgtagcctcacctcagcgcattcaggtacctgcaacctgccaatggcaaccctgcctttccagaagaactctttccaaaaacaaaccttcctaagggtttcactaaagagttgtgccttttgggcatgaaatacagtacaacttcatcaattctttaaaaaaaataaagaaaaaatgcttacatttatttaaccaacttacatttaaagcaaaagcctaaactgttgtttcaaaccattgagataaagtaccattttattacttatttgcttctaaattgagaggcagtatgtcttagtactgtaattaagagcaagggcccctacttgaagtcaaatccagtgccccacttagctttgttgaccttggtcaattaactttttaatgcctcactttcttcatttggaaaatagacataatagtagtatttgcctcacgaagttattatgaagaatcaaagggatattgcttataaagtgcttagaatggtacctggcacat

SEQ ID NO: 104826 - DNA, 1059 bp, Homo sapiens
agtgagactgaagaagatgtctggcccaaaaattcaagtgctggcctgcttgtactggggatccatagaaggttagtgaggcagacaggaaggaatggagaagtattttacaagaacacagtaccaggaatgccaggggcacaggcctgtgttctgtgatggctgcttggttccactttcttctgtggtcacaaaattcacaggaactttgggcactgtagtcctggtttttgtttgttttgttttttaaaaaggaggttggaccaagcctcttaggaagacagccccaagcaagcatctacagaagatcagaagctccagtttcccttccatgctggtgacaccatttatctgccaatggtgcctgcctctgctcccgccctttgtcctggtaaacccaacccatcctatcccttctctgaagccctcacctaccccagtaggcagatagacagtgctgcttgtgattctgattgccctttcctacagattaatcacttgttgcatactcatataattcactctttacaggcctgtcttccccatcagaatgtcagagcaaaaaccatgtcttaccatctatctctgtattcctgtcttcttgctcagcaaggaaaggctctctacaaacttctgaacaaatgagtgaagcatgaacgtaacaaaagggccatagaatctgcttggcttccccatttgtcagtcttcttctgagcttaaaggaaaggcctagtcacaggctcttggtgccattgtctcctgatattagtgtcactcaaagggatagagaactcaaggaaatatactgcaaagaaaggaaaaacaatattatagaaggcactttaccacaactattcttaaaagaaaaagactgagttattccagatgcacacttgggaaatggttttgcatactagagcttagaacagtgggattctctgtagccaccataaatggtaatcctgtgaaatgtatcctccttggcaatgtagctatgaaattggattatacaaacaagacagaatcagaagagcatgtccatggtcagtctcagctgga

SEQ ID NO: 104827 - DNA, 1085 bp, Homo sapiens
aggtgatccacctcccttggcctcccaaagtgctgggattacaggcatgagccactgcatccagcctctttttccatttttaaattgggttgtctttttattattgagttgttagcgttccttagacattctggctactaaaccattatcagacatgattcgcaaatattttctctcattctgtgagttgtccttttgttttatgggcttttactttcttgacaatttcttttgaagcacaacagttttaatgaagtctagtttatctgtttttgttctgtcattttgtcacatatctagatttgtgtaaataccaccacaccaagatacagaactgttaaatcactaaaaagatcttcctcgtgttgcccctttgtagtcacacttccctctcctcgaagctgtttttgaaccagcattataacttcattggcctgagagtcatttgcgtatctgtgttcatttttaatgtcagtattttttgtttaataggctgaaacaagccagggagctctgggcacactggcaaatgtagtgacctcccttgccaacctaagtgaatctttgaacaacggtgacacttcagaaatccagccagaggaccagtctgcaagtgagataactcggtacgagcccatgaggatggagtctcccctcctcgcctggacaccctccctctattgtgagggtggaaaacagcattttggtacctgtgctgtatttaactaaggatgataaaattgttacaatgaccctgctcatctgtcttctttgaaattttaactgtgggaacatagacccacctatgttatacagtataaaacaatcaaaacttcttttcattcccaaccatggaaaaggaaattgagtaaatcagtagacataggaggaaaactctagtggacagcggttatttgtattaattactgtttaataatgcgtctgcatattaagagttcattccctttcctacttctattttaacctatttttctcatctatatttttcttttttctttttttttttttttaatagagatggagtctcaccatgttgcctaggctggtctagaactcttgggctc

SEQ ID NO: 104828 - DNA, 1090 bp, Homo sapiens
aatgtgaatcagctgtttcctcaaacatggatttacaatctcacacaagccacagtgccaattggcacattgagtagtacagaacctggtgtcatctctacaggaaaccccccccccttttcttgctttcttgagtaccacttgtgtatgtttctcctctaaataccagcatcggctctgccagtgtgccaagtgctgtgcagctggtgcagctgccaccgtgccatcaggtggctggcagtctggttgaaagataagtaaccatataaaaatggaaatacaatgagagtcattgcatattgcagagtaaccatccttaggtaatatgtggaaaacactagaatggagggcagggttgtctagtagttgacactattgtctttggggcaaacagacctggttgtcgggccataagaatagtgcttgtcagctgtgtggccttgtgcaagtcactttacctctctgagcctccagtttctcattgtagaatcctcgcgtgggtttcagatctataaagctcttaacccagtgcctggcatgcaagggactcagcagaaggcagtgtggttctgtgggtcaggtggtgtgggatgtgtcctgagtagttgttagaatggtcacctccctccatgattaaaggaaaggcagtcagaattgtcccattctccagggagaattagacaggtagtgactgctaaacaagtattaggagtttcattgttagctctttgggagaatggcctaccccttgctactatctggtaggtggtgtaacctcaggctttttttttttttttttttttttttaaataacaccacagtccacagttaatagtactgataggtacctgagattttttaaatgaggttaaaacattgttacccactgccctgagtgtactttttctagttgggtaatttggaacctcctccacagagtttctcagtccgggctagataaaatgtgctaccacatttaaagtggtttcatttacatttcatgtactgtttttcataagttagtgttcagggcagtgatcatagtaaaatactagatgtgcatctggggcatttgggaatgacccagtgc

SEQ ID NO: 104829 - DNA, 1023 bp, Homo sapiens
catctgcagctggaaaatgaagctcttgttcaccttgagattactgatttttcattaaaaagtgaaatggtcccatttctttccatatgtggcccctcaaataagctggttttattgttcttaccagcctttctcaggatctgtgatgttggtttctagataaactttctggtgaccggataaagcaagtcatggagcacatctggaagctgcaggagttctgtaacagcatggcgaagctggatatagatggctatgagtatgcataccttaaagctatagttctctttagccccggtaagatatgcggtggggatgcatgacccctttccacctgtatctactgatgtttctgaacgtgaacatgttgtcatcattggtgtagaaagagccctgcagattgtatgtgacctagtgttcttatgataggtgttttgctagataaatacataaacgcttttaaattcttgcctttacagccccaaagaaatatgctgcagtgcctgatgatgtcacgcactgaatagatttaatctgtgtcctaattaaaccattggccaaacaagactacaccatacaaaagtgtgctgccacccgatgtcctttcttttttttccggccctttgccagtttccaagttttgttagcgcatataatccagtacacattgaagttccacttgtttgcccacagactgtgtatagcactgcagagcatgctaaaaggtatgttcgcaggagatgaagaggcagcaatcacgatgcctgggctggcctcactccccttattaactgttctctcaagtcctctggaaaagtcacttaggctaattgttcacctcacagtaaggggttggacacagcttaacctttttgtcttccttcccagcccttcactcacaaacaacaaaatagctaataaaattgggacaaattatataattatttagaaagtaaatgacaatttgtaattttatgtgatagtttttaaaactatgtgttttctagggtagtaggaagccag

SEQ ID NO: 104830 - DNA, 1074 bp, Homo sapiens
tctcactatgttgcccagggtggtttcaaactcctgggctcaaacaatcctgctgcctcagtgtcccaaagtgttggaattacaggtgtgagtcaccacgccctgcccctggatagtgctttttaaaaagttttctttttcctttttcctttctagaacattctaaatttttctagagtgaatactgcttatttttaaaatgggaaaatgtattcatactatgcaggtagcattccagcaccagcatccattcactcagccacaatgagtcgctgtgctccaatcttgcagggcacacgaaggtgtaagggacctgccatctcagctgggccttaggggctggctaagatttctatcagcagagatacaaagaatggggagggatgggaggcatttcaggaggaataatcaatatgagaaaaggcacaaggatggggaagagtaaaaaatggatattccagacagtaaatatcaagataaagaaaaaatgaatatgcaaacaggatgtaaaacactctaggcccttttctttgagaactatctcgagtgaatttctgagccctataagaaagcctcccttatcattttgggctccaagtaacctgtcgtcaccctacccaaccctgggtccctgactggacaggagtgactcatgatgttttcagacacattgtatctactttccaaggccacagaatcactgctgtcaaagtgattctcgagtgtgctgtggctctgccagtagccccagagggccatttccagccatcttttggccatgggaactgtgggggagcaggcctgtggcctcctaggaggacaacctgactgtatacctggctggatgtataaattctgggtgtggatgcattccctgacagtcccattctctatgtattgaggctgaagttattctagattcatgatgaagtcttcaatgattccagtagaaaatggatcttgcttttgtaaaagccacatctgggcaacagaagtgcgccaaaaggagaagcaggctcttgtctaccagcaggaccagccagccataagacacccccagtcacaccagagaaa

SEQ ID NO: 104831 - DNA, 2053 bp, Homo sapiens
agggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctccatcataactgtgaggctggattggggctgggcaggagcctgctgccgcctggcgagagtggttagggcctggtaaagctggatggaaggtttcaggacaatttcttcctgttgaccttaaataccagagattttaaaaatgtgtatagactcagcatctctgttggcaagtctgttaatgttaccagcacactgtgcactttggttcccccaggtgtgtgccagccgaccaccccggagcattttaaatgcaggctgcttgctccttaaaaacaaccctcaatttccagggtgatagtctttctcctcataaattgtagcaaccagagtttacagcaagaacagtatgcgcttaaaaggaagttatgtctaacttcaaacacccgtaaattcccacggatgtgaatatatagcaagcttttcctgtttgagaacagtggcatgtggaagacccggtcaattgctttgtcttttgctttttaaatagtccagattaagaaaatacaccctgttgggttaaatttgcctctcttgatttgttaatcagatgatatccaaaaagatccctggacactcccctgactcacaggtgctctgatctggctcaggctggcgccacatgtgctccacaggggtgcagtctggccagctacagacgcccctgtggtgccacattggacagaatggaagctgctgcaggctcaaggcagaacaggatgcttgatcctgaagggttagcagcactttacgcaagtcagtgttagtagggtaagtgggaacagtgtttccaacttctaaattcttgtttggatttaattatatcattttataattcttgccttggcagcaaattttggagagtagtgggagtggccattataaaatgatggaaaggatttaattttgccagcttaaagtaatttttacttttctaaccctgatgtgttttcagtttcaaaattaagacaaaaaaccagctgagacaatggaattagggcaggtttgtttcatttctgcttgtgaaggcttttagtagcaggcatcctgcagctcagtggtgcctctaacacagattgttgcctgccttccgtcgttttgatccttgagagtgaccatgagggccatgttgcagttccctgggaatacaagcataacagctttcagatcccagttcttggtgttggtgaaaaggtctccaccagcccctcctctcattcccaggtcattcagtggcagccagtaggctgcttagactcaggctggataaggaagtgttgggctgtggtgaaacaaccttgcagaaaacgtgattttgcttggaaaggtgctgattctaacctggtcctgctctttaagtccccttgctggtgatggctgattccagggactgttttgggctttgaacacctcttggttggtttctgagatcctcttggccttactttgaagtggccttttctttaaggatcatgtccacgtaacctgt

SEQ ID NO: 104832 - DNA, 1334 bp, Homo sapiens
ctggctactgaactccatggagccacgttcatgctccctcttctactggcctggctgctcctccctcaatgaggagaggcagctggctcagagaggtgggacagacacatgctgtcatcagttaagtgagctcttttccagaagtatctcagataatgttgggttaagacagatagatgttgaaaatggtggagatcattacacattagcataaaacaggacaggaagagattttttgaaagaccaaattagttgagcaagtaatacttttcaagttactcctggaaggtgtttttaaggaagtgtgttacctaccatactctcctaatttgacatttctgtgtcctgaggagttacatttattgtctaacccttgccataaggctgtggtttgaggttcttttgctgttctgggctttatatttaatttcaggtgtagtcacttctaagatgtgtaattgccctcaagagggactgatttttagcttgtcattgtcagtattgaatgtggactcttctgaggcagttaggacaccagccatggtgttaacagtggatgcgttaggctccttaatctcaaggcaatatccacgctacacacatacttattagctgtcttacttgtttgggggatagttacggcaaggagcaaaaaattctaaggactctagctgtttctagtgcttttactttcatagtcctttgaggacatttcctgcagagcactcttgctcacagcccgccctctgcagggcttccagcccctggccgcaatcagcagttcatgccacatgtgtacatccatgttctgggacctgatctcattggagtccagaagcttgttgcccactttccagtgtaaatgactttatgtgcaatggggtcataggtaacattttaactcttttcttagtccaggtcataggaagtctcatcatctgacagccacttttctcccagggaaggcggtgcccactgggccctgggaatgcctgagccagcagagcagatgccccacgtgcttcctttatccagcttccattctctcagttatgaggctctttgaaaatgtcttaactttgatgtaaatttttaaagccaacccctcatcaagacagggttggtttgggtcttttgtacacagggtctggaccttctcattgtgtgcctcccaccagcgtgcacttcgtatgtccagccctgggtcccttcagcagcattgtgcgtgtacaggtttctaggctgtaagactgaatgaatgtacatgtgtttatatcctctccatatgtacagtgtatatagtgtgtgtatgtgtacatagatgtatattatgt

SEQ ID NO: 104833 - DNA, 1405 bp, Homo sapiens
accgttctgaatctctgaccgtgacgcctgtctctgggctactcaacagagctgaatagctgggaaggctgatggctcaacccaactgccaagttccttccaggtagggccatgaataggtgcatgaaaaggttaaaaattcccacttagttttggatattaagataaactgtcttccagcttcctggctcttgtccgaacctagagaatatacggaaatgtcaccctgtcagaacctcttctgcctggaattcttccttttgcagagtggagattctgacttcatggcccttcccaggcaggctcacccaaaggaaaatggagtgaagaaaatcaccagcaaatcttccctgccgagggaccttggaacacccatatcagtttacattagcaactttatgaaaaactctctttaaaggaaagtttggatacatgtctgtatacataatatacatctatgtacacatacacacactatatacactgtacatatggagaggatataaacacatgtacattcattcagtcttacagcctagaaacctgtacacgcacaatgctgctgaagggacccagggctggacatacgaagtgcacgctggtgggaggcacacaatgagaaggtccagaccctgtgtacaaaagacccaaaccaaccctgtcttgatgaggggttggctttaaaaatttacatcaaagttaagacattttcaaagagcctcataactgagagaatggaagctggataaaggaagcacgtggggcatctgctctgctggctcaggcattcccagggcccagtgggcaccgccttccctgggagaaaagtggctgtcagatgatgagacttcctatgacctggactaagaaaagagttaaaatgttacctatgaccccattgcacataaagtcatttacactggaaagtgggcaacaagcttctggactccaatgagatcaggtcccagaacatggatgtacacatgtggcatgaactgctgattgcggccaggggctggaagccctgcagagggcgggctgtgagcaagagtgctctgcaggaaatgtcctcaaaggactatgaaagtaaaagcactagaaacagctagagtccttagaattttttgctccttgccgtaactatcccccaaacaagtaagacagctaataagtatgtgtgtagcgtggatattgccttgagattaaggagcctaacgcatccactgttaacaccatggctggtgtcctaactgcctcagaagagtccacattcaatactgacaatgacaagctaaaaatcagtccctcttgagggcaattacacatcttagaagtgactacacctgaaattaaatataaagcccagaacagcaaaagaacctcaaaccacagccttatggcaagg

SEQ ID NO: 104834 - DNA, 1053 bp, Homo sapiens
aactagttttataactgaaaagctgcacatttttcacagtacaagccgtagtttttacctgtagtttggacttctctgttagaatgtaactgcattaccagcccttttaaaggcatctatctatcaaaggaaaatttgggtgttagattttcttgggaccgtttctgtaacctttgcccttcacaatatagaaaatattggttttgccattacattttaatgccaggtttaaaacctgttgaaagctgcagctttatacagctttcttctccctgtgaaatcactttgtttatgtgatggcatttaaaaaatagcatgttctttttaaactgaattttatatctaatcaatgtcttcagtcttgaagaagaatttgcattgttgtgtttgtatatagagtattgcagtgcatgaattagctttatgcattttattaaatgctgtttcaatgtggcattattgttgtggcttaatactactacctaaatgaggtttatactattaaaagtgaattaaagactaacatgcatcctgctcttcatttttcttcatgatagtagtaatgcctggcccccaaacaatgcagcgctctcttgtgttatggacatgaagcatcctggtggtcctgtctctacagctctctggctcctaccttagccttagcggccaagagggattgggccctctgtggtccactggacttattaatacctttagtgggaaaccctggcaggacagtctttacatccacccagcaaggcagctccttggtgtggaggtagggaagccacacacatgtttctggagcagagcacagttaggctgctggaacattcagatgccattacagacaggccttaaattggcaagcttattctctaaggatacgtgctatcaagggcaaaaacaagctccaaaagtttcagaagttagaacatattcattatgtcatctgacctctcatgttccaggtgaaaattctgaggtccaaagtctgatgcatgacagaactcactggcaggcagatagggcctcactccgtcacccaggctg

SEQ ID NO: 104835 - DNA, 1013 bp, Homo sapiens
gcagggccccaatgtctccactaggtggtgtctcctcatttcctccatggcctacaaacctccctgctaatgcacacagtggctgggccatgggttggcagtggctgactggtcagcaggtacgtgcctgagtgaggctggcctgtcagccactggggctcctccatctctggcccatggctaggccccccagcaggcaagggtaatcaactgtacttaaaaaagtgagcactgcacgaagggttgcctttggatttctgaaaaatacccccaaggaactgaacggaggggtgtacacactgccaaccacagacagtgctagccagactcaaccacagcagcccttatgttctccagagtagagcccagaggaagattcaaagccagcggagaccagtaaagggtcgcaggaccaaaacaggtgtcaacaggctgtggccttaacctctcaggcccaaagcctttctgctacacaggccttcctcttcactaggaccagatacacgccaagctgctattaggaagcgttttattgaccagcagagcagggatattcatttagcagctcagcttcagaccctcctctcccacatccttttacacaggtgtgtaaagtccttttaatgcaaaaggatttccagagtctccagggacagaaccaggggcttccctgggccaaagtaatcccattccaatctccccactggtcagacaccatcaccccagcccacagtgaccgtgggccttagtcctgggcatcggctttcagagcggctttgtacttccccctcatctccttgggtaatggcaccaggctggggcagggcacctgcccttccacttcacagatgcactcccgcaggcagtactttcgagggccgaagttggctgggtgagaaagctgctttttctcctcctcctcttccctgagggtttccctgccaaagagcacagacggcaaccaagcattggcaactttgagtggcaggcacagggcagtttctcagccgaga

SEQ ID NO: 104836 - DNA, 1099 bp, Homo sapiens
gcagataggctgaccgcactgtgtaggcttgctgctgtggtgtgaggggacaacagcaggccttctttcagcgctctcctcaggggccagcagggagacagcgataggctttgacagtgaggatcaggttagaaggcaggagatccaggtgtccctggtggatggtggggttgtctcggctgagaaactgccctgtgcctgccactcaaagttgccaatgcttggttgccgtctgtgctctttggcagggaaaccctcagggaagaggaggaggagaaaaagcagctttctcacccagccaacttcggccctcgaaagtactgcctgcgggagtgcatctgtgaagtggaagggcaggtgccctgccccagcctggtgccattacccaaggagatgagggggaagtacaaagccgctctgaaagccgatgcccaggactaaggcccacggtcactgtgggctggggtgatggtgtctgaccagtggggagattggaatgggattactttggcccagggaagcccctggttctgtccctggagactctggaaatccttttgcattaaaaggactttacacacctgtgtaaaaggatgtgggagaggagggtctgaagctgagctgctaaatgaatatccctgctctgctggtcaataaaacgcttcctaatagcagcttggcgtgtatctggtcctagtgaagaggaaggcctgtgtagcagaaaggctttgggcctgagaggttaaggccacagcctgttgacacctgttttggtcctgcgaccctttactggtctccgctggctttgaatcttcctctgggctctactctggagaacataagggctgctgtggttgagtctggctagcactgtctgtggttggcagtgtgtacacccctccgttcagttccttgggggtatttttcagaaatccaaaggcaacccttcgtgcagtgctcacttttttaagtacagttgattacccttgcctgctggggggcctagccatgggccagagatggaggagccccagtggctgacaggccagcctcactcaggcacgtacctgctgaccagtcagccactgccaacccatgg

SEQ ID NO: 104837 - DNA, 1050 bp, Homo sapiens
ttttttttcctctggagtataaatctgtttaaatcttctaagtttaaaggtgttcctccactcctcaattgtaaaactgttcccccatgtgtgaatacattggtctcattattttaaaattgtggtataacctagatacggtgcacacctgtaagtatacagctccatgaactgccactcatgtttacaccttgtcttcacgacacaaatcacgacgtagtacctttcatggtttcattttcagtggtgctttggcattggtgttaggttagcttgcagtacaggttgggatacagatttctttcccctcagatgcctgcccaggggtccccacgccattcagggaatcttctaagaggatccctgcgagttttttctcagcctttttgggtcctctgagaatctgatgaaaatgctgggctttctccctagaaaaatacccacgcataaaatttcaggctaaaaactctgtttcataggcttcatttcttcccttttgcaggaagtttgtgtttttcaacatacctcagattcaatacaaaaacccttgggtgcagatcatgatgtttaagaacatgacgccgtcacccttcctgcgattctacttaggtgagtggggccctcgccatggtccaggggctgtcccagacatgcctggagagactgcgtccttcctatgggagcgtcaggatgagctgcagtgtgcgctgtcatggtgtgtctgtgactcctggcacctttggcttccccataccgaggcactcagcagccactgaggtctggactctttccctctccagcctcacctcttcttaccctctgcctcacaccatgggggtaatttttccaaagtcccttgtcacaccaggctgtgatgcctttgctcaagattgttcctggcctggaatcccatttctacctgcgtttgcttatttaactgaaaaaaaaaaaaaaaaaattcttcagggctcagtatgggcaccacttctaggaagccttccctgcatcctagagtgacctcccacatgcccccagaacccctctgtctcg

SEQ ID NO: 104838 - DNA, 1050 bp, Homo sapiens
gaaaaatggacaatacgttcaataggacgttatcagctgacttggtatccaaactgagctttcctgattatttcttattgcaatgtctgacttttagcctatgtaaaaatattttcccgtgggtggatggggaaatgactaatttacaggacgcgacaacctaaaccttccaaggggaaggcgtcctaaagcgaagctgcacacaccggttctcgccgcgccgggtcgaaggccgcctacaagtcccagagtgctccgcggcgtgcgctgcccgccgggaagcgtctcctgtgcgtctgcgcgggaagtggaacctggctctggggagaagccgcgtgagatccgcgcgggtgctagctagtcctttctcgtcgctgctcggctcgcggcccgtggggtcggccccgccaccgttgccgccatgcccatgaagggccgcttccccatccgccgcaccctgcaatatctgagccaggggaacgtggtgttcaaggactccgtgaaggtcatgacagtgaattacaacacgcatggggagctgggcgagggcgccaggtcagtcgcagccccggccgcctggcgagccgtaacctgctagtcgtgccagcctgctggtaacgtgaggtcccgagtcgctctgggcggccgttcatccccggggcgggccccccaggtcggcgctgttacccccattttacagaggtccagactgaggcggacggcggggcccccgccgggccggctgcagtcgtgacgaggtttggggggcggaggacaagaaccccactcctggatctccttcctccggcgcggtgggcgaggctgacccgagggaggccaccagttcccttggcccctctggccagcaaggcaagcgctggggaggggcagccgcagatcctttcggggtgacgggggtgacaccccaggacgaatctgaggataaaatgagagaaataacagcggcgaacactgatcatatctcgcacagttctgaatgcttctcgcgctttcttttttctgatgcctagagaaaccccagcttatccc

SEQ ID NO: 104839 - DNA, 1089 bp, Homo sapiens
attcttccacgattatcttctcctgtaaatacatcacaggagttagaattctctacccatcagctgtaccatgtcgcagaattcatgcaggcacaaagttggagttacagagatgggttgacagcaggcaaacttggcctatgtattataaccacaacttcaagttcttacctcatgtgaatattcaccctttctttagtcttccaaggcaaacagccccgtctcatcaccagatgagcaaggtcttgatatggcatagcagatctccctagacacagatcatgagaaaagatggaagagacttagggattcaggcatcagatgaagttggcttttcccttttatgccttgtttgtatttaccctgtctaatacactaaggatacttactcattgtacttgcagctcaatatgtctttgctgttcagatactaaaatgtacctctgagtcattgtgagctgtgtggtaggttggacattggcatagttggtgatgggactcaaaatgaaaaggtggtctctttaccaggtcacagactgtagcagattgtgcttgttatctgacaatgactgtcactttgagggtcgttgatttgcatgcactactctggggccttgtattggagccttttttaaaaaaaataaaatctgagatagaggttgggggtgtgtgtgtctgtgtgcacatgtgttacaagtgagaatcatcagatgacatcccttctcctttcttgatgacaaccatctgagtatcagaatagttccagcacctgtgttgtttgtctggttaaggcctctggaaaaaatgaaggtcactgggttctgaacaggggatagatacgggttccagttctgcccttattcccagttattcctgcagtgctggttaaatgaacagttttacagaagtatagtgcagatcccttaatgatcctatcatcccagtttcacactggaagaaactgaggctcagagattgaggaaccttgtgactgccatctgtgccagtcaccacctctgcatgaccacatttccctccattagcactaccagcatgcctgtgaggtagttactcagctgttcatctgac

SEQ ID NO: 104840 - DNA, 1037 bp, Homo sapiens
tccctgttgcgtctgcaaatcgaaacatcacttccacttgattcattcattccaagagatggacactgcattatatctgaaagtctgaaatgccacctttagagaattaactgcctttgtgaggccttacacctttagcgtccttctacactatgctgtccaatctgcaccatgaaacttaggtcacgtgtctctggtttctccttagtgctggggagacaacctacagtctggaacatgccagtgaccttcgagtggaagtgcagaaagtgtatgagctgatagacgctttaaggtaaggtccattaagtggtatcctgcccgctggtggaatggagaagatgctgttctaatgaaatggcgaaagcagacctgcactcactcagacttctggtgatggggcagtgggtgaggaggagggcaaggaaggggccagctctggcacttaatgcatctcagtgacttttgtttcgttaaggatttctaatgtttgctattattaaagaaagaggagctggttattgacacctatcacctgccagtcactggctgttttctctagaatagctcatttattctactgaagttaccctgtgaggtagggattaacatcctgtgtcaaaggtgaggaatcatgtcacagatagcaaaaattgtggagtgaagatagaaactcaggttctttctttgtgtctgtgctcaagtccacagctgctttttaactgtggactggccattggggttaaattagccagtgactcagagggagaataagatgaggtgcctttgtccatccagacatacagcaggagttcgtagttgcagggcctggtacaaaatgaaaatgcatgtcccctgttcaaaagttattaagaataaagacactaacagcagagcattaaaccaagcacagggctcttttaagtgccagtcctttccagttgcataggttgctcacctgtgaagctggctctgcatgtgtagtcagtcactccataacagtgttgtgcgccctttgctaaggcctgtgtacagcc

SEQ ID NO: 104841 - DNA, 1029 bp, Homo sapiens
tgacagaacaaaattccttctcaaaaaaaaacaaaacgaaacatctgatcagaagctccattctcactttctttccttcctacaaaattttctgcttggaaagtatgcctataaatcaggaaattgataacaacaattaatgtgttagaaaagtgaacattttaaatatagctccattgatggagcctagcttctgggtaggtgtttctatatcttgagcataccacttacctctttgtttttgttcttagaaattacgactttgcatggagaaagttgaccagaaagctccagaatacatcaggatggcagcatcattaaagtaagctattcatctatgtttttctaatccagtggtgactgttttctggcattttaggtcaattctccagtagccaaaaatgaaaatcttaacttcaaccgtgctttttttctgagaccagctgaagttggtttttttccacttttggctattatgaagagaatcatcttcatgtctgtcttttagtggggtacaggctaccatcacatgagcttgtagaaagacagccacattcagttgaccttggctattctgactgagcaggtttgggaagggcctcagacaataggtactgctgctgagtgcagcatctggacagagcagaggaagggcagtgggtctcatgctcatgtctgggtagatgccacttgagtgtcacattgaggtgtcagggcttaaagcaggcatgaccattagagcaggggctggcagactgcagcccgtgggccaaatgtatcctgacatctgctttttttttttttttttccgagacggagtctcactctgttgccaggctggagtgcagtggcgtgatctcggctcactgtgacctccacctcccaggttcaagcaattctcctgcctcagcctcccaagtagctgggactacaggcacgcaccaccacgctcagctaatttttttatatttttagtagagacggggtttcaccatgttggccaggatggtcttgatctcttgacctcgt

SEQ ID NO: 104842 - DNA, 1374 bp, Homo sapiens
ggaggcagaggttacagtgagccgagattgcaccactgcactccagcctgggtgacagagcgagactctgtctcaaaaaaaaaaaataataataatactatacatatgtaattatgagatacatatgaaagccaatccaaaacatgaaggagaaattttggacacatgaattcttattagctttgtttcatgattgcccatgtgagattactggggtgattttctgattaagttgccagttgcagcaactgaagacagtcacaaattgtagaaggtcaagtgaatggcaaattttagaagttaatatttatttatgatagcttgtttgtgataccttgtttcatgattgccaatgtgagattactagggtgattttctgattaagttgccagttgcagtaactgaaatcacaaattgtaggtcaaatgaatggcaaattttagcagttaatatttatggtcacccctaagaattctaaattaaagtttaattagatgttagagtatgattagggaagaaaagacatgtggatggttaagagtatagcatgtgtggccaggtgcggtggctcacctgtaaacccagcactttgggaggccaaggcaggtagatcacatgaggccaggaatttgagaccagtttggccaatgtggtgagaccctgtctctactaaaaatacaaaaattagcctggcatggtggcacatgtgtgtaatccaagttacttgggaggctgaggcatgggaattgcttgaacctgggaggtggagattgcagtgagcctggagatttcgccactgcattccagtctgggcgacagagcgagactctgtctcaaaaataaataaagagtatagcatgtggagatgctgatcgaaggatacaaaatttcagccgggaggaataagtcaagagatctgttgtataaggtggtgatttatagttttttgtttgtttgtttttctgagacagccttcctctgtcacccaggctcaagtgtgctgctgtgatcttggctcactgcaacctttgcctctgggttcaattcttgtgcctcagccacctgagtagctgggaccacaggcgtgcaccaccatgcccagctaatttttgtatttttagtagagacagggtttcaccatgttggtcagactggtcttgaactcctggcctcaagtgatccatgctcctcagcctcccaaagtgctgggattacaggcatgagccaccgcacctggcctgattatagttaataaaaatatctcgtattcttgaaaatcagtgagagtagactttgtattgtcaccacaaaaagtggtaagtatatgaagtaatgcatatggtaattagcttgtttagccatttcccagtgtat

SEQ ID NO: 104843 - DNA, 1049 bp, Homo sapiens
tttgtaatatagtgtttgtgtgcttgctcctgcattttacttgagatctaaatatttctggtgcatttttaaacaaacgataattatttcgtcaactcttgttttttgagatttcttttgactgtttactgggtgttcttcatggctcatttgtattatttgttccatttttcaaggtcttgtccagaaggctaaaaaagcaaaggacaggttgttgaaacgagaaggggatgatcgagcagagtcagggacccaaggatatgagtctttcagctatggaggggttgatccttacatgtgggaaccccaggagcttggtaagaaaattcatttattcattcagcaagtggttattgagcatctgctatgttctaggtaaagttttaagagttggctgaggaggcatcagtaaaccataatggtctaagcttctcatggaccttatgcccttgctgggggaagaaaatggaagagaaccagctgagcatccactttgtgttaggcactacattaagtgccttatacccatggtcttgttagatcttcactgcacctcatgagaacctgcccagggacaaacagtgagtaaactgcagaagtagggtatgaatccatatctctctgacgtcagcccaggcatagagtccattaatgattctttcctctcacataggacattacctgcccagtgacaggcactggtttatgcagcttacttttttgaataattatagtaacatctacctactttcatgtttttgggatgataaaaattctctaacatttattatgatgattgtacaactctgaaaatcctaagctgggcgcggtggctcacacctgtaatcccagcactttgggaggccgaggcgggcagatcacgaggtcaggagatccagaccacggtgaaaccccgtctctactaaaaatacaaaaaattagccgggcgtggtggcgggcgcctgtagtcccagctgctcaggaggctgaggcaggagaatggcgtgaacccaggaagcagagcttgcagtgagctgagatcgtgccac

SEQ ID NO: 104844 - DNA, 1022 bp, Homo sapiens
aactagctgggtgtggtggcatactcctgtagtcccagcttcttaggaggctgaggcaggaggatcacttgaaccgagaaggtcgaggctgttgtgagcaattatagctcactgggtgacagagcaagatgctgtctcttaaaaaggaaaatatagtacgcccattagagataagtgctctacaaatataaaatagattttttctttttgactagtaggtttctattgtttctctttaactgatgttaggatttttgattttttgtatgtttttatggcagatactatatctttttcatctttgcatttctaacacaggtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaaggtattgtttgcttatttcaagaatctgtgcttcccacttcattgagtttttgttctccagtgatgttttcacattttaggttttgcagcttgcttggtctaaggatttgagaaagagtttgttttctcaaacttgcactgaataaacattaagtaccccattgaactgtgaaaagaatgaagaaaatcctcaattgctaccagtttgcctgaattggcttttttcccttcttcttttctttcttagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactca

SEQ ID NO: 104845 - DNA, 1034 bp, Homo sapiens
ttccttagctctttactcccatcccttacacttaacagaggaaaggatctgtaaggcgcgtacccctctactgcccactgtcgacgaaaacagcctcgccctgcaccgccaccgccacgcataaggcggtgtgtgggcagctcggacgtggcacctgccctcagctgctcaatcccgggcgccgcgacggtcacgtgcacagcggcaggcctttttgccccgcccccgcggcccggctcctgcgtgggcccggccccgcccacagcccgcgcagtcccgcgagcctggcctcggcggccccagcttctaaggagctcgtgagggccaggctgcgcctgcgtcgggcggctggtgggcggggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggtagggccgggcccggcgcttcggtcggagttgctcagtcggagtgcggcccgggcctgcggccgaggggcgggatccgggtgcggaggctagcggccccggctttgcttttccctcgtccgcctcccggccctcctcttgttgggagcggcaagcccgagtgcagaggccgacgctgaggctgcggggaggctgggtcgcggcttgcagccgccgctcctccacctgtagtcctgactggcaaatgcccaccgttgagccgctttggggggcaggtgttagatatgggtagttagtagccaattcttgctgtcacttga

SEQ ID NO: 104846 - DNA, 1146 bp, Homo sapiens
aaaaagagaagggaggaaggctgggcatggtggctcacacctgtaatcccatcactttgggaggctgaaactggcagattgcttgagcctgggagttcaagaccagcctgggcaacatggcaaaaccccatctctacaaaaaaaaaaaaagagagaaaaattagccaggcatggtggtacactcctgtagtcccagctactcaggaggctgaggtgggagaatctcttgagcccgaggaggtagaggctgcagtcagctgtgattgtgccactgcactctagcctgggtaacagagcaagagcctgtctaaaaaaaaaaaaagaagggaggaaatttgtccttttttaaggatttttttaaccttgctaagttttttaaatgaagaatacagggttttggtaaaaaatgtcttaaatagtgaaaatagtgtgttttctggctgtatttagataatactccttctgcgtatttttttttctatcctagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacagtgtgtatagctacaaattacgtttgatgagttatgccaaaccatttcttctcttgctagtgaattttacataacaccttgaataaaagaattttaacagaataaaaaaaattattttaaatgtaacaactactcctcaatataagatgatgagtagaaagctaataatgggtttttgcatcttattaaaattttgaaagtattgagtcttaaattacaagaactatttttaacatttctgttcttacaactaaaataaacttacagaattcattatcacaaatctattaatttagaataaacttccccttttttcagtttcgtgcactaaaaaataagctagtggtttggatgagccttacttatttgcagtgtaaaatctgtatgctgagtggcttttactgctccctgctgagccttggttgggactcttagcttcaagggacatctagtgcataagagagcagtgtatttgacaggaggatgaggtaaagtagttga

SEQ ID NO: 104847 - DNA, 1037 bp, Homo sapiens
tagtagttgatattgaatactaatgttggtattttaatatttatttttcttacaaaagcataatttaccctcaaaacaaggatggtgaaccagaatacaatccatgtgggaagtatatggtaaaacttcacctcaatggtgtcccaagaaaggtgaataatgtctctccccactcccatcccttgtctctctccgttccctacctttgaatcttgagtgaaatcattaagaaatgtcatctgtttgaacattttaaaagttagagtctgtgatattatatattactaccagtagcatcatgtgttaatcattaaaaattaattaaaaccatggcaagtataaacttgttttttaaatggttttgagaaaatgtatacagtttcaaaaagtaacgttcaactaaggattgctaatgcttaaaataaattttcatctgatagttcatctgattgttttgattaaaaggaaatcagacaaactaaatctgttaggtcagaagagtgtatatgtagtcataacttaagtgtaagaagcctttgaaattatttccttttaaatatatatgcataattttaattcacacaaatttctttaaggaaagactctgaactctgttataagggccttgcattgttaaggttctccaccacctgtccatgttgagatccatgcagcaacatcagcatcacctggaagtttgttagttttgcagaatttcaggcttcaccctagacctgctgaatcagaatctgcgtttcacctagatcccctgtgatccagcctgaaaatcattgctctgtagttcagtaatactcaaattttagtatgcacagaatcacctggcaggtgattatctgttattaaaacacaggtttctggacctcacgcccagagtttctgattctggaggtctgagatgagatcaaaatttgcatttctaacaagattccaggtgatgctgatgttgttgtctagaatactctctgagagccattttacctgatttacttaaaaagtaaagaaaattattgagaata

SEQ ID NO: 104848 - DNA, 1050 bp, Homo sapiens
aacttaaaaaaagagaaatgtgataatttattttatatactgtgcattagaaatgtacttctttttgaaaattcttcaggggtaggaacagcccattttcatgtaagccattagactaaaagataaaatggtgtgatcttagattacaaatgtgttttactttaattaattgtctttggggttcattccagatttcacaaaggagatgtcctcatcactgcgtcaactggaatgatgacagaagctgaaggagagaagtggggtctggttcccacacacgcatatgctgttttggatattagagagttcaaggttttgccttaaatctttttcttttatttttcttgttggataagacatttcagggatcccagataatttatcagacttctgaatactgacaaatcaaggtttaagtggagtttataaaccatttcacctacattaacttgatctctaccgttgaaaattatgaaattaaaaggtgggaaaggaaatcatagggatggcacagatactgatgacagaacagaaatgctgttacacctctttgtcttttccataaaaccagcagttttgaggcggaatacatagcttccaagattccaagcttcttcttcgtgtttggatcaatcacagtgttaagctctaaagcagtggtcgccaacctttttggcatcagggatccgttttgtggaagacagtttttccacagactggggggtgggtgggagcatggtttcaggataaaactgttttacctcagatcatcaggcattagattctcataaggggaacacagcttagatcttttgcatgcacagttcacaatagggttcacactcctatgagaatctaatgccaccactgatctgacagggggcagagctcaggctgtaatgctcacttgcccactgctcacctcctgctatgcggcccagttcctaacaggccatggaccagtacctgtctgtggcccgggggttggggacccctgctctaaagcatagtagacactgaataaatacttatgaaagtgggccaggcatg

SEQ ID NO: 104849 - DNA, 1047 bp, Homo sapiens
atagttagaacattgtgaaagacatacgtaaacaccagcctgtttaatttacataggtgccctgagaatagtgttttctcagataaatgaatattttcctctaaggaaatttgtattttataattatacacttaaaatcttgttcaaaagtcatctctgaagaaaagtatgagggagtttgtgcttttcagtgagggtttgggggttgatcgtgtatagtttagatcttaatattaacattgaaatatgctgaagggaatttggaaatgttgaatcattagtcttgattctgtaaaggttaaccataatcttaatagcctccgaatcttaatatacattcatacattgtggtcatctattaaaatgacaatttaattcagaaaaacaatgtttcttatagcactaaatagctgaaaacaatgctcttaaaattagagattttttgtggagagatttagagcatttttttggagagatttaaaaagaaaataaatagcattttgaacccattttctaaccacattggattctttgtgattttaggatgattttgcgaataatcgagaatttatcacaatggttgtatacaagactgatgggaaaaaagtttattacccaggtatgtttagtagcccagcaaacattaaaataaacatacataagattttatttatatgattaagttgaaaaatgacacattttatgtagataatatagagaaataattatgttgatagactaatagaaaccactcaagcagatgggtattcatgctgttctgtgttttgttttgatttgttttaatttggagactccaaggggggatttccatattctcgcacatggctgtcagaattttatttctgaaacttaaatgatgtcttttactctaatcaaatgtattctgtggttttccttgaacttctggataaaatctaagctctttagcatgatatataaggctttttattcccaccttaatctacctgcccccctttatttcatgccccagcttctcacagttgacatagttgctactccagaata

SEQ ID NO: 104850 - DNA, 1667 bp, Homo sapiens
tctaacctgggcagcagagtgagactctgtctcaaaaaaaataaaatatttcccggggagcccatggtaaaaatacagtctctcttaaagtaagtttaatctggtgttaatctttaaggcttcaactgaaaaatataaatggtgtgttatgatcaaaaatagagtgtgtatgtttctactgaaacttcagaaacataaacttagtatgacatctgcacttcagataaagttattttaaatcacgtttgagaatatatattaatacagtaattctgttcattttaaatgctaggcaatatagcgttggatttgaggttgtaacagtttctactctaggagatcctggtccccatggctttctgaggaaatctagtggtgactataggtaatgttggcatttttattgtatctattttatactttactttttgtggcatcatcttctataaaccttattctcattttctctaaatataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggata

SEQ ID NO: 104851 - DNA, 1075 bp, Homo sapiens
gacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaatt

SEQ ID NO: 104852 - DNA, 1389 bp, Homo sapiens
tgacagcacaaccacagagacctggtaatgcagcatgggggccctgagacctggcagaggtatggaatggcacaacagtcaggctacagaggcagtgtggcatctgggacggggtgagaaggctgctactcacctcgttctacttcacattcaggggaggaggccccgctgcattcacttcgagggcccaacactgggaacatcatcccaaactctgacagggacacagggctgggcagatccaggctgccaggcctcacaaccgcagggaactggtcaggcatctcagacgggcttgttggtcctgaactaaagctggacacggactgggtttccgagtcatcttcagacacaaagttgctacagctgtcatcttcaaaggcctccgaggccactaagttgagagagaacaccagtcacatgggttctgtcacctcctcaaacaccacaagtgcttgctgctggcaggcagctagacacagcatgggggactaaagagtctctacctctgtgagtgcctaatgaaggaatgtgacttcccaagcctgaatgaccagcctctaaagcagctggaagggaagcagctggcagcaggatcccatggatattaagcgcccttccaataaccttataaccctgccaagaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccaggtaacttctgatctcataaagaacacactcaaaggctacccacatcaccatttgctgcaaaagaacagaaatcctttacaatgctctgtagccacattatttggtagaccaaagtaacaaggcccagacacatgttattcccatggtttcaaagcctctttggcctttagcggttttccctcagcctgcccacaatcccactccttattagaactttcctactccatttttccccccctttctctttaaaaacagccttgtagcattccataaaggtttcttataaatgataaatactgtaatgttggggacagaaaatgggctcagacctgaattgaatccctaactccactacttgctgtgtgaccttggtcaagttactttacctctgtaagcttcatgatcctctccatgcagggtttgagatgatgtatatattaaagtacctcatacatagtagttgttcaaatgatagtttccttttcctttaccttgaacctag

SEQ ID NO: 104853 - DNA, 1045 bp, Homo sapiens
ggctcaggtttgctccctggcagatcctccacagatgtgctgctgccctcagcaccaacaccgcatccccgaggccccatggcactggagcgccgccgctcgtggatctcatctgagatcatctccaggttcttcagggccatcttgtactcgccttttgccagggtcagtttggcctgcaggtcatccacagtctttttcagttgctgatcaagagaacaggagactaagtgaagactaccctgctagccttaagatgctttctgaatgacaggttcaagtacattttctgcccatcattctacttcaaggaattttccaagacatgactgaagacctaattaccattgtaactgctattcattcaccagacaaaatcagccaccaccatccccagatcccatccaggtgacaacctctaatatccaaaaactctcactggtggaacaaaccccatcagggaagcaaaaatgggcatcagacacaccaaagtcccacagtctagacatctggttcccagtacagtggttctcaaagttgagcttgcatcaaaatccccttgggtgttaagactcagctcactagactccaacctcagagtttctaattcagtcggtctagagtgggacctggtctatcaggtctccaggtgatgctgatgctgctggtcctaagagcatgctgtgagaaccactggcctagtacaacagagaaggtgactgaatggcagttacagaggttcagagaccactgaagacccaaccgagacaattttgaggtctgaaaactcagtaaagcctgtctctccactttccccttatagcaagtggcccatgtgatactctgctaccccagaaaagtgaagctttgagtgcagaaaaatctcatcagtgacgaagcccaaagctacacatacctcgagctgcacatagtactttgccttgagttcaaaataaggcctgcagaagacaggaaggaaagccatcagagtaatataatacagtgaccacagtcaactccacaagatgaacaagaggcatcagct

SEQ ID NO: 104854 - DNA, 1035 bp, Homo sapiens
actaaaatacaaaaattagccgggcatggtggcgggcacctataatcccagctactcgggaggctgagacacgagaatcacttgaacgtgggagacggaggttgcagtgagctgagattatgccactgcactccagcctgggcgacagagcaagactccatctcaaaaaaaaaaaaaaaagaagtgtcttagtgttatggagccctgcctggtcttactatctttttaagtagtaggccattttggttccgtattatgggcatttcagtctgtccccttagtaactatcacaaatttattttaagtcctaacttaatcaggttttattttgacagggttctccaaagtcatgttcagcctgcttttgtttcataggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatggtaagatgaatggaatccagtctttaaatgttttattctttgtttctgtttatttgattgcattatcactgcaaggctgcttggagaaggcttgcgacatgtgcacgagaccctgaaacaagccctctactgcacaatatttacccagcacctggaaggcacagacctggcccctgcccttgaagagctcacaagccttctctggtgtcagtgactcccctaatgagcttgggttaatggacagcctctgacatgccatgtggattccctactaggaattgtgctggaataagagggagggcaagtcagaaacttcttgtccagttaaaaataaagcaaatttgacagtataatgccttgagattactttcccatggcacaaagtcaggaaacctttttctgtagaattgattggatctgttttggggtttggtttttttgttgtttttgagacagagtctaattctgtcacccaggctggagtgcagtggtgtgatcttggctcactgcagcctcca

SEQ ID NO: 104855 - DNA, 1008 bp, Homo sapiens
atgctcagttttgagtacgtgatactcttattgtctcctcagttaaaaatgatttattaaaatgaagtcttgctcctgtagcagtagtgaatattacatgctttatagtgagtgatttattaatcagttttatctggtaacagtgataatttctatgtatacaagtggaaattggatcgccttttgatgttgtatttttctatatgtatcagcctagtggttgcattaaaattcatttgtatttcttccccctgtagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaaggttagtgatttggggcctgcacttgagggttggacagtctggattcttttacttaccttccctcatgaggctcatgtactgtctagattcacatagtctctccattctcactaggtaggctgtgtagtgagtgtatagaaaggggtcctctggcataaaacatccaccctaaattctgatttgtgcagtgccatggctgctcttcagagcttcgccagccctgggacaaggatgattttgcagttacctgggatccatggagtcctgctataaggtgagaggagttatggtttagtggtcaagagtacacagtttggccaggtgtggtgtttcatgcctgtaatcccaacactttgggatgccaaggcaggtgaatcacttgaggtcaggagtttgaaaccagcctggccaacatagcaagaccttgtctaaaaaaagctaatgtatgatcattggcagatcacttaaccctgttgagtattggtttccgtgtctcatgtgagaataataatcacattcctttgtcccacagttgggtgaagatacaatgagaaaatgtatggttaagcagtcaaatgct

SEQ ID NO: 104856 - DNA, 1035 bp, Homo sapiens
atagttaatgttagtaactatttaccatggctgttttctacatggcctatcatttgacccttataccggctctgtgaagtgtaagtattagtattgtactcatttgtccccaaggtaaaattgaggcacagagctgtttaagtgatttacccaaggatagaatgcaggggaggagttgagatttgggtgctggcagtttaactccagagccgagttagccattgtgctgtttttttcctccacaccaaattgttaatgttggatgacaaatgaagtaccagtattagcttttgcttattagttctcttgttgatcgtctgctccatggggtcggagacctctcatattctggaccttttagtttggtttatttcttcattatgcaaatgtgatatactataactttgagctgtctttccccagtttgaagatcaaaagttaacaatgcttgaagctggctgtggggttggaaactgtttattcccacttttagaagaagatccgaatatctttgcctatgcctgtgatttttctccaagagccattgaatatgttaaggttggtgcaccatctatgtattctgctgtgtttctgttttcttgccgatcttgtttgatctgccttttttattcatttgcccaattctagtcttccctggagctaaccagctatagtcaccatacatgtagttgtcctgcttacatacatatacagtgcatgtagaaacacagctttattcaagaaaagcaggaaaaaataccataataacatccatataattaacatcttttgctttacaatttttctttgctgaactattttaaagtatattacaaatgtcaagacatttcactcctaaatgtttgcatacatctccccttaaaaaaggcctttttctacacaaccacaataagtttatcatatttcacaaaaataactataatctggcctgccatgttggttcgcacttgtaatcccatcagtttgggagcctgaggctggtggatagcttgcacccagtagttcaagaccagc

SEQ ID NO: 104857 - DNA, 1061 bp, Homo sapiens
ataaaagtatggtgcatgagatagtctggccactgaaatgaatgtaagcccactgaaggtagggactgtgtgtttgtcttctttgtgacctctcatatagcgggaaggatttttttttgtacagtctgcatctcataaacatttggtgaattgaacctggcgtcttgaactgtaaccactaaccagaatctaattcttttctctgcgaagccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagaggtaagctaatattacgccttatctgagctgttcttcatttaaaatgtgaagagggtgccatggctcatgcctgtaatcccagtacttggggaggccaaggcaggcggatcacgaagtcaagagatcgagaccatcctggccaacatgatgaaaccccgtctttactaaaaatacaaaaattagctgggtgtggtggtgctcgcctgtagtcccagctacttggaaggctgaggcaggagaatcgcttgaacccgggaggcggagatagcagtgagccgagattgtgccactgcactccagcctggtgacagaacgagactctgtctcaaaagaaaaaaaaatgtgaagaggtgtgctgtattgcattcctagggagagtgcgaagtagagaatttaagaagcctatcaaaatgctttgcgttttaggagagaaatatactgtttggtcttaacaccaaagttttagcagtttctggtttggttaacatataggagagagaac

SEQ ID NO: 104858 - DNA, 1007 bp, Homo sapiens
aagggaaccgtggggagcgctgacttacaacgaatagtgtggaaggaggcccgcggccgcttctcgaagctctccccgagcctcaggcaatgttcctcgcggtccagcagcgggtttgcggtcccattcatggccccgcacctgcctcgcacccagatcggcgctctcccggtgcagccgcgatccgagcttctggcgctggcgtctgggaggactgtgcttccgggccaccgctctggaagacaaggagagccgagccggcacccacccgggtccagaagcaagttctctcctctgcgtgggggtgagagaggaatctgaggaggcaaggccgtgggacttccggcgtcgggtaggaacttccgggttcctagcggaagtggcgggggcggtgccatggcaaaagaactcccggataatccgaattcgtggtcctcagaattggtttagggttgtttcgcggttcttcccgtattctgcctccgaggcccagtggggctggctgtggggtgagtgcgcctggccctagccctgcaggtgaatttaggaactgatgacggtgagccctgagcgtggctgactaaattaacgcgggtcggctagccatcatggacgccctcctcagggtctaggggcccatgcagcctagtctatcctgagggtcctgagatggatcctcgggacctcagccacgcgtcattgggtctctttctccactttgcccggtgatggcggtgcgagggtctcagtccctgcaaagtgacgctccctctggttcctatgacagcctcttgtgagtgtgatcaggaaatgagcccacccaggcttagcttcatttcccccgaaaaaacggaggtccgacccttgggaaacgatgacctcacttgtatctgacaattgaccacccgcttccagctaaggccattgtggtttttaagtcacccctttcgcgggcaccgaaaattgaggaatattttcttcgcaaggtttcccagtcagttcttgag

SEQ ID NO: 104859 - DNA, 1021 bp, Homo sapiens
tcacttataatacagtaattattataatacagtaattaaattgtaaagattgtcacaacctgatgttttttatgcttcgttaagccatttttttttcattcattcattccacagaaaataaaaataggtaccatttattgagggggtatcatgtcccaggcactctgctagatgctttatatgcattgttttatctaacaagtaatttttagaaaggtgttattattattttttacttcttttgttaaaaatatggaattgttcatgagtttgtgtgtcatccttgcacaggggccatgctaatcttctctgtatcattccaattttagtatatgtgctgccgaagtgagtacgaaaggtgctattatctaaaaaaaaaaaaaaaaaaaaaaaggtacggagactgagggttagagagcttgacctaccccggagagtgtgctgcagagtccttgctcctgtcctgccactctatttatttgtattcattacctacagtgaaccaggtgctaccgatattcctccaatatctgatggttgtggtatattcccttactactcagtgtgatatgggaactaacagtatcatattacctagatgatatgcagaatctcaacacctatgagatctgaatctgcagagatcaccaggtgatttgtgcataagcaaaagttttagaagcactaggctagtccatttacaaaagaaattgttaactgatagaatattctcagcttgggatggaattctgcttgtctgccagcaagagctggcatgtgatgaaatgaacaagcagtatatagataatggaaaaaattttcaagctgggcaatattttaggagctactttatttaggaactcatgcactcatgattataattacataatgatgttttggtcagtagtgacctacatatatgacagtggtcccttaagattctaatggagcatgtatggaaacctgatatacggcacttgatattggcattgcagatcaagtagggggaatgactgatatt

SEQ ID NO: 104860 - DNA, 3473 bp, Homo sapiens
ttcgaaacctactttttggtgcacaaacatgccgcaagactgagctactttggcgtggagtccattgcaagaggaaaatgttatggatcagtgactgtagtaggagtttgaggctctggaactctcacatattcaagtctttaacttagtggtgatgggtgattttctcgtgtcatttttgaacaatctcatctttcaaagtttaagtagacctgtagaagagctaacagaattatatttctatttagttaaaattgttaatgaaaaacagataaatgtgccctggtctaagttactcaaaggccatatcttcaccaggccagagattcagttttaaacctcagcagccatcagtttggccaagtggttggtaccagtggaatgaagtctttgatgggtaggagagagagggaaaacctcaaactacatcatagaagtatgttaaaaccactttaaattgttgacacaaagtggtaaggaagttttgtctgactcagcctgacaagcctggatagaaatggacctcagaatacagaatggagtccttgagtgtcagttggtgaggaccatggagtcctgccagctcaacctgtcatttacagactaagaaagggaagtacacacctggcttgtggccagtctcctgccccctctctgggctttcctcactgttctctcccttgaatctcatttgtaggaatcaagagattcctatacatgggacttttagatgtacattggcacttggattagattccaaaagacaaaagtgttgggtgcttctagcttgaattcagtccctaaatacatgaggctgggtgagcagatgaaaccggtagccactgtgctgatgcatgtgactccattcagttggggattttggttccatgtggatccatactaagtattcttcagtcagtggattttagcaaggggaggtaggagtggaagagaggtgtgaagaaacctctccgaacaaatgaaccagcagtaagtttctaaaaatcagaatctagatagaagttctgcaatatgaaatgagcacattctttgataaggcgtatctattcatgcttttgtaccactgttttgtacctgactccctgaccgatttgtattttttatatacaactagaaggaagtcacaagattgccttctacagtgtgccatttccaaatggatctgttgttggaggaaactggttgctagtcaatgttctatatttaatgaatgtgtgataaatcatcctgtaatcagtatggagtaacctgtttttgtagtttggatgaatatgtcctgagaaatttccatccactttggttcagcggacatcaaggtagtaataataatttttcctccacaggtccctccactcatatggcctctccctccccagctagtggaggggaagcagtctggacttagaaaggaaataggtggtctgtcataggggctttcattagagttaaacttcatagagtcaactgtttcatcatcatagtgagcccagagagccactgcccagcagcatgctcacaccacctaccctagtgtaggtaataggtctacgctaggaccccgtgctgggctctcagcccatcatgagattttggtggatttaatggcaggtaggaacttatttatagtggattgataattgctttataattccttggtaatgacagctcagggaaggtttcacaaggtcatgatcaggagacttgaattgttactggatgtaggaattgtttcactgctcttaacttgctcaaactggggcaggttccaggaacttgaactaaaaatatctatttaagcctctctctctttctctcctccccaacttttttctgaaagccttgatttctgtagacagaactatggtttttggcatgttgggtcaagacgtgtttctataggaaatgcttgcacgtggcactggcttggtgagtcaagcttcctgagcttcagaccgtttgtcctgtcatctgtcctgcccaacactgtatggtttttctctagcacggcttcaattttgttctctgcacaaagcctttggtggttctgccctctgccctccagctttacccaccagagtaagcaatcttttctttttagaaatcaagaatttggcttcacagatggcttctcacagatgccctcctgccagccaaaccggacttgttcttcctgcctctgtgccttctctcattctccttctctccctccataccccacttttgaggttctgtgggtaccatctttgtggactcttgtcttttttttcaacccacatggagtgccctgtgtgtacatactgaccttttttttttttttttttttttgcttgaactctggtcggtatgagctccttaaaagcaggtactgggctggctgtggtgactcatgcctgtaatcccagcactttgggaggctgaggtgggaggattgcttgagtccaggagtttgagaccagcctgggcaacatggcgagaccctgtttctacaaaaagaaaaagggaaaaaaaaagcagggactgtcattctcatctcctccctggggtatccacaggaatggacattcaaatggttgtagcctggtggggtagaaggcagagaagactacccagccagtgaagtgcagaggatagacataggaaaacattccaggcatttggagacagctgaaagtatccatgctgactttcatgatttagaagtctttaactgaattattaaaattgccttttttttgtgctgtacaatgtctactgtactgtgggtcatttagatgagatgaaaaacttaattaaatctgaagtgtcagaggcgcttagtaagccttagtaaagttgtgattgaagaaacttaatacaaatgaactagaggtttgtaatcatgccactcactaacgattttatttctgtagcagaatcattttttctatgtaaggtgttaatgtgtgtgtatgtgctttggttgtaggaaaacttgaaaattccaaaatccttattttcctatttgagaggctggttcagcagggtgtgtgtgtgtgtgtgtgtgtgtgtgtatgaatggtatatttattacattattttgaaagagaattagtgtgttatgtggataatgttatatacagccaaagtggatgtttctatttggcaaggaaggtaggatttctgaaactcaggccttaaccaataggttggaagacaagaccaattgaagagttaggaaatgtgagtttttgttacttctgttattccagtcttggtttcattgtctcattctttatttttaaaatcttgtgcctaaaagtttttttgcttaattatgaagtagacatgcatgtttacatttatgtaaaatatttgctgtgtaaagtattttttgtttattctcttaaaagatcactatatttaaataaaagtgaaggtcagcaacacatttcttgtcttggtgggtttcattt

SEQ ID NO: 104861 - DNA, 1015 bp, Homo sapiens
ttgaaaggtcaagaatccacttctgtgatatcacatactctcagtccagctgaggctaaatattcctgctttacactcccaccgttgccttctaatttaaattcttgcctcctcttgcccaaacaactgcctggccaccctaagtggtgccttttgccatcatacatgagtgcctggagggcagaagttgtgattcatttgttatatcaccacagtgcctggcttggtttgtgctttcacgtggtgtagatgcttaatattatacattatttattaattgaatgacattctttattgaatgacattctttattgaatgacattctttatctacaaggtttgagatttgtattttttaatcttaaaactaggaggttttgagtttctgttgcttctacattttacttgtctttgttagaacaacattctgttctttcatctgtgtgaaaaaatgaagctattgacctatgaatggaacctatacttaactgtttttgtagagatgacatatctgccactgatttcttcatacagcaaacatttattgactaagtactgtatactaaggattgtgctacataacctgtaggagagagggatgtaaagaaggagtgaggtttagtcttgatcttcacgttgatcagtcctggaaggtgagggtaagacttacagaaaaagactcatctattataactctcacaatagatgtagtagcacagaaggggtgactggttctctttgaggacagagaagattgcctgtagaggtaatgttagttcatgtggttccctcaaggtaggtaaaggcatggtgagctgtgagactggtaggtaggttgaggggaggttgtgggaaatctaaaaagagtttgaatttttttttttttttaacagtaggcaatgggggagactaaaggtttttctaaacaggtgggcgatgtaattagatttgtacttcagaaagatgatgcgaggcatggttgtacatgccagtaatcccagctacgaagggggctg

SEQ ID NO: 104862 - DNA, 1039 bp, Homo sapiens
gaggccttggagctcatgaaccagaaccttgacatctatgaacagcaagtgatgactgcagcccaaaaggcaagaatgctcctcggaacctgagtttctctcatacagagcagattgctctttaccccttgatcagtggttgggtaatcccaggcttcctaccaccctctgaaaaagcatccaggtagttaacctgagttgagttagtcagttgaattaggagccttacccctcagagagtggtccgtggaccggcatcccctgggagcttgttagaaatacaaaatcttgggcggcaccccagacctactgaatcagaatgtgcattgcagcaggatccccaggtgatgctttcacatggcaagtatgagaagcccaggactagatccccagttctcaagtgtggttgtacataagaatcacgaggtaagtggtaaacactatggctgcccgggtcctggagagtccgttgtaattggtgtggaaggggtgtggactggcactgggattgttttaaggctccccagtgcagtctaatgtgcagaaaaatttgaagatgactgggcgtgatgacctctctgagtcattcgaagcttcactgaagtagtaagcatctgcaagaatgccgtttgctcccttcagactgtttgaggctcgtttccggtctctatgtcggactacgatcagtctgagaccttcgcccagatagaactgaccccaaactgacaaagggaaggtcagtgccagcctttgtgaaggcttcctggttggcctgaatttcctgctcccttcaggaagggtggggacaaaggagaggcccccctgggggcaaagagggaaatatcagaggttgcctaagaaaatgccctgctggaaaacacaaacccgaagggaagtttgggctgtaactctggtggcagggtgaccaagcgcagctgcttgaggaagccctgctgtgcctcaacaggatgtaaactcattgtgagcaacactttcctgctctctgtgaacttaaagggcagaaccagcaggtcctgcc

SEQ ID NO: 104863 - DNA, 1069 bp, Homo sapiens
ctcactgcaagctccgcctactgggttcacgccattctcctgcctcagcctcccgagtagctgggactacaggcatccaccaccacgcccggctaattttttgtatttttagttgagatggggtttcaccgtgttagccagggtggtctcaatctcctgacctcatgatccacccgcctcagcctcccacagtgctgggattacaggcaaaaacctcatttatttacacctttttttcctctaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttac

SEQ ID NO: 104864 - DNA, 3119 bp, Homo sapiens
gtgaaactggaaactttatgacattgtaaattatcagctggtttttctgaatataaagtgtgaaaacacagaacagtattttgatctatttgataattttgtgggttttttgaagaattaatgagcatgtacatagaaatagtgactgcttgaatactgtatttacttgcactctttcagtacatcaagattcctgtatattttagagtataataaaacacagatgtgagttgtatttaatgaataatgtatttgtatctgtgcatattatctacaaatctataaagtttctagggcattgactactagattttaagcattttttctaaaatatttacagaaattataaatctaatcccccatcttttctttataatataaagaagtcataatgaacccttcctaattattagtagtaggaaggtgaatatgcattttaatgacagtggactacattttctattgtaccttttgaaaaaaaaaaaaatcaagcagattctaaaagtatacatatgtgtgctttctctttccttttaggaattctcttctgaattccctgagggaattttctagaatctcagaattgaaagagacctgaggttcatccagtctctaacctcttaacaaatgcaggagtcccttctacaagggtgatctttccaccttgaacacttccaagtgactctacctcaccaagcagtccattcagttgttgagcagctctaactgttagaaaggtcttccttagatggagttgaagcctccctcccggtaacttctgtctttgggcctgggtctgtcctccaagagaaccctgagaatgttggaaggatgaatctcgcacattctgccatgtcttctcttttacaggctgtttgacttctctgctgaagtgatttccagaaggactcatttgacacactattagatttaccacatctaatgaaatccaaggtgtagctataaagtgacaagctgtttttaatttatcacatacaccagaacttctatcctgcatcacttatatgtaaatgatgctgttaccaaaaacattaaggtagttcttgcgaatgccaccccactaagaaaactatttcattacttttgtaatccatctgtgagagtctgccccccagcttaaccacttcctttggtctgcacccaatgaagggaaaccccaaagtactgtctcaaatggtatttgaactacgccagtattgttggaataagtacattaattacttgaatgaatgaacacagcaccgtagaaatttcctttatggttacaccttgtatgtctaaagcattcaggccctgttctgtagtgtttcttatcctcacacagagtagaaaagcctgtttgctttatttaacttatacataaaagatgacatctgaaatatctgatgtgtattataataccagcttctgctctagaactactttgggtgaaatggtggtaatagcaaatgacctcctttaacaagacactcatctcaaacaatgccatttagttcaggagatctctaagtgtagctgtaaattttggggttaatttggcttatattggaccttttaaaagaaataaagttttttaatgcaataaatcaagtgtctgtctcttttacatgcaaacttcttttcccttaaactgtctagcattgaattgacaagttttttttccttttctaataaaaaaatgactttttagcaaagttgttttagacttaaatgaacctatctatatgggattttcaaatatatttattcaacaaatactgcttgcctgctgtatacttgggagtgggaatgggcagaaaaccaagaaattgtgatcttgtcctttaggagcttacaattaatttcattgtggaaaggtataagtagaaagtaataaaagtgtaattgaggtagagattaattgataaaaggtacagaataagatcacattgggagggaagatcagaacaggcgtcatggaagactaggtgcggacattgagaatcagatttgaacagatggagaagggtgcaaaccctatgtgaaaagaacaaaatcagcagctctttaaatggttggtggagttggtggaggggcgctctgggatagagtagatatattggcacttagcaatcctgagcatggaaagatgatgaaaatatacaagagagctaattggaaacacgtacaagattagataatagaagtgagaacaagtagatataaataggcgatgggaggaacaggtgaagagggctttaataacctttctcaaagtggtctttatgcaggtaataataatagaaaatgcctatgcagcatttatcatgtaccaggcaaggttgtaagtacttgaaataaattatctcttaacccacacaactgttctacgtggtaggtactatttatagcaccatttaacagatgaggaaagggggagatgaagtagtgtttgcccaaggtcacctggctggtaatttgtgaagcctagattcaaatccaggcagtcatgtccattgtcggtgctcttaaccccctaatgactgctgacgtgcaatctggtctttgttgaaattgttgattttgaagttgagacacacactgaatactaaattatgtaagttcccctcattttattctcctagattatttttaggagaaacatgtaaatctgactgcaacaggtgtttattgaacacctgctatgtgccaggaactgtgctaggctcttggcatacagcagtaaagggggaggtaacatagtttgccctcaggagtggatcctaaaagaatgatgtcttcttacatttcagttgctgttgccacctaaccaccccaaatctaagttgtttaatcactcttactcatgcctctgcagattggctgacatcagcttgtgtgggtaactgcttcaagctgggtctctggctgggctttactacctgctgtgagttgtgcttccagttgctcccatctatgttcattcttgggcctgggctaaaatagaaaagttatacagaagtttccacactgatggtagaagcacaagaaggcaagcccaaccacacaagtatggtttgtgccttctgcgtgcatcacatctgccaacactccactgg

SEQ ID NO: 104865 - DNA, 1565 bp, Homo sapiens
aagttgtgagaccttggggaatcattcttctctgggcctgcttcctcttctgttgtctagtctaacatccccttccaccctaggtttctatggctattctttttctacttattagaaacttgcgaatcatgctggttacagcaatttattataagctaagtaatgtaaaatatgtctaaagttgaagtactttaggcttatttccttgtctttggtgaaatacatctcaggatgcttaatttttaaattttatctttaattctaggctataccccagctttggcctgtgctcccaataaggatgtggctgattgcctggctctcattttggccaccatgatgcctgtctcatcaagtagtcctttatcatccttaacattcaatgccattaaccgttataccaacacctcaaaaacagtcagctttgaagctttgcccatcatgaggaatgaacctagctcctattgcagtttcaataacattggaggggaacaggagtacttatacactgacgtggatgagctcaacgactccgattctgagacctactgagaggctgaggaggagggagttctcacagtaaagcttcaaactgtgctttttcaggaaaaaggcactttgatattcacgtagaaattcaacctaagaggaaagatcccacagtgagccaatgttaagagatctgatggcattaggaggaagagttttaaaggcaagttttacaaaaggaacttctagaatcttgaaatagacctgactgaggaaaacacattgatgtcagaattctttgtggaattgtttaatttggttttgcagtgccaggaacaattggggacactgtgcactctaacctgcttacacaagcaacactattgtaacagaagaaataaagacactagatttaaattttatcaataaaattacaactaaatttaaaggcaataaaagtttggtacagtaggcattatgtgcacagcaaattgcaaaaggaccaaataactgaaaggtttttttaataaaatgccattttgtggaaactggagtagattaaatgaaacattacctaaaccaaactgcaatatttctggaaatgaagctgagatttggttttaaatgttgagtttttttgggttttgttttttttttaagaaaacatctgaaagccttccaatgctgtattaaaccatgagagaaagcagatgtatttttacatttttttcttttacagaactatttcaaatttccaatttttatactattagaattaaaaaccagctgactgggtgcaatacgggtgaaaatacttgtgacatagacattgagatggattggggtcaggctgttgccctgttttgaatggtttgggtttaaaatagtactatttttgtttgaaaatgtaaagaatttcctagaaaaaaattcatgaaatcaaaaagtagactatttcaccctattgcagctaagtggtcctggggcatggagtcttcaacctctctatgaatggcacaccttagtcacttatgttacttttgtgtccccaccatgggttgggggattttttgttt

SEQ ID NO: 104866 - DNA, 1067 bp, Homo sapiens
aaaggattgggtgaaggtagggacctgtcgatgggacctatggctgagcttgatgccgagctacacgttgacaaggtgtgacagtgcactgcacagaggttctgctctccctgcccccatctttgttattaggactaggtttctcgagtttgtacctcttggtcttcacaagttgacaaaaatgctctttgacagccaggtgtgtatgtgtatgtgcatgcacatgcacatatgtgtacatgtatcatgttttttcccctagacctctgcatgttgctgcccgaaatgggctaacaatggtggttcaggaacttttgggaaaaggagcaagtgtgcttgcagtagatgaaaatggtaagttggttctatattctcttcccttaacctagagcttttatcttttgatccatatttgaagagaaataaacttggatattttttattggtcaaagaggagagctaaagttaatattgaagagtagtttgtggcaaaggaataagggcaaaagaaataggaaaagttatctaacagatgtacttccgaattcctatatcatctgttacagcaaagttagtatttactgtttatacttgccactttctgttgttttagtagccaaagattttgttctttcagcaaatatgtatcaagatcctagttaagtactaatattcttatttaaagccagtgtttctactcatgcactagatcctgtccccttttgcctacttcataatgtcagtttgacagttctcttttgtgtcctggagtaacatttttcgctctcttcctgtattattcctctcagtatataaacattagttccctcatccttaaaaaataatttataaatctcactgctcctgccagctactgccatatttctctgtccccttttgcagcaaaactactctcttgctgtccgcagttattcctctcattcttccattcttttgttgttgttgttgttgtttgtttttgagacggagtctagctctgttgcccaggctggagtgcagtgccatgatctcggcttactgcaacctccgcctcctgggttcaagcg

SEQ ID NO: 104867 - DNA, 1099 bp, Homo sapiens
cccttgtgaataccaaaaccaacaggcgctcaagtcccttatagaaaatgggatagtatttgcatataacctatgcacattctctgctatactttaaatcatctctggattacttataataaccaatgtaatgtaaatgttatgtaaataattggtatgctgtatttagggtatatgacaagaaaaaaagtctgctctgttttttttttcccccaaatatttttaatttggggttggttgaattgatggatgcagaacccacggatacagagagccaactgtatgtattttgtgcgtgcagttgtatatgcctagaaattttcaggaactactggtggcttaacagctaccaatggttatattccagagaggggatctgggagatgggatgagggagagacttttacatttttcctttaaacacttacatgtacctgtgatttttgccagtatctcctttgaattttaatacctggttctttacacctatttaggtcacgagacatgtgtagaactgcttttagaacaggaagttttccagaaaacggaaggaaatgcttttagtccattgcattgtgccgtgtaagtaaagccagaatgaatcagatttggtttgagtgttttaagaaatacaccattgctgtgagaatgatcaccttgttaccttacacaggataaatgacaacgaaggtgctgctgagatgttaattgatacattaggtgccagcattgtgaacgccacagattcaaaaggaaggtaggaattcaactatgtattaaatagttttagccaggcacagtggctcatgcctataatcctaacaatctgggaggctgaagtgggaggatgacttgaagccaggagtttaagaccagcctggtcaacatagcaagacctgcatctctaccaaaaaaaaaaaaagtgcatgatgatgcatgcctgtgatcccagctgttcaggaggctgaggcaggaggatcacttgagcccaggagtttgaggcaacagtgagctatgattgcaccactgcattccagcctgggtgacagagtgagatcccgtctgggccctaccccccaaaaaggttttattttcaata

SEQ ID NO: 104868 - DNA, 1255 bp, Homo sapiens
tagtttagtctctttgttttttactaccttaaatccttaaccaaaacagttttgaaaactataaaacctttggggtttaacttctctttttcccatttctactcgctaaggcaagtagaaatgagtgtagtgaagtggccagagactagtactcatactagaacaaagaagatactgtattttgccattgatgtttgatttgtttctgtaatgtgacttgacattttacaagtataaggaaaacccaaaatatctaatatagtgggaaaatatctacaattgtgagttgtgtttctgtaaaaaagtcagtgagataaaactgttcagaagcaaagacttactgcttggtttttaaaaaaatatatccctgaagattaaccattggaaaaatcacacagtgagatatttttcctcaggaagagcatttagttgtaaatgtactgctgtaactgtcctttggagagttgctttctattacagtgtttgttatcagatctatatgtagaacattttccctaaagtgagttcctactctatcactgctaaatttagactctaagcacgttttgtgcaagagacagaattttgcaagaactgcatgcctggttgccatttaaagatcataacaaatgtgtctgattttcagcctgtagcaaaattgtggtgatgctgaatttgagctggaaggaatttaatgtgtgttggctatatgcaataagcgactatatagacagcctaaaattaataccatatttatagccaaaagcccgttttataatttggcattctgaaagtagaatatgtaaaatggtttttactttaactagtaattattgtacagctggaaagaaaagtggaagcatgccaacagaacagaaaacaacctcttaaaattaaaatgaaatgatggccaagttttagaaaaacactggctgtagatactaaaagttcacaatttcagtttatatagtcattcaatcacagaacttaagaatacttattattcctttaaaaaatgtgttcatttttatgaagctctaaacatcctcagactagcctctgaaactcaggaggacccagtttaccatcctatctatctttcataaatgatgatagaaagttatgagattgtctgcttgatatcacccagtaatgatttctggaggtcacaaaggggccccactgttcccttttctcagtctgtactcagatggtgagtggttctcaaaccctttggtctcaggaactatggatt

SEQ ID NO: 104869 - DNA, 1063 bp, Homo sapiens
ttagaggcagatgatagggcatgggtgctgggtaggcggtctgcctgtcatgttttactgtgaggaattcacatttattccagctttaacagtcaaaggccgtagaaaccttctttttacctatagttttcattcttgcatattaaattcagtgcaactatcccaaaagtaaattctagaagatgtgcttttagatggacattttctattttatcattatatgtaattactgaaatgtttaaatttcactttacagcaacaaatggtcattcagaatgcttacggctattaataggaaatgcagaaccacagaatgcagtggatattcaagatggaaatggacagtaagtttcgataaataattgttgcatcacagaagggcgtatttcgaaaaccagagtacagtcttaagtgacagcactgaacctattcctgttgttgctcaggacgcctctgatgctatctgttctcaacgggcacacagactgtgtttactcattgctgaacaaaggagcaaatgtagatgccaaagataagtggggaaggacagcgttgcatagaggggtaagcagaaatatgctctttcctttcaaaaagcttttatgacctcatattacctagaactgaactaggttatgtttattttttcttcattaaatgttcgtcaaatagtctttaccatttctttcagtatcttagtttttaaatgctaattttgaacaattacagagtacaacttaatctagagaacaatgttagaacaaaattttaaaactctaaaacttttagtagaattaatgtcaatttgactttttccattatctcacttattttcttatacactttaatcttttttcacctttgaaatatcattattttcattgaataccaagtttctctcttcctgttttcatactatttgcattttagaagggttcttgctttaactgaatttttaaaccacttccaataaaaatacagaattactcataaaatgataaatggctttaattgatggaaggatatggagagtatggtctttaaagtttttaattagctgaaa

SEQ ID NO: 104870 - DNA, 1446 bp, Homo sapiens
gagtgatccttaagaatacatttgaatatatgtcttggattttttttctagtcctttgggaagcttacattttagaagactattgataacacccactgttactcccagagccgcccttcaaagctatcagatgttcaagtggggctgagaaaaatattttaataatacattagaacctctaataaacatatatacactactatatggtttgaacaagaggttaaaatgcattacttgctgttaccttattctgaaaaagagtgaagttatatatcactttgcaaagccaaacttggtggcgcatgcctgtattcccacctaacttgggaggctgaggcaagagggtcacttgagttcagtttcattgcactctaggcaacatgatgaaaccctgttcctaaaatataaaataaaaatcaattttgtacactggatgggatctgtgaaaaataagtacattttaaaaatattaatctatagctagaaaaattataattgcagatcatatgcagaactaatttaaagcttgcatggagtggttgcactctcaataggtaaatattgaactgagacattagccagtcccttagaagtagttaaccaatgccatatagttcagcataaatcctacccacaaaaagaaccacaggttactcttagtgcctatctattcaataaatgcaagccttgtatctatagatgcctttcaaatttggaggtctatagagagcatctataagccatgaaaagaacactgagggttttttttcctggaggtttaccagtcatttcccacagagatgctgtgcttgctgtttgggtattgaacttagatgacacaaacattcatcagtagcgactgtgaactgagtgtaaatgaactgatttgaaaaatgatgggccaaacaagttcttcttgaacatccccaagtgttacgaccctgttttttgttgctaagctgtgagagctgctggcagagtgcagcatacagattggactagggtaggagaggtgatttaagccacaagtttaataactattagtatttaatataactgtgggaacatactgtggaatattcagcacctagcttgcttttgctagttttgtcatcttttaattagaagaaatagtgatagacgttcttttctgtatcatatgcaagatacatttttttctaatgtatttctttaaacttcagactttgtatatattaacaggacctgaattttgcagaggatttaacttacttcaaaagctcttttctttggactacttctacttgtacccttgcccattttatgcatttggacttaacacatgcattctttagatggatcatttttcttgtactgtatgtatatatatatatatcatttgaaattatttcagccataaataacagagtaccctactgaaaatagcttaaggggtttagtgtctca

SEQ ID NO: 104871 - DNA, 2220 bp, Homo sapiens
atcatgttttataagtttgctgagttgccaaataatactctaaggtggatttgaactgggtgggtgggagagaataattgctgtagtatgtctttctgacatttaaaatgcctcttctttttcagttaatggaaacctcaggaacagacatgctgagtgattcagataatagagcaacaataagccctttacacttggctgtgagtactgccttcatagccgacttgatggctgctggtttactgaaaatatctaataacctatttgtgttgactcaaactagtaccataaacttttggtccatgtaatagttatcatggaattaaaactttgagaactttctttaattcagagaattacttaatgtgctgggtttttgtttttgttttttctgtttcttgctttagaaaaaaaaaaaaaagacagacagtgatccttaggcttcccccagggccttctggggagagaaagggagaaaatatggagaatatgcctgtgatggtgaattttaaaatgtgctgccctagtggaatgccttataagttggctaagcagatggtatacacacacattctgtggtatttctacaattttttgcttactttgtgatcttggggtgctaacttgttgtgtgttcactggtcctttagttgctcacactataggatttggctacattgtctgttatgtcccttccactttaagattcctctaaattttttttcagtgtcaatcactaaatggagaaggttagggaagaatgtgacaattttttaagtcaaatgagaatttattaccttaaatttcaagtagatcctaatctagcttcctgtacagaaagaatttatttttgagacaaagcatgttagagttgtagggaagggggtactttgagaatcaggagaccagggtactctcaccaggtgtttgtgagatccatgatttttagtaaaatgcttataaggatgtatccttaatttaatgtggaacactacaagttcagttattcatttgattgtttcttttcatatgtactattattttttatcttaatattctccttgcgggtgttttaacactgacatatatacattaaattttctgccatttctccctactgatacttcctatcatgttctaaataactaagaaagcattcttgaagctttctacttctttgccctttgagtccttggaaacaccatcacctctcccagacatgcatagtaaataagtctgaaaaggcaaagccagcatggaagaaatagccattttactattgatgaaaagaaatgaagactgagcagcattagcagcagcagcagcagcagcattctcattataataatttcactgtcatttcttgagcactttctaggtgccagactatttccgccttgtggagattcaactagtagcatattaaagactcccaaaagccctgcagtctttaggacttagttatcagtttaatgatgttgtttccttagaaattctcatttgtattctaccccacccttcaatttggcaagtttctctttttgtgcttgcaagttaacagtgtgctatacattgattagtgggtcggtctctctctctctctctctctctgcccccccattactatttttttgtcagagattttgtatgtgtatatggtggtaatggtagaaaaaagaaaacatagcataaaacgtaccttcttaaccatttctaattgtacagttcagcagtgttaagtatatttacattactgtacaaccaatctccagaatctttttatcttgtaaaggttaaaactaaaactctgtacccattaaacatctccctgtttctcctttccccagtccctggtaatactagcctaccttctgttcctatgaatttgactaatctagacacctcatttaagtggaatcataacagtatttttttgtgttgtgtgactggcttatttcatctagcaggtttcatccatgttgtagcatgtggctgaatttccttatttttaagctgaataattattgttatgtatatagcacatttttctttatccattcatctgacaatagatgctgggttgctttcttctcttggctattatgaataagtgctgctatgccataggtatactaaatagtgtttttaaactaaaaattgaaataatttagtgattaggcttaatgaaatatgattataccaccacttttgcatttcata

SEQ ID NO: 104872 - DNA, 1014 bp, Homo sapiens
ttctagatagataaatagtaatattgccaatattatgtactcaccaccacgaaaagtttaatcctatccaacattgtttagtagaataggtggtggtatagatagagactgtgtaaaagatagccttcacatatgaaaaaaaaagctgtctgacagacttttgaggtatccactttgaatcaagaagattctcatgaatgtttcatttgcatttttatgatactttagtcagtgtcatttaaatgacatttttatagtgtaatacatttatgatttttatattactcaagtataagaaaaattgtcagtttttaatttcagtctctttttatcattggttaatatgcaggatttaggattttcagtatgttgttgttgttgtatataggtgcctggaatacttattaagaaacgatgcaaatccagggatccgtgataagcaaggatacaacgcagttcattattcagctgcttatggtcaccgtctatgtcttcagctggtaagattcctgaattcttgtgaaagacctaatgggagtttatagtctaataatgtaacaaaaatgagaataaatggatcaaggaacaaattccattttgttttttaacattttcagaatttatatacctcttaaattcacacttgctttagtaagatatatctcattctcttttccttttaaaaaaggagaaaattagatctctgaagagggctactgattaccccatgttcatgtctacactatttacttctcctgcccctttaaattaatattcctcataagtttctaaaaaactataactgtgtcttttgtgagaaataaaagtccctgtgaaaggaatatctcccccatatatttagggaattccaaaaggcacatttatttcacaacccctcctaacaagggagactccacttctgcagaggacgtttttatttctgctgtggtctgattctggaatagaataccaccattcacccaaatttaccaaaccagaaggaaagtcaaggaa

SEQ ID NO: 104873 - DNA, 1344 bp, Homo sapiens
aaagtgtatgagaaggaagggtgtatgtcagaagaaaatgtgtgaatatatgtcaatgcatgtgatagaaccagtgcagaagagaagtaaaaagaattatgcatggtaggaaatcagaaatgaatagaagaaaataaaaactatttgacaccataattactttgaagaacagattgctctcataagcctacttaatggaaagaactaatgacccacaaaaataaaaaaatcactttggctttggaatgcaatatttttatagctaatttgcttttataattatactttaatccagtttatattaatttttagtacttcaggcattctatactacaaataacagagagggcttctgaaaaatgctttgagttgagagggttgaaagtaattcagggttaattacattttttttaatgtttcttctatttttttctcttaccttttgttcttcttctgagacatgaatagaaattgctacctctgtactgtggaacatttttattaatgtaggggaaactttcctaaaatgaaagttttcacatttctgagcagaatatgaaggttatttgaaagtcactcaaaggactgggactgggattgctgctactgcctggaggcgatgaaataactgcattttcatcttatttcatatacttaaaggttctctgccaccttgctttcttcttctagctttatgtccagtcctccgcaagacttagtatatggtagtctaagtctcactgtaaataaagtatttgtaactgggaggagtaagagtcaactatgcttttgtttactagttatgtctctggcttttatctttcttgtattaacttggacccaaaagatctccactgcactacgctgctgccaactgcaattaccagtgcctgtttgctcttgtgggatcaggagcaagtgtgaatgaccttgatgaaagaggctgcacacccctgcactatgcagctacatcagacacagatggcaagtaagtaccataggagtgagagtggaggatcaatatttctataaactggcatcttccatatggatgtttttgttgcaaatttgtgtttcctctttgtattttttgttgattatctttgccctaagtctattttgggaaatagattggtttcatagttattgataaatcatagttattactacctattctcagcaccagccttactagctgatctggtggaagaaagataaaggtcccttcttgtcctatctgccaaaagagcatcttaatatcacttttatgtttttttccacctgacttcttagaggctacagccgtgactatatcatggggaaagggagagaggagatatatga

SEQ ID NO: 104874 - DNA, 1022 bp, Homo sapiens
gcaggagctgtaatcgactgtgaggataagaatggaaatacccctttgcacatagcagcacggtatggccatgagctgctgatcaacactcttattacaagtggtgctgacactgcaaagtaagtacttaccgaggtgttgataactgatacaggcaagcacaaagggaagtgaactgcagttttctagacatttcacgtggaaatgtggattttatcctcaatgttgtattaattgcttgaactttcttttgtattgacaaagtggtaggttaaaatgtttaaatacaattttatttggtaagccagtgtatttttatgtatgttaccccagttctttctcactttgagtaataacgcagttttgatcagagctgttaatttttgtgatctctttatttttaacctagaagtacttaaaagtcccagaaagctgtatgtgccagatgcttttttttaatccaaatactatctgtagataatacttttcaggctgtgctgtgccaagctcagggattccttggaatcctacgaaggagttcttacccccacccccattttggtcagaacagtttgcttgtatttattttataaattaaagttcccattgtaatattttgtttgaaagatgagtcctcctgctaatgctctgcaagaaacaccatacttaaatttatgtttatcattctttgtatcacatttacatgtgttcattaacaagttttaaatcttttttactttctgtaatggtatggtactgcacctatctgttttgtaactttttccaaaaaaattacatgagcttattaatttagccatctagatagaaatttaggccttctttcacatctgtacaagttgctctagttcatttattttatagaattattgtataaagatttcacaatatattcattctccttatttgcaaatacaagttgcttacagtttttcactattacagaattactacaataaatattcttgaacatgttgcattatggaaatgtttcaatggtgggg

SEQ ID NO: 104875 - DNA, 1047 bp, Homo sapiens
agttaaacttaattcatgtaaaatagttataaaaataaagatgcaagagggtattcaaagtaaaactaaggtttacacattatggatatagtagagtgagtaatttttttcttccccccccagagtaaagatgggaaaaccccactacacatgactgctctccacggtagattctcccgatcacaaaccattatccagagtggtaaaaagtatttctgttttttttttggggtttttttttttttttcttaaatgtagtaaaaacatccaccaaatgaatggtattgaggaattgtcatcgcattttgtgtatttttaatacatgatttcagagctcatgaaaataaaatattaaagagtataaaataccacgtagctgtatctttcatacttttgttttttatgttttgtttccctgaactgtgttatttcttcagcagttagtattagcttttttcaatattgctaaatagaaaattactttctaccataatttgtattatatattaatgtgtgtactctgtatatacattatacatgtatcattttcccctgttgagtatctgcaactattttcaggattttaatttcttgagtttgtattcttttgtgtttaaattaatatcaggcaagctaaacttttaaatcaaaagaacttttaggtgtattactttaaatcagtgttttccaaggcatattccaagaaatttatcctcaagataataggtgctatggttttgcaggggaaaagttgaaataggttcatgatccaatattttttgaagcattgcatgcagtcttgatgacagagtatgcacattaaagctctgaagtcttgctctaaagaaacgtgtttaattttgttttaatacagtagtttccaaacttattggaccccagaaccctcttgtcaatttaaaaatctactaaaatcttatgcttaattcacacaattgctttaagtataaaagctataaatccattgcctggcccaataaatgagctatgaatgaaatctagttaaaattgctgtatctattagtttgt

SEQ ID NO: 104876 - DNA, 1117 bp, Homo sapiens
gtcactgcaaaatgaaaaagatgaaaatgtgcatgttactgaatatacctcagaatcttcagtttgtgttcattttttatgattataattaattctatagtaaatcctttacctagaacgcctttaaaaatacattagtttacgtttccctgaaatacctcttttgtattattcagttttgtcatgaagtagacattgtgtatgtgaattatattccctgaatgtataaaatcaatgtaataccaaaatgcttgtcaagggtttattattttaaaccaactttagaattataagccttatctctgtacttatcttgtctccgtttctcactttagtaatttgattgcaaccacaggttgctaaaatagctcacaacattgataattagcaaaactactttaacattcgcatttttttcccttctaatagatgaatgaaccaaatgcctatggaaatacacctcttcatgtagcctgctataatggacaagatgttgtagtgaatgaacttatagactgtggtgctattgtgaatcaaaagaatgaaaaaggatttactcctttgcactttgctgctgcatcaacacatggagcattgtgtttagagcttctagttggcaatggggccgatgtcaatatgaaggtaaggaacaaaatcagaatctataagtatttcatatgtcactgttaaaacaacatcaatggtgaataccattgagcaataaaaaggaatattgataaactcaagaacatggataaatctttaaaatattatgctgagtgaaagccttactcaagagtatgtacattctttccatttatgtaaggttctagaaccaataaaattccatttatatggggttccagaatctataattgaaaaaaatcacaacaattattgccattgtgaggagggatcaactgggaaaggggcatgaagggacgttatgtgatgatggtaatgttttgtattttggcaggggtttatgttatatacatttgtcaaaactgataaggtggttcatttgtatgctttcatagcatataaattttctcttagaaggaaaatactaaacagatgtttaaccctagttaatgttgtgtttagaggtgacatg

SEQ ID NO: 104877 - DNA, 1003 bp, Homo sapiens
ataggaacaaaacctcttattaaatatttcagtcttagactttccagatttgtacttagttcataaaataccaaggcacaaagtggcatcctaaaaaggtactgatgcctgacttcagtagcacccacagttaacctttttttcatgttttgtcctgttatgttaaatgaccttcagtatttagtctagctccttctgttcagcaactgcagaaatttagtgccagagaagttgagataagtaactgtcagaaatgtacattcatagacaattgtgcttcacaattttgatgacactgtgtttacttctattccagatggtcaaactactcttgtctagaggtgccaatattaatgcttttgacaagaaagataggcgtgctatccattgggcagcatatatgggtatgtactttttaaatttagtttttgatattatatatttagaaaagttgtacatttcaagttcttgctgtttgtatagcatttgtctttaagggtactgaaaagctacacagtatctgagtttgatgcccaggtagaacaaccctggtaatgggggaggtttggagtacactgggtccagttcatctaaaagctgtttgaaattaattccatttacccttaaaaaaagagatgtcccagacacaggcctggaatacataatttaggattgatgtttactaaagcccattcttatacccatttttgtttgtatgagaatataaggtaaaagtaacaaagatgcattaagaagcctattattttgggccaaccagtgggttaaatgtgtattaccatgtttgatttctataatagtaaatttatagaaagaaactggggcttggaatacagacttttttgctgtaacataatatatatgttcttgaaaaatcttacagtctgcaaaattgtactctaaaactaatagagctcatgggaataataggcctggggtagaccacccaaaacctatgcaaccgtgtgaccacagcactaacaga

SEQ ID NO: 104878 - DNA, 1048 bp, Homo sapiens
agcgcactacagcccagaactcctgggctcaagcgatcctcccacctcagcctcccgagtagctgggactacaggcacgcgccactgtgcccggcccctgtctcctgataagatgttatcaatgacaatgtgtgcccaaaacttcattagcaatgttaatttcacctggtcctgtgatctcgccctgcctccatttgccttgtaatattttattaccttgtgaagcatgtgatctctgtgactcataccctattcgtacactccctccccttttgaaaatcactaataaaaacttgctggttttgcggcttgggcatgtgatgtctccccagacacccagctttaaaatttctctcttttgtactctttccctttatttctcagaccagccgacacttagggaaaatagaaaaggactcactttgaattattgggggcaggttccccgataatttaccaaaaattaggattatcactgaaagaaaaattttgttgagtttagttctgattatattgcttaatgttgatggcatactgaattccttggaatcctgccatgagtccaatttatagaggtagtgttgtgatgttttccatgcgcttctgggagataaatcccttggacagtagactcttaaattgccttaactttctctctaagcagcactgcaaaaagaaccttgtctatgttgtgtcttttttttttttttaatgaaattgatcctagtgatttttcattttgtcaaatatagcatgtataatacattgagaaatagtatgtttttaatttttatatatgcagtgtaaaaaatctattgcttaaaattgttcaaagagccaggtgtggctctatgactggctcatgtttgtaaccccaacacttcaggaggccaaggaaggaggatcacttgaggccaggagtgtgagaccagcctgggcaacatagcaagaccttgtctctacaaaataactaaaaaattagccaggggtggtggcatgcacctgtagtcctagctactcaggaagcaaaggtgggaggatcacttaa

SEQ ID NO: 104879 - DNA, 1032 bp, Homo sapiens
ccataatttttgtgagtattcatatatgtattctttccatattcctttttaaattgaaatataacttacaattaaaatgcatgaattttttagtgtacacccttaagttttgccaaatgtatacacctgtgtaacctttatcccagtcaagatatagaagatttctgttaccccagcaagttccctcatgtccgttttcagtcttccctgtccccagaggcaaccactgttctgatttctcttagcataatttccgtattctagaactttataaaaatggaatcatacaatatgtattcttgtgtcacgacttcttttgttcaacgtttttgagatttatccatgtttcatgcattattggttcattttcattgctgagtaatagtacagatatactgtttgtttatccatttttctgttgatggacatttgcatttctggtttttggtggttaggaataaaactgctatgagcattcttggatggattttttaaatcttttggataaatcactgttgtggaattgtggagtgataggcctccatatatctttgattagctggctgacttccttagcaattcgatagatgactgggcatttcttcagtcttttgccatccctgttaagtactggtgctatttcccatgtttcaaactgttctgactactttttatttcagaggcctaaaatggtatgggtgattcatggctaatagcattttgttcagtcttccttgatgctctgtatatttatagctattttcactttctaacacttttcatgtacattagtttattgtgctttatagcatacttgaaaagagtggtaggcagatgttatttcccccacccccatctcctttacagataagaacatttagggttagttttataggacttgaatagtatgccttgtaaataatagaattgacatgagaacccagatctctttcggttttggtcgttttcattttcatatgtagtttggcattcatttactgttgcgggaagtcagggaccccaagtggaggg

SEQ ID NO: 104880 - DNA, 1040 bp, Homo sapiens
tttttgtgccagccaccttctgttttttgagacagagtctcactatcttgcccaggctggagtgtgtggtgcaatctcggctcactgcaacctcttcctcccgggttcaagtgattcctgcctcagcctctgagtaattagacttacaggtgcacgcgggccaccacatctggctaatttttgtatttttagtagaggcagggtttcaccatgttggccaggctggtcttgaactcctgtcttcaagcaatctgcccacctcagcctcccaaaagtgctaggattacagtcatgagcccctgtgcccttctattctcctgctaattaatactttgaatcagacttctcagcatccctcatgagacctcatttcttatttacctttgttgattcaggatactgtctgtactaggtgtctgtgttgataccctttgggccttactgccagagctttccgttctactgtgtatagatatgcatgtgcacataaatataaacctgtagaaagaggcacagggcttaaagagaaccattgaagtcctaagcagataagtgggaaaacgaaagacgctagcttctgtgtcactccttcactatctgtagggttccagcttccagctggcaaacatttcaaatgtgtgtactttgtacattccgtcttctacccaaaacaaacgttggcattactgtgattaggcagtttgtgttttaaccatctagggttccacagtgcctggcagatagttgcccaaatatttattacatgggtatgtcatgctctctgactggttctttatttgctgtcttcctttccttcttccatagcctaactgtgagcattgttcaaagctctctaattagctcttgattctttgtgtcctcactgccactgcccacagagaactcagctactctcagcatctcaactactacatttgtggatgtttcttacacctccatttcatttattttctctcatttttcaaggctttaaagtctacctctaacatatttgctattatgtactaggcacatttatt

SEQ ID NO: 104881 - DNA, 2182 bp, Homo sapiens
tgacatgatttggttttatgaaacttctggctaatgtcaaaagtgattattgctacagggaagaaaacttgtagattccagaactatgtaaaatatccttagtcaccccacatggatgattctaatgtttttattactctcttctattttagccatcactggtgcaagctatatttaacggagatcctgatgaagttcgagcactaatatttaagaaagaagatgttaactttcaggtaaaacagttaattcactgatgccagcctttaaaactgctttttaaaattctttcctagaattgtgatttttgtttacaagacataatataactctgtaacagttgttttaaatgagggcaggaaggtattgaggcaaaagggaaaacactggacatatactcagggcagtagcagccagtaggggtcttttgttctcccagctttttactttgaaatttttcaaacatagggaagttaaaaaaacatgctgactacccatatacctttcacttacttttggcattgataacattttgccacatttgctttctgtatttattaatatacaacttttacatatatatgtagtaagttgcagaaatcatgatacttcaccattaaatacttaactgtgcatttcaaatgaggattcttgtaagtgtatatctaaatataagatcagatttgctttttgtaaataatcatggtgagtgttttacaatggtgcttgattaatttttgtcagattaggttttcagtaaagtcattgttggaaaagttttcagacttaacgatacagtagtatattcagtgctgacatgatggacagttttagaaaggtggatatatggataattttctctctctgttatgttttttcagtggccagtatttagtttactaagttgtggctgaaagtacattacgtactctaacaaaattacatccactaatgtatatatttttaccagaaacaaatgtacccctgagttatggagggggtgaaaagtcatatgattcacaaagtcgctgtggcaacaccaaaacagatgacctagaaatgattgtggttttaagaaagcacccattgcaagctcatttttaactctcatctttcctccttttttttttaatataatactgctgtgaccacttaatgttaggtagatacaaaaaagttttaccttatttttaaaataatgaattatctgaatagatttgaatcattggctaaaactgttgttaattttaacattgggtaatgaacagaatgctatcattatatattttttaaaattttttctaagtgaattgccttcaagtttatatttagttggaaacatgcacctaattcaggatttatgtatgtatgtatgtatgtatttatttagagacagagtctggctctgttgcccaggctggagtgtagtggcatgatctccgctcactgcaacctctgcctcccgggttcaagcgattctcctgcctcaacctcccaagtagctgggattacaggcacctgccaccacgcccgattaatttttgtgtttttagtagagacagggtttcattcaccatgttggccaggctggtctcaaactcctgatctcaggtgatcggcccgccttggcctcccaaagtgctgggattacaggcgtgaggcactgtgccgggccatgatttatttgttttaaatgaagtgtctggctactttacccagggtatactgaagagtatgcgtttcttagaaaatagctcaaggggtatagacgcatgaaaaggtggaaaacatgttttccatttaactcctaaggttttcttgttattttggttttattttaatagtactgacaaatactaccttgattagaaagtttgaactataattccatttaccagggctaatttctccatcattacaaagtttattgtagctgacattacttttatgttatatttaatcaatttatcctaaattaaaaaaaaattcagagtcattgagagcatcagctcactcatcagtaggcctttcttgagagtaactctttgacaattgtcttcagtgatacaaaggtttttgacaacaacttttatgattgcttttaggccttttctctcgtgaccctttcttagtagttgagagtgttgccttaaagtcaagatttgttaactttttggccatt

SEQ ID NO: 104882 - DNA, 1926 bp, Homo sapiens
ctaacaccatttctgcctggtgcctgtgcccttttgctggagcagccacagacaactgcctgatggagaaagaatgaacgctctgccttgcttatgctatcgatgggaataaagctaactgtgtttcttctattatatgggaaacctggattaatcaagctgtattctagtaccaagagtcgtattgtctcttgtggtctgactcatcacatgtaaacgtactgcagctttgctattaatgcagagtggtttttttttttttgtttttgttttttgcccctttcccaaacactgaaagaattgttaacctctgagcttcattttcaggatttgtgctgagctctagatcttttttctgtgaatagtatctgcattaaaccagtgatgaagaaatgaagacaaattagaagtggaaacagaatagtgagattttattttttattttcaattataagcaaaacagctactggtaactatatgaccttgcaggcaagagtgggtatcgctgtgatcatctctgtcacagcagttgtttctcatttcattctatattgtgtggtgttgtgtcaccaaaaacaatgattgttttgtgcaagtaaatttcagagatagagcaataagactattttggtagaggaaaaatatttttaaatgagcttggactcagttttagttattgacatgttggtgtgaaatttcttcttaagtattgcagtaatccaacagaaataatagaatttcgttatatttaggaagttacaaattatgtagtcataattttaaacttgtttttccagtagtacttattaactttaaaaaaaaaaaaaacccagctgtgctgttcagagaatgtttgtaagtgttgtacagaagaggaggaaaaactacttgtgctcttccaactgtgacttttatcacatagcttggaatttagtgttttaaaagatcgaatgagtcgagtgtgtattgttgttttggaggaggtagaagatgaatctcctgcattcatttctaaattgccacaggaaaataaatccctacattctccaccttctggaaatgtattggtaagatatgtaagtttatatgtttactatattctactgaactagtagtataaatcttgttttttaagaatagatgtaaatttccaatagtttctttacaaacccaaattaaagcaatacgtgtgtagatatgatgcagtatttttgtataaaatgcacatttttcgtttttacttttttgaatgctgagataacatttcagtctttactatgtcttaatctctttaaaagactgtttaaaaataatttgagaattagtagttatggcaaccacgtttctgttttcattttgtggtttcagaaactgatgtaacaagaatcaggaactctgcatattttaggaaaggttgactacccccagcaacactaaggcatggccttttctgtaatgaattttatgtatttacatataagactttatatgagattcagtcttcatctttaaccttggttttagtgctactgtcagctggctccttgactagtatagtataccttatcaagaggctgtatcgttgattaagaaattattatatttagttatgcatgtgtttgtcttttcaagttatttaagtatccagtattttttggtctttgattagtggctattttcatcaactgccaggtttgctttcttgggatttgtatctttatacatgtaatgctaatccatgtaagataatttgatgccccaaacagaccttttcaaaaaagccttccttcatgggctggaaattgcttaaaaagttctgtcccacaagtagatgttgagatcacacatttgtatttggaagagtctttctttttgtcatatacagaaacaaaaggcttctacttacaagaaataaaatctgatttt

SEQ ID NO: 104883 - DNA, 1013 bp, Homo sapiens
tattacaggttgcaaagatctggagatgagtggagagaagagagtgtgtctgtatgtgtgtgtactcagtgatagcagaatagattagaaagagtatgtgtttaaaataacacacaactttattaatttatacaactttgggtaaaatacatcatttctgagtctgtttttccctctataatgggaatacagcaaggttattgtattaaatgagaatgtacagcacatagcatatcacagatgttcaaaagtaactattatgtttattattgtttattaataaaaatgctagttaatatgaagaacacagattgaagggggaccatggtattttctttgtaagttttctcttgagaaatatcccccatgttgggtaaacagagaaagaagaaaaaaaacgatgaaatgattggctttgacatttatttatggctttgggaaatttatagggagggagattatttgtattaccctgtgcccttttgacataggtaattcaggacgaaggacattttttttttcatgtacctctttaacagatttttaaggctttattccctatccaaatgggaaggtaggattattttatttcttcagtgaaaaatcaaatgatttatataattttagagttaggatttctacattatgaaatttttgcttttccctttaaaatatgaatcaatgattgattaaattcaccaatttagaaattgttagacaatcttaaatttcatttgtttaagctttgcattctagaaaataaaatacacctggcagattaaaactgatcttggtaaaaatatgaataaaacaatttcatggtttttataatctaataaaatatttctccatctttaaaccttttttatgagtccattgcaggcatattcttactgcaactgtcattatagggttaaacatttgctttattgtaacacacgaaagcagttaagccgtttggaattgtttacttgctaaaaccactgttagtcagcagaggcagtacaccagat

SEQ ID NO: 104884 - DNA, 1260 bp, Homo sapiens
gttcttatctatcctggacaccgtgagccattgcttttaactgctcaacagtcacttatactcacttttaacaattatatattataaatgatagttttgaatcttcaaccattttctgaaaaatgtgatagagtttttacatggaatgttctaactagcagaccattgatttctttgacaaagcacccttcctataaattaaaggaggagcaaaataatgaggtttatggagagttttattaaaatatccatttttttagagaatggacagttagaaggtatctgtatatgtcagttacaattaataacttcatatgctacactctttcctatgatggacttggtagcaggtatagtctatatctcggccttcagtatatactgtcttttactgtcttttatcttgtactggttagatttttacgtgtatgacataatgccctatttaagttgcataaggagtttgaaggtgatatatgataccttataattccttggcatggtatgtatagtagagatatgaatgtctaataattgtttaatcagtgctgtggtatttttgttgagtgttttaaaaagtaaggtattcttgccaaaagacttttagataatttcagtgtactggattgagtagaattgagccagatctcaccattctttatgaatttttttaatattcacctagatgtaggcaactttgggatttaacatttcatttagaagtcatgagggtagatgctaagataatgggctctgtattaagtttaaaacagagtttgagagcatgaaatgcaccttagatattgatgtaacaagtaacattcttcattgtataaatttggaaactaaaaaagtcccaaatttcttaaactccaataagcactggttgcttaagtcaaaaacctgggaggtttctgattatcatcttctccatcactcttgtagccagtctattaacatgtcctataaatcctatttctaaaatatatttctttttttttttttttttaaatggagtctcgctctgtcgccaggctggagtgccgtggtgtgatctcagctcattacagcctccacctcccaggttcaagcgattctcctgcctcagcctcttgagtagctgggattacaggcacgcgccaccacacccagctaatttttgtatttttaatagagacggggtttcaccatgttggtcaggctggtctcaaactcctgacctcatgatccgcccacgttggtctcccaaagtgctgggat

SEQ ID NO: 104885 - DNA, 1034 bp, Homo sapiens
taccttctaactgtccattctctaaaaaaatggatattttaataaaactctccataaacctcattattttgctcctcctttaatttataggaagggtgctttgtcaaagaaatcaatggtctgctagttagaacattccatgtaaaaactctatcacatttttcagaaaatggttgaagattcaaaactatcatttataatatataattgttaaaagtgagtataagtgactgttgagcagttaaaagcaatggctcacggtgtccaggatagataagaacaaacatacagaagcaaaggtaattacagcaaatgagacaagttgtaggatgtggtcattgaggtggttacagccaagtggaggtggttacagccaagtacagatgactgctggtgtggaggttgttaaatagttaagtatgttcaaaatgtcatctacaaagaaatgaaatcacctagatgacagacaaacatgatccagatgtggaactggggtatgagatgtgacagatgatagcaacaagaaatagaaggatcacctagccaaatggtatgtgcctcaaaggaaggaaggtttttatagacaggcagactagtaacattttaacactataatgggggactagaagaatgctgactttgcgctctttcctcctcccaacacacatgtacttacgtagcaggtacttacgaaaacagagtttcactgacttttccaagtaagtgtagattcaacagttacacatatgaacttaaggtttaaatcaatatttagatgactatttttagatttcagccttaagagaattacttccttccaaaagaatataagtaaaaaattcaacaggccaaactaacacaggttagttttctagaatacacctaatatgccaaaactaaggaacaaagggagaaaaactactctgttagcaagtatgtagtactgcatttaagtaatgtctttaaaagttaggttattttcttcataattttgattaccttgagaagcagtttgaaattaaggaaaaggactc

SEQ ID NO: 104886 - DNA, 1033 bp, Homo sapiens
tccacccaccttgacctcccaaagtgctgggattacaggcgtgagccactgtgcctggcttagaaacattttaaatgtattaactttttaggtggtactatcatttacatggcatctatagaaaaccacaatttcttaatttataaggttaaaataaaggttttaaaaaaattgtccctggccaggcgcagtggctcacacctgtaatcccagtactttgggaggccaaggtgggcggatcacgaggtcaagagatcaagaccatcctggccaacatggtgaaaccccgtctctaccaaaaatacaaaaattagctgggcatggtggcgtgcacctgcagtcccagctcctctggaggctgaggcaggagaatcgcttgaacccaggagacagaggttgcagtgacctgagattgtgccactgcactccagcctgggcaacagagcaagactctatctcaaaataaagaaaaattgtccctggtaattattttgtcttttctcctatccagtagctgttcagactcctttcactgaagcccttttatttcacaaatactattttcaaattctgcttttttagctaccaaatgactttttgttagctaccctacttaaatgagttgagtacttaagtctatagagtctatttgtgattgtaacagattatggagatcttaattcagggaaataatttcttctaataaagcattctcttattcttttaaagatcaaaataaaacagactctagaataacagtgtcccttaacaacttactctgaggccttgtttctccagtctggtgtgctgttatttccttttctgttctttgtagggttatttagataaaaaataaagtcataaaaacaagcatcttaaactaccctgttctgtagtctgctcttcatttgctattttatagcttttgagttatgaatttataggggattgtaggtcagcaagtttaaagtcactcacagtaggcttggtttgcctttgagtctcaggcttacaggagttatgggttaaatga

SEQ ID NO: 104887 - DNA, 1039 bp, Homo sapiens
ccatgggtaaataattgctgattagtaagtaactgaatatattattagtgaatgcatttgaaaagtttgtgtgtgtatatgtgtgtgtgtgtgtttgtgtttaagatttatgagaatgacttgttgctaggaattctaagaaacaaacaccactttttaagtctcttctgggaagccaattctgtttaatatataaagaaagcctttaaaaaatgttttgttgcccagattagtattttttttcttgatagaaggataaaagtaaattctgaattaataaaatccaaagtaagtttttgaatattatccaataattcaatgttttgttaaggtactagttatttataaataacatagcccttaatttctaggatcagcgtattctttcttttgatatctgttttctgctacaggcctgtgattggaattgaaacagtacaactgcctccaccagaggaaaatagtatgggaattcctattatggtaggttattttctagtagtctcttgcagtaatataggcagctcttgtaatttgttagtttgttgctgtttaagcctccttgtaacttagctttcatacataactgtatgtgagtaaatagttagtgtcagccaaaaagtcctttattgtagaaacatttatagtagtggaccctgtgttagtggaagacttagtatagccgttttataattcaagtaaattttcagtggagggggcttataaatctaagatctctgtcttggagaagaaaatgttaaacagctgaaaataatggtatcgcaactagttttatttattttgttctgaaatactaaattactaaaggttttcaaactttggtttagatgtatgcatccttttgctcatagctcattctcttacatgttaaatgattgtgctgcacactttaaacattaacagtcattcagtaatcactggggaacctcaattatttgagtgactcctatgttttcatgaaagtagtttttaaaaaatctcacaacctccaggtgtgttggactgcaggcactagtga

SEQ ID NO: 104888 - DNA, 1328 bp, Homo sapiens
actttgctaaacttattaattctaggcattttttaatagattccatggaatcttctataaagacaatcatgttgtctgtgaatgcaagcacttttatttcttcccttccaaactatatatcccttattccttctacccttatggcagtgctctttctttcaatatgatattaagtaagagtgattaagagcaggcattcttgcttgtatctcatcttaggaagaaattagtggtttcctggtaattttatatttatttaaatatataaatctcagtatagcgatcacttagcaaaggaatcttagttaattttatttactaggttgccctccagttttcctcataggattcatcaactggtatatcttgtgattcctaaggaactgtatgtctgtctgtctccctctgtcacagatacacacaacaaacttttaggagagcacttattgcactgctttgtagtttactttttatttctcttttcccttattagaaggtgagtacttagagcaataagaaatggtgcctaccggtagctctaggaacttaatgttgtgagcaattgatattaggttggaccatatgaaattgccgatgttagtttataacctataaaattttctatctagttgggacaaaaacaaaataacaaggaaaaaaaaaccatggtacttctactgacaagataaaatcatcagtatgtgaaatgtttgtgcgtgagaaattgttcatcactgttacatgttaaggaaaatcgtagagtggacatactgatgaaatgagtgagacacagcccctaccttaaacgatgctcactctgtggaagactgggcctttacagtattcagatgtgtgcttttgtttgggtttcttttggttttggttttgttttcttacagagacagggttttgctgtgttgtccaggctggtctccaactcctgagctgaagtgatcctctcactttggcctcccaaagtgctgggattacaggcatgagccactgtggctacctccctcctcttttttaatagagatgggttttcagatgtgttttaactctatgattaatctatgcacaacctatgcacatatttactctcagtttggatttactcattatcctagcttcctatctctcagtgtcttggattataagacactttggcaataacttctatatataaattgagacgattgacatactttgataattttatatgaaaagatgctcttatacatttttcagtttcatgtaacttaaatgtttgttagttagcatctagtgggttaaatagtgtagtaaaataaagggcaccaaacactttt

SEQ ID NO: 104889 - DNA, 2000 bp, Homo sapiens
ctcaagtgatcctcctaccttggcttcccaaagcactgggattacaggtgtgagccactacattcagctattgttagcttcttaaacatggattaaatagcccctgtcttgcacaaggtagctatttgggtataatgaaagtttaggaaagaaaaatcccctggttttaaccaagatcacattattgtcagagtttcttcattcttaagacttccaaatactgtttctttagtggtgattcccaaatttgtggttctggttttgagttttcacctaagtttgaatctctctaacatctgcctatttgataattccagttagctacatttgtgttgccccaaattcagcatgactgtttgtaaatttatttgactctgattttattgtgcatcaagtgctataccagactccaaaggacacaagagtgtgtttggagaactgtcaagaagtaaatatggttgcaacacagaggacttgaagtgagaagaaatgaccctgttggagataagggccaaatcatgaagatcctgtgtgctgagttctaagttggaactttattctgaaagcaatcatgagccactggaagaggcaaagcagggaatcggtgcaggattttgttttgaatcaattctggaagatagtatagaatataggtttgtgttgaaggtgaagctggaggcaggtggaactggtagtaagtgttatccatttgaaaagtggtttttacctaagatactggcaaaagggatggattccagagatacttaggatgtaaaattgataggacttgataactggatagtaggggctgaaggagaaggatgactcttcagtaactcctggggatttgactagagggcctaagatttagagcatgctggaagagctggtttgaaggtgaggtgaattcagttttggatatattgaggtccttgtaggacatctaaatggagaagtgttgttacagtagacagttaaatgtgaggctgggcttttaggtgataattaaagtgaatgaggtcactcaaggaatgagaaaaagctcatggcccagcagagtatcatggaaaatatggaatgaatggaggaaagaaaatctaagaagctgctagagttaggaagaaagccataagagattgctatcacaagcaatcccagttgcaccctatattctcttagacatgaagtcttaattttttcatcactttttagtttttctttatttagtacattcttttaaatttttcatggaaaagtttcttgtttgctccaagttctttactttctaagccactgtttcctaactttggagcatacatcagagtcacttggcaagcttaaatacatattctttgggatcctattagacctgctgaatgatgatcttctgggggtaatgccccagaatctgtgtcttaaaacctcttgtggtaaagactagcttgctgtttaccaaacttgttttcttttctcccaggccccagataacttatatttactagaccttttgtgtttggggatggccatatgattgaaatctggccataggaaataaagcagaagtgttgagtgttactttagtcctggcaaatagaaacctcccttgaaagattgtctttcttttccacctgctggctgggtggtggttgccagagcaactttggaaatgaggggtcaaagagaactgaacttctttcagcctgggttgtctccagcctcctcaggcacacccagctgatcattaacatagattttttgactttatgtgagcatgaaataaaaataacctattctgttatgtgataatttgggatttatccattacagcatccactattactttaatcagtggagctctttcgattgttataaaatggtcagaatttaggaactgttgcccttggtttatactgtttgtattttttaactcgtttatatggtaggtaagctttcagctgttgacttccagaccctgtatatattgtgtttgtgaaagcagc

SEQ ID NO: 104890 - DNA, 2050 bp, Homo sapiens
ctcccagccctggcagccactaatctactttctgtctctgaatttgcctattctggatatctcagataaatggaatcatacaatatatggccttttgtgtctcattcacttagcatatttttaaggttcttccatgttgtgcacgaatctgttggtcataaatttttgtatcatgtttaggaattcctaaaagaagttcctgtactcaggtcatctcactgccttccgtggtatgcatatgtgtaatctgggatagtatttatttctgtttttggaatttgttttatgaactttgtttgcagcagtactaaagggtaatagcttttacatttggatcatttttgtgtaggagccatctttgtgtgctcccttatgggttaatggtgaggactgatatgtttaaggtgttgggtttttttttgttttgttttgtttttttaaacagggttggcatatatcagtgagaaaggtgttggatggatgtgagtaacttaaccactattttggatagttaataagttcttatttgatcaagtacacactaagagtggaacattgtttgaggggaaaaaacacacacaaaaaatgacggttcttgggaaatcttacaataggggatacagaatgcatgaaatacttgaagaagaacactgatgcccagatattcaggtactctatgtaggaggtgtcttcctgttttgtttttgtttttgtttttgttttttgagacggagtcttgctctgtcaccaggctggagtgcagcggcacgatcttggcgcattgcaacctctgcctccctagttcaagcaattctcctgcctcagcctccctagtagctgggactacaggcgcccaccaccacacccagctaatttttgtaattttagtagagacggggtttcaccatgttggccaggatagtctcaatctcgtgaccttgtgatccacccaccttggcctcccaaagtgctgggattacaggcgtgagccaccatgcctggcgtgtcttcctgttttgtgctggagatgacaggggacacaagggtgaagtagctaccatctctacccttacagatcttagaagaggggaaaaaaaaaacacatagatgtagggtaagtgagatacatcacatgaagagacttatagaggctgaaggaaaacatgtggagcatattaattgaaaatgtaacatacagttcaaaaacaagttctgtgtttcctcactttttggataccttttgcaatacaaaatagaacctggtgagctctgtaagaggtgcagataacatgtttcagaatttaaaggatcagataatctgattgtaagtggagggaaaccctcatggcaggggaggtattttaggttcaccagaagtatatgtggatgttgaaagcaagcagttgtcaatgaaagcaacaagagggaactgtgaaggcaagccaggaaggatggatgggataatcaggagatagtcttgattggagtgtgtagttggaaaagagaagataaattagttaacagtgactacattaagtactttgaatcccaggctgagaagtttggacttcattggtaagtgatgggacgtttgagctgggcctccttaaaatagggcctgcgaaggttttggcaagaatgtgcaggtatggatcctcagaggggtccatgatcactgaaagttagataaccattacaggttttggaagagtagattacaaaaggcagacaaacagggacacccaggaccagttaggtagctactgctgtaaatcagaacatacgtaaaatattttagtacagatcgagaacattaagtactaggcaaaagtttgaatgagagtgagtatatcttaaaatatttctcatagctatattaatgacctgtttgtatctacaattgagagtgtcttggatttgtatgataattggtaattttttggatacatagttccagtagggtaaattcaacattatgaaaatacaattaaacattgattttagggccgggcgcggtggctcatgcctgtaatcccagcactttgggaga

SEQ ID NO: 104891 - DNA, 1081 bp, Homo sapiens
taacatcaggtcatgatactttgaaaaactacggtttagtcaatacagtttataccttgtatttcaaattatacaactgttctgtcctataagagagccactagccacatgtagcaatttaattgaaattaaaccaagttccatagttttgctagccacattttaagtgctcagtagacatatgtagctattggctattgtattggataggacagacatagaacatttatctcatttcagatagttctactggacagcagtgttagagaatagcaggtaaagcacagttatagcaggaaccatttctgctaattccagtacagtccgtgcatcttatactcttaacagtgtgaaactcgagatctgggttttccagtaacctttaccagtcaaatggcactttgtgcttccattgttaatggttgaagtaatgactgatcgatgttttcctttgtttctagtcctgcatttttgacaaagttgtttttgtgatttagattactatgtgcattagaaatttggtgaacttttaggagagactcatatttgattcaccattaggttttaacagaaacaggattgtgtttttcaggattgtgttaagcaaaagtgcaactggattttattttggaattgcagttgtgagaaaattgtgatgccactccagtcttatgtatatccattaatcttcagtggtaatattgaactttaaaatgccacttgcggccaggcgcggtggctcacgcctgtaatcccaacactttgagaggccgaggcaggcggatcacttgaggttaggagttcaagaccagcctggccaacatggtgaaaccccgtttctcttaaaaatacaaaaattagtctggtgtggtggcacgcacctgtaatcccagctactctggaggctgcgacaggagaatcgattgaacccgggagacagaggttgcagtgagcggaggttgcaccactgcactccagcctgggcgacagagcgagactccatcccaaaaataaataaataaatgtcacttgtaaacctaatggctcagggagaacgaacattgaggttttcctctaaact

SEQ ID NO: 104892 - DNA, 1030 bp, Homo sapiens
tggtttataaaaggtgcagatggttaaaacacaaacgtgtgacgtcagggtcggtttttaaaagtctcttctacccactacatcagttgtgtctcttgggatggactttagagaatcgattcgagcctaatggcagtctagagaaatggagatcttcgtcaggactatcagattattgtaatgctgcacttataacaaaaaacttagatttagccacgcaaaaaaaaaaaaaaaaaagaaaatagagtgcaagataaaaaaacacacctgattaactgatagtacgacccttccaatattctttgagatatccatgctatggttccattgaaacaatttcttacctaaaattatgtccctcgtcatgatattttctacttaaaatggaggaattctcataactgtgatctaaccgtcataatgaggctaaaaaggaaatcaaactgctcttgctttgcattctcttcagtagctcctttaccctttatttcaactccagcagataaaatagagatactatttgtcacccaacccctccttatcagttcagtgagggtgaatgagttaatgtcgtgaaagcacttgagttctccaaaacaaagatgttgtgataatattactacagtactttgtgattacaagttagctttgtaaataattaccaatgtgccatatccagtcgtgttctatcttggcctaggagtgttaggatttaccctcatttataagtaagcctgttaagcactatggatgttgagccaggaattaatatagccctcctcttcccaccaaataatctctcctctaggttaaatttctagaatttaaaaacacaatgagaacctgattaggaacatggcaaagatgattttttgggagaatgtaagtgtgtttgagagtatgaatttatggactaaatatgcattttaatagattttgtgattgaagctaatgaaactttccaggactcttttgaaattttctaattaacagtaattaatgaaaatgttttatgatgtaccatctgcat

SEQ ID NO: 104893 - DNA, 1003 bp, Homo sapiens
tcttctctttggagggttaagatgggaagctgttacacaggaggctgagtcaggaggattgcttgagcccaggagtttgaggttgcagtgaactatgattgcaccactgcactccagagtgaaaccctgtatctgtctcaaaaaaaaaaaaaaaaaaaaaaaggaagctgggactgagcttgaggctgcctggccagaagcagaggtagagggtaacccttgtatgtcagggtacaatcaggagacacatcacaccatgttttttttgttgttgttgtttgttttgttttgtatttttaacaggatttaatagaattaattgttaattaggtaaccgaaaaggcaaacttgatagaactctagaactcgaaggtatcatggaagtagcaactgcaagaagtagccaccactccgtgggctaggggagcaaaaggaggaggtgggaaatattcaaacgtagagggtcctgagacccaaacctcttgaggagcaggtgctactcttctggtgccagtgtcaaggagcaccatgaggctggttctacaagtgctgaaattgcaagctagactcaacagctgctacaggagctgctgcagctggggtcaatgttgctggggtaaagctcatagaaatgggaagaaatggagacagacaagaaggaggaagtccctgcttcccccctccagccccgcggtctccctctaacgccccctatcggcatagcctaccaaggagtcacagagaaagcaggaatttggtttgcagagtcccagccccagtgggacaaagctgagcacagaaggataggtttggagcccgccctacactgaagtggaggggattggacagaggcacgaatacaaggatttggggcagattgggagccattttagaggctgcctgctacagttgcctttctcactatgaccctggcgatagttgcattgatttttttaagagtagtagatagccattctgcacgaatgacaaactatgaagactc

SEQ ID NO: 104894 - DNA, 1055 bp, Homo sapiens
acatggtcgaaggggtaagcaatctctctggtgtctcttatattaatatgagggtcctaatcccattcatggcccttacgatccaataactgcccaaaggccccaccttctaataccatcaccttaggggtgaggatttcaacatagggatttagggatttgtgagggaggcaagcattcagaccatagcaggcacatacatacaatggaatattggtcagcctttaaaaggaatccagtttggacacatgctacaacatgagtgacccttgaagatattatgttaagtaaaataagccaggcacaaaaggacaaatattgcatgattctacttatatgaggcacctagaggagtcaaattcatagagacagagagtggaatagtggttgttgctaggggctggggagagaaggaaatagggaattattgtttaatgggcacagagtttcattttgaagagatggaaaagttctggagatgaatagtgatgatggttgcacaacagtgtgaatgtgtttaatgccactgaactatatgctcaaaattgggtaaaatggtaaattttatgcatatttttatcaccataaaatttttattttgaattttataaaaataaaatgttcattttattttatttattttgagatggagtctctctctgtcacccaggctggagtgcagtggtgcaatcttggctcactgcaacctctgcctcctgggttcatgccattctcctgtctcagcctcctgagtagctgggactacagatgcctgccaccatgcccggctaatttttgtatttttagtagagacagggttttgccacattggccaggctagtctcgaactcctgacttcaaatgatccacccgtctcggcctcccaaagtgctgggattacaggcgtgagccactgagcctggccattcattttattttcttgttgtttttttaaaaattatatttataactatggaagagttcagttgagctgcaattaactatttctttgctattcaaagtcaagggactagaagcattggcattacctggga

SEQ ID NO: 104895 - DNA, 1050 bp, Homo sapiens
attttacaaagaccattggactatcacttgaaacactttgctcctttgctgtcctgagagcaagcacattggtgcttgcgggaagtgtcttggggagttaagcaccagctcacagagatggtgaggtgtatttcagaacccaagcttctgccagggagcatatagattttgttatttcaatattagcagcttactctccatgggttttattgcataaatttcaggagggagtgttttcttgactgacaccttagaagcactctttgtagcaaagtcacaaacatttccagatcttgctgggcatagagatggctgcaccactggaaacaatctattggtgtcacttgacacagtgtgagaggtcaggtaggggtgaacagcattgtctgcacaccaagtgggaacattatctgctctgtggggaggcccatcatgcttggcctgctcaggaggaagactgacacatgtgggtcattccgtggtgccttttctccttcacagtgaaaagaaggcctgacacttccagaggaaaatgacactgaaagcactcaggcagaggaggggaaaacatgaccatgctttctggaaaaccctttcttcatgcactcatgccaatcattgttttatccaacttagctaatccatttctaattttttgttccttaataaaagaaaaacaattcaactgtcacttactgaattctttttaaaaaaacttttattttaggttgagggttacacgtgcaggtttgttatataggtaaactgcatgtcacgggggtttggtgtacagattatttcatcacccaggtaataagcataatacccaatagtatgtgttatttatcgaattctcactgtgtgctaggaccagtagtgtgctgaagatggcttggacaggctcacgagaagcttaattgttcaatttgcaggaattttgcaagacagctgttaaacacagccattattaaaattcaattatattaccttacacttaaaaacaaaggcaataaattcaacttatcatattctaattattttactcttatt

SEQ ID NO: 104896 - DNA, 1017 bp, Homo sapiens
gctatgtctctttttagcttcgtaatctttggcaaggccattggattcttcagctgtacaattaggagactcgatcaggtgattgcctttctcagctgtcagttctctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaagtcagataattcaaatccatttgcttttatgtagtttttcttctaaatgtcaacattttgaattaaaatgtttatgattttatatgaggtagaaatcttaactgctttggggtattgttaatagactttttgttatggacagtagtttttaaataaggaaattgccaatttctacagtttgggctctggatttctattgtttgggaaaaaaataactgagtcaagtggtagtaagacaaagttgacattcttagatgagtaactcagtttattacaaggaaagaaaactgattgtttaaggctgatgatcaattcttggagtggtttcagagcccagctctggtcagaagacaatttgaatcttagttcctccactgtgatctccgagaagttacttaataattatattctggtttgtgaaatctggatcatagtacctctttgacagggttgctgtgtgaacccattcattctgcaattagaaaaatagctgtcatgtgctatgcactaggcaaagaagtacctgtcacatgctaggcactaggggaagaagattcggtttctacatttggaaacttagtggaactagaagagacagaagcaagattacagatgagttagagcccccaaggaaa

SEQ ID NO: 104897 - DNA, 1904 bp, Homo sapiens
agaatagcaaggcggtagtctcaagacataagattctaaactgatgggttttagacaggaaaggagaatggaggcaaaaaggaggaactagccccacttccaatccctctggtactaggactctgagaacacagagcctccactagatgggcttgtaggggaaactgtccttaagaatatgacttcatctcaacctcagccctgttgacattttaggcctgataattctttgttgttcagagataccccgtgcattataggatgtctagcaggatccctggcctctacctactagatgccaatagcaatcctcagttgtttcaattcaaactgtttccagatattaccagtgctcttggggataaaaggacattttgagaaagaggttgagaatatgaagcattgtgctaacaatggaccatgaattccaaagggcacagtgaaagggttccacatattgggcaacagagtagcagggacagagtaggggctgatccttcgggaatcagattgctggaggtgagggataaccttggaagcagagatttttggtggtagctgacataagccaggataaaagaccagagattgaacttcatttacaaagtagctaacatagcagattatccatgttgggaaccacataaagacctgtcccttttagttagaagaagtaattactttgaagaggactggtatttgaatgaccaaatattaaagtggagaagttttagtgtaagtagtaattaatacagaaatttaaaatatgtggcatgtctttatgtgatttctgagaagtggttgctctgaactgaagatagggatgtttgtttataaggtgctttgtattaaataatgaattcagatcaaaaaactgatacatgtttaagattctacttctggtgctgtcattggctctttgaacaaggatgaaatgataatagcaaatgaaaaacaattaacagcgctggattgatgctgtaacaaaatgaaggtttaatattaatgtatttgtgaccggaaattcattggttaatgtcatttctcactctgtcttaggatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatattccttggaagtcaggacaagatgaaaagaaaaacatccaaaagaagtgaaattggtgacagaatgagaggagca

SEQ ID NO: 104898 - DNA, 1637 bp, Homo sapiens
gcacctgctgcagccttcagcgggctatttaaggcgttaaagcagacgataagaagcagggaaactttccccgctggcacctagcttgcagacccggccacgtttagttgcaggcgcctggaatactccgcggtcccagacgtgacgtagcagcgcgggcgagccccacattctattggtcgctgccgcccaataggaggagcggtgcgcgaccccgctgagcaagctttcagtcttcccagtgtctccgcccctagttcagccatctccatggtgaccgctaccggttatccatttggccgcgcagggcggagttgcgtcattgcctatgcgccggaagggctagtccttgcccggcgcgacctgatgatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggtaacttcagggtcccgcccggcggttcacccaagcaagcgcagtttggttccgcccgttccttccatcattgggtagcctttgctgcgctgtgtcacccacgccctctttcccgttgctgaatcttcctcctcccgcgtccccccaccccaactaatgccctgagctctctcggtaggcacgcagttctggccttagattaggtcagggagagggtggcggagagcctctgtctctctgcccgatccctgccttagggtcccaacctgggatatttctgtcgaggaggggactcgttttttgtttcccagggcttttggggcgaccgaagctcgcctgaccttcctaggtgtttcccctaagtgacgcttctaggggaaaatgatgtcggcatttctcgctgaaggccctggggttctcacccaccttggggggaaggcaagccaccaagagacttgcatctaggggtgggataggtttgggggaggagatggcgaagagaagctatcctgaccacatggtatttgatttcgttgtaggaagatttggagaatggggaagacgtggcaacgtgtcctagctgctctctcattataaaagtgatttatgacaaagtaagggatataattttaaaacgggggaagggtattgtaagtcagtggcaaggacttagatcagcttgtcagtgatgagtgcaggagaatgtttcattgtgctaggtaaagtgcggtatttttttaggcaggttttaaacaccattgataaacagccgaatagtaaattaaaacgtttaaagttcagattacgtaatttattttagctttagagataaatctagctttagtgaaaattattatttattaaatagaaagtatatagattattttagtggacaattttttatatttctcttctatttaatatgtaattaaaattgtttagagctgctagacttactttgaagggaacaattgtatggtatttcgtgctggcttatacacagaattctgcattatcttgtttgagatataattcctaggtgcagctttacaatttcattttagtctt

SEQ ID NO: 104899 - DNA, 1032 bp, Homo sapiens
caaaaatgctgattctgtaaatgtgagacttgttaggatttctttttataaaatgaaggccttgcaaattatgaaaaaaaaaagtgatttatcttacaggctctttcctgttgtattttgaggctggtagaattagagcagaggttgaaaatctttccctagaaggccagatagtaaatactttagattttttgggccgtgctgtcttaattacaacttctaatctttgattttataatgtgaaaagagccatagacagtatgtatacaaatttcatttaccaaacacccagatttggcctgcaggtaataatttgctagtccctgaattagagtattcatttcagaattttattttacaagaccaattaattttaatagcctgcagaaactaagtgaaatataagcaaaaaagaatcatcaagcatttacaaacaattagtatattatttactgtttagcgtcaactgatatttactgagcacctcctgttttccaggaccaaaaacttgtttcttaccttacagaattctcaaaactatgccgtaagatacataataatattttaagacaggtaagatagatagatagttaatagtattttcttgttttttttttttttttttgagacagagtcttgctctgtcacccaggctggagtgcagtgggtacaggggtacagtcatggctcacagcagcttctgtctcccaagctcgactgatcctcctgcctaagcctcctgattagcgaggactacaggcacactattgtgctcagctaatttttaattttttgtaaagatggtcttgctgtgttgcccaggctggtcttgaactcctggcctcaagtgatcccttctctttggcctcccaaagtgctgggattacaggcatgagccaccacacctggccagtattttctttttaacagatgaaaagactaagaatcggactaataggaacttgcacagcatccatcataggcattaacatacttaattatgttgactgccaattctaaggaaacatatct

SEQ ID NO: 104900 - DNA, 1049 bp, Homo sapiens
agaactaaggtttttgaaacctacaaagatgtggtttttgaaaattgccaaacaaggtaaaacacactttgctttagttcagcctaccaccatgtgaatacattttaattaacttttttttgagagacttgctatcatactaatttaattttatcctacattcaaaaatcatctattcaagggatcttttaaccggcatttatctgatgagtatccacaatgtgctgtgcactgggctaggcactctgggaagagctcagggaattggaactctgtaaacaagccagggtcttatcaaggagctgccgttaaattctccatcagcactgggcaaagtgaggcccactcttgcttctgggggtgtaaggagcccacaaagagctaatttcagaaatcaaaagcaggcacttagaaacttttaacaatttcacagaacaatcttgtgcctattgagtctagtaacagaaaacaaaatgggtttgcattcttcatgtctttgtttttaattaattttcaaattcattttttatcacacgatattttataaaatggaaacagatcacaatcttaacaataaaaagagcccttccctacagataatttgagaagcactatttttacatgatgtatctgatttctggaaagccttgaataggtttgactcgggagctatgcaggtatgtgccattcatggctcaacacccctcaaattcaaaaggtatctatttcctttattctttcatctgctttgtgtttctttgtcctgtaagcctgggacatcttcacaagcaaagaaaaaagacaacatgactctttccttcctcaaccttctatgtctgttcatctttacttgtggcagcaaatcagcaactaaccaaaatatagccctctccttggaaagtgtgaccttcacagctccaccaaagggtgctttggaaatctgtcaaggtcaatgaacgtcccatcctaatgctagctcatgcaggccctctactccaataggactactaaatctcatcaaactattagtggagaccattttcaaaaat

SEQ ID NO: 104901 - DNA, 1035 bp, Homo sapiens
gagtggcctcattcatatgtctggcagttggctagaacagagccttgtgtatcttaacattcagtaagctaacctgaacctcttcacaggatggcagccacaggattcccaaaagcagcaagtgggcaagccccaatgtgctagcttatttcatgctgcggtttgcatcatatttgttaatgtactattggccaaagaaagtcacaaaaccagctcagagtcaagagatggagaaacaggcactacctcctgataggaccctctgtaatgcgtggcaatggaacagaaacagggaagaaacaagtttgtgtgtggctagctaaataatggccttgtgctttatggccagtacatgactgtgtctaattttcatacgtgaatatacttccaacttccacatgcaaaatacccataaaaatggtaacacagcatcctggcaaattaattcacatttttggtggcaaactcatgtctcattttaggcatgatttacagcaattttgataagactttgagagtacaagacaatggtggcagaacctacccacaaaatgctaggacaggtgcatttattcactcactcaacaactaattatcgaacaaatacttccttaagtgcctgggattcatcaagaacaagataaactccttgcctttgtggagtttgtgttctagtgcaggggcagaaaaacgaagcaccaagtcatgatcaatatgtggaaatggtaggacagggaagagtgatgggagaattttctagaggaccccaaataggattggccagtctctctgagaccattttcattttctggactttgggtttttcatcattggtttgtcccgtggtaggtctcagtgcagatgctgatggggacccggcagcgcatctgttatggctctggtggatttgtctctggtagagcagggagccagatagaatgggaggtggactgcaggacttgtaacattggactaatgaacagccagatgtctgatgtgtcctgaaggcaggatattccagctggaggtttctgg

SEQ ID NO: 104902 - DNA, 1026 bp, Homo sapiens
tttttgtcttttgttttttttaacttttgaagagtgaattgagccaactcggggcgtatgagtggacacatacatgcccatagacatgtatgtagttgatgctttgacatgtgtccactgagtcttgtgattaaaagaatgaactttggcccaggccagacctggttttgcactctggctactcactgcttgttttatgactttaatgtctctgggctccagtgtcctcatctgaaatggagacaatgataccatgcagcatcattgaaggatgaaacgttttgttgttttaatttatgtaaaatgcctagctcaatgcctagacatagtaggtctacagtagacagtaattactactattcttattttatgtctagcacaggctaggatttaaagactggactgcatgtttgcaactgcagttttccaggttgcgcagtgtggaacaaaaatgactttccatttaatgtcagggtggttcttccgaggagagctgtcagggcagcttctcctttagagagaatacctctgtgctggcaaaactgactctcaaatgagggtagattatcattgcagaggcctcaagattttctgaggtcatctgcttagagcttggtgactaagacttagacagctctgaggtctgcaccgccttatttatttgtaaaatgacttaagcatccttgcctggaaagtcccctaaaggctaccttctggctttggctggctcttgctttattttattaggttatttattttcaatttttctttcaaacttatgacttacattcaacccaattgccttgggctattttttagggagagggaaagttcaagtacctcggtactgcaggtgggtgttcatcccccatcccgttggtacagggagtgagaaggaaccatcacctcgctgctgatggtgtggaccaggacttggagagccaagagtcagtctgtggctgtgggctgggcatgatctgtgggctcctttgaccttccctaagcctgagagcaccagggagcaag

SEQ ID NO: 104903 - DNA, 1251 bp, Homo sapiens
tttttttaaaaagaaatatttttcacatcatgattcctgattatagttacagtggagcatgtccttacttattatagagcaactgagtgaagttgtggattagtcaaaacagccatgtttaattttcagtgcctcaaccagaaattgttactctttaagtatttggggcaggtgggttcttacaggcagcagaaatgagaataaggtgggtgagggtgtatatcagtttaaacaggcatccacctgggcatcttggcacaggtcagattatctgaagtggaaagagtggtatcgttgaagaggcatcaggttgggcttaggatactcagagcgaaagccaggcatggctttgggtagttctgtgaggtttgaccagtcacagaatgtcttaagcagttttctcttctgtaaggtatgattttgaggcctaagggaatgcatgtgaaagttctttgtagaagagctgtgcaatgttaatagttgctgtttcctgtaatcgctgttgttagagatgttgtgggcatgcgtgggagtctgtggggagctccatggctgaggtgacctggctcctcatgacctgttcttccatgttgatttggttccatgctcatgaagaccctggcatcgcctgaggtcatggtgatgtccagcaacagatgatgagggcttgaaataaagtgagcttggatggtcactttatggagaaggaggaagtaattccagaaacactgggggataaatgtggtagggtgtggtgaacagacacacaggattagaaacagggaagaagatactgtgattccagctggtgagaccagatcaacagtggacccgtcagctgtgatcgtcttctgtgtaggtctgaacttgcaaggaaagccagggctaggggttcacacttaggaataatgaacatctgatttgtagctaaacccatgtgagtagaggaagtcaccaaggggagtgtagagtggaggagagctggcagccggggatgaaccctgatgaatacatcgcatgcccaccaccatgatgaatgtgagactggctcagtaaaggttataaatgcaagaatgagaagcaggatttactttagccataagtacacggtcaaatgactttctgaaaaagaggaaagtgtctatactagggtaagacagaactgtaagagtcgtggcccctagatctagccaaatattgatcttcataaaatctaaatgtggtcgtctagttaaaaaggactacgcaccc

SEQ ID NO: 104904 - DNA, 1028 bp, Homo sapiens
gatttgggaaggaagaaaacaatcagcaaagtttaatgtggaacatgtgcattcaatgcacgtagagaagaggcttcttgtaacctaactggacaggtcccatgagagagtctcatgaacaccattcctatgtagctattattgctatttttgtttgcagatatgtgacttttctgaaccagtaaatgtcaggcagactgcttttattcagtattctatttgtgataaaatattattaattatgcatcgctactaatattagttctttctacatctgtcaatgtaaaggagagacttgcagcattccagagaaagcaggaccctcccccagctcccattctgtgtggctgctctcctcttttctgcagcccagctcactgggcattgaaattctttcacaactccattagacagggagcaccgaggcaaagtttgtctgttttcctcttggtctttacggttaacagtgcactccttgtagtgcacagtggctgatagtttgtctcccagggagccagccctgacagtaagcagcaagacaggatgatttctctagaataaatagcagggtcggatagttagatgtccctggtaacatctccccagtaggcatgcacagctccctgagagagtgtgtagtgggagtatcctttgcacatctcccccatcatgtccagaatgttcccagagataccaaacttttttcaacagaagtgctgaatgtcttctgctagaaggggaagggaacatcggaagaaaggacagtgactcatctgtgggtaaattcttctccttcgttgtgcttcctacttcacaactcccctgggggaccctatactgaggtgctttatttaaagatttgctaggatttgtttacttgactattttttcctcaagtatttcttcagttttgctataggggaaacttttaactccaacaggctcattgtatttgtgtagatttggttcattttgcaaagagggttcataaaattatgggaaaccttttccctattgtactgggagca

SEQ ID NO: 104905 - DNA, 1087 bp, Homo sapiens
ggagcctgccttccaagcacttgcagtctaattaagtaaatgagatatgtgcctcatgccacaggagtttgggagaaggagatgccacctctcactggaagggaaaccaaggaaatgtttctggaggggcagcttttaacttgggcctgatttcttttgggcaaacatggggagtaatgagcatgaggcaggaagagtttatttaaatctcctaatgaaatgttttctagtagtatttgagtaattggagagcatcgttgacagtctaactaaattattaatgagtcattccaaaagtagttctcaagtgcagtaacattcctctgagctcactgccattttgacagatttcacttacatccctgaaaaattacctgatcttttcttctgaaaattctaataactgccatttcattttaccatggcaggcctagccacacatctaactgtaaactgttcttaattctaagtgtattgaatttagtcaagtcagttactttgactcaagttactttgactcaagaatgaatagctgaatatgaaatacttagtgaataagtagaaagagagtttgtacttcattttctcaactctttctttggaacacttagtgatttttaatagacaatatagttgcactcactctgaattctaagtatagttaagtgatccttcatttttttcaagtagttttccttagaatgagttgctaaagatcttgaaacttgatggctaacagaagtcagttattaaaacgtcacttctgatgtttcatgagtgtgggtttaattctaggttgttttatggttatagatgtaactgcagtacaaaaatgcatggtgctggccatttttcagctgttgaattgtcgttgtacacacatggagctaggggcgtcattggtgtgtttttcatcatgaatgagttgaagtcctttggcgacagcttccgtagagtaatgccttacatggtacagggaccagcatactagggagctctgtggacatttatcaggcaccttttggcctaggattagggtgggggcacacagaggacctgtagttaatgcagaggctgcaattctaaa

SEQ ID NO: 104906 - DNA, 1105 bp, Homo sapiens
tgctgatgccaacaggctgaacttttaaggccttaatagatgcatcaaagatgccctgagcatgggctcaccggtcttcagtccatcatggcttgcttggtgagaaatggtcgagatgaagtgtgtgaaagaaaagttactgatgctgtttctaatagcccaggctggaataatgctgtaaaggtgtgcaaggaatggggagaaggatgttgaggtttttctggattgccttccatatccctcagactggtgatccaactgtttcttttcttaccactgtttcttgccaatctagagactgtaaatgaaaacaaaaacttactctcatgtctataagtagtttcttattgtggacttcatttaatgaattagcctaaaacaactaaaaaccaagaaaatatcttttttcttaataccatttactttcttggatataaagtgtgaattcagaagtggcttaaggcaagtgatggggatcagtgtccctgaggggtgaaccagccaaggttttgttctcctacctgcaaggaatgttagagtactatacagtgcttgggtttgggagccaagttacctaatgaaaaagcaactttaactcaactttcctgctcattagtgttatgatatcaagtagcatggtggacatctgccaagatggcccccagtgacccctgcctactggtatccacggccttgtgtacctagtgaattgcttctagtgaacaggatacagcaaaagtgatgggttatcacttccgagattaggttacaaaaagattgtagcttccatcttgcactctcccgctctctcttgattactcccctgaaggaaactggttgccgtgttgtgagctgacctgtggagagacccatgtggcaaggaactgagggaggcttcctgtgaacaggcagtgaggaattggggccctaagcccaatagccctggggaaagtgaatctgaatcttgctcaacaactgtgtgcatgagcttggaagtggatcttcccccagtggagccttgagatgacttcagccctggccaatgtcctcaggcaacctcatgaaagattttgagccagaggcacccagataagctgcacctgga

SEQ ID NO: 104907 - DNA, 1952 bp, Homo sapiens
ggggttaggatgatttggaaggacacaattcagtccatagcaccagactatagattggtattttactttggttcaaactctctcacagatgaagaaccagtacttgatgctagagtaatggagactgatgggatggtggtagcccaggcttgatggaggagtctgtgtgtcaaggaagacttgaaatcctcaggtggatttggagttttatgcaaatttggtgccagggacagttggctgttagtcaggcaaaagatgggagaagagggtggaagcagataatcttttcacgaagaggagacaacttgtgggagggatcaaaacacggagataaccctgcatatgtggggagccacaggcagttcagtttggttggagcatgttctttgggggagaagaaagtagggccagatgatgaaaggtcttaggtgttgggctgaggagtctaagctcaaaagcactgaaggtttttaagatggagggggtgcaggtgacatcagattctcattctggaaagatttctctggatttagaatgaggaaggatggaaggggcaatgctgggggaggggaaacatatagaaaccattgcagtcatcaggcaaggtaaaggtggcctcagtcaagacagtggcagtggggacaagaaaaggagtgggggaaagagaaattaggaggtggtcctagggactgcctggcaggtgaaggaaagcagaaagcagaggaggaggtgggtgtgctgggcacctgggatgacacgagttccccacagccagatgctgagtctgctttaaagcattctccaataatgctctcacttgatgattcaagtagccccgaaagttgaaaggaaggtatttttcttttcttttcagatgaagaaattgatttggcaggtaacaagtagtaagtgggcccagaatccagtgtttcagctctttccactcaaagcttatccaccgcacatgaaagagagctcagcgccaactgccagtccactgaagggtgtcgcagtgatatttgtttgaataactttattgaactataatttaaataccatgaaacacacccatatgaagtgcctgggtgatgagttctgataggtgtaaacatttgtagaactatcaccacactcaagatataaaacttttccatcaccccagaaagttccctcaggtgcctgccctgacccagccaactgctgatctgctgtgtcactgttgaatagttttgcttctttttgaataacatgtacatagaatcataccgtgtgtgtgcctctggcttctttaactcagcctaatgcctttgcagttcaatctgtgctgttgtatgtatggagtccttgatgttgtatgtatggagtccttgctgttgtatgtatggagtccttgttgttgtatatatggagtccttgctgttgtatatatggagtccttgctgttgtatgtatggagtccgtgctgttttatgcatggagtctgtgctgttgtatgtattgagtccttgctgttgtgtgtatcaagagttaattcctttttgtttctgagtaatattcccttgtttgcatgtgccacaatttgttgaatcattttcctgttgaacatttgggaaatttccagtttggggctattatgaaaaaaaaaagctgaatatccacgaacaagtgttttgtgtggatgttttcacttctgttggggaaatatgtaggagtggaattgttgggtttatgctaaatacatgtttacctttataagatactgctcaactgttttccaaagtgtttgttctattttacatttccaacaacaatgtatgagagtagagagcttcattttttataggtaataatcagagttactttttattcagcacctactgttgtattaatctcttctaaacaaactaacaacaatcttatgaggtaggtggagtcacccccacggtatagaa

SEQ ID NO: 104908 - DNA, 1037 bp, Homo sapiens
atattttatcttttagctagaatccacacatatatatcctatttgattagggtagtaattaggataactaaaattctgggcctaattttttaaagaatccaagacaaactaaactttactaggtacataagcttctcaatgagtcaccattcttcttttttgtaaaaacttttttctttgaaatgctaaacttggctgtatgtcaaattgtgcaaaatattggtattaaagaatgctgcaacttttttatgtctcttagaggttaatcagagtatctgaagggaattgtttttataaaaacattgaaatattagttacttgctataaatagatttagtctgttatatttccttttgtaaagtaaaatatgtccagaagagtcaaagtagttagttttggttatttctaaaccacaaaagttgtttaataagtatatcttaagaatgtgctagagttaaaagttagcattgtttctagattagctggtgtcttcattttacattgtgacaaacagctagagcatcagagcccttttgctataccacagtctttcgtttccagcctttgtcactagtctttgaggaggtttgctcctagaactggtgatataaagaatgaaagtagctgtatgagcagagcagttcaagggccaaaccctggaacggtagcaatgggatataatacctttctaagggaaaaagttgtatcagtaccatttgatctgccatggacatgagtttaaagcggctttctggcccttctttcagtgacttcttccctaaaatgtagaaattctaacttaatgtagttactgtgagccatattactagtgccccctagggtctataattccttaaaattttcattctgaatctgaaggagagagtcttttaactttagaattcccaagagggctttattacacctcagaaattgaaagcactatgaatttgtccatttaaaaatgatctgtagtttttttggtgctataacattctgacacatatcattctgtgattaaatctccagcttactat

SEQ ID NO: 104909 - DNA, 1057 bp, Homo sapiens
taatgatatgtctttaaatgccaaaacttacatcttttaacctaaaaacatgaaatttcagattggagagctgttcacaagccgtggttcctattagatgcagttcagtcagtgaaaacagtattttttagaattacattttctaccagctgtctttgggacattactgcaaaatcattaattaagaagtacataaaatgatattgagtctaagtcctgttatttctgagtttaatgggatttctttttttttaattgatttcttttttaactaaactgtttaataaaactagccatcctggtatatatgttatcccagtgttcaagaatgcttctcaaaaagaataatcttttttctcattatttataatgtttaaacccaaaacaaatggtttaagtttttgacaactttcagatctatagtagtaatcagaaattttcagtaaagtaaaaggactctttctgtcttttccaggataaaagagtgcatcactttagaagaagtcgggcaatgcttaaatctgtttgatcctcctggcttatctagttacatgggaagttgctggttttgaatattaagctaaaaggtttccactattatagaaattctgaattttggtaaatcacactcaaactttgtgtataagttgtattattagactctctagttttatcttaaactgttcttcattagatgtttatttagaaactggttctgtgttgaaatatagttgaaagtaaaaaaataattgagactgaaagaaactaagatttatctgcaaggattttttaaaaattggcattttaagtgtttaaaagcaaatactgattttcaaaaaaatgtttttaaaaacctattttgaaaggtcagaattttgttggtctgaatacaaacatttcacttctccaacaagtacctgtgaacagtacagtatttacagtattgagctttgcatttatgatttctccagaaatttaccacaaaagcaaaatttttaaaactgcatttttaatcagtggaactcaatatatagttagctttattgaagtcttctta

SEQ ID NO: 104910 - DNA, 1395 bp, Homo sapiens
tattgaaatactggttttgagaatgtcttcatctgtggagtatttgatgatttgttgaaagagatctgtatgctcttccaaagctttccctggtttatgtatatttccagaaataattttctatacattaaaaataatattagcagtagaattactatatcataggacagacatgtgtacattcagctttagtagatactattaggtgattttcctaactggtccagccaatttacacacctaccaggttatatgaatgctaggtgctctaaatgcacacatttggtattatcagtgtttctttgtctttttgctttttgattgtaactattgtgacggttatgtaatggtacttcactgtggctttttggctgaatttctctcatggctaatgatgttgaacatcttttcatatgtttcttggccatttggatattctcttttgtgaaaatgcttgttcaagtcttttgcccatttaaaaagtcaggttgtttttattttaaaaaaaatggtatgtaggacttaatttacattttctgaatatgtcttttgtgatatatatatatattcaagttgtttatatggtttaatgtttattattgaagaaaataaaggatatcgcttagatttttatttctatcaatccgtgctaatagcttatattaaatgccaatgtaattattcagatgatatatatgttttgtgatatatcacaaaagacattttcaacatatatagatatgttgaaacacgtatctatatagatatagatatatgttgaaacatgtatctatatcgatatagatatatgttgaaacatgtatctatatcgatatagatatatgttgaaaatgtcttctagtatgtgacttgctttttcactgtcttaaagggtatattttaatgaaaattcttaattttagagaagttcagtgtatcagtatttttctttatggttattatttttgagtcctgtttcagaaatgtttacttagcctaattctatgaagatagtcatttatttaaccactggagtcttattgttctatttttcatgtttagatctggatttcattttgtgtgtgtggtgtgaggtagggttaaagattttctttccatataaatatccaattaattcagcaccatttatttgaaaatagaatctctttcccactgcactgcattggtcttcgatcctagatcaagtggccatttatgtatgggtctgtttttggagtctattttgttacatacacataaagtccttatatacttaccacactgtctttctggctaggtatatacctaacaggagttactccatatgtatattgaaagacatttccaagagtccttaaagcagcattaattctaacagtcccaaattgaaagcaa

SEQ ID NO: 104911 - DNA, 1024 bp, Homo sapiens
ttttgttgtgacagtcccattaaaatgtggactgaatcctctccttcatgacacagacagcatcagtggtgctgtccttgccacagaaggccccagggtgtgtgggcacagcgagtgatgcaagtgatgtaaccagaagaggttttgggggattttcacacttctttacacatgctatcctagcctggcagagtggtctgtgattccccactcagtactacctctctgtcttttatccttaaaagaaaaactggaagtcaaagctgattggctgtcaaacaccaggctccagtttcaacctctgtatcaaaccaaaatagcagccttctaatggaaattttcttttagtataaaatgtactttcttttttatctgtgcaatttacattcattttaattttttggaaagcagccagttgatttttgcatttaaatgagagtgagaagtataattatttacacaaatttaaaattttctatgtaaaggaaataaatttccaatgatgaaattgtataccaaaaaattaattgcaaaattttgtaggcatgtgcatatgtttctgagaggttttcatcaaattttcaaagggatctgaaattaaacaaacagccaaacaactgattcagagcaagcttctgctgttgcagcagctctagctcactgtttagacctcctcagaatagcgacagcatacagggagcctattagttgtgtaccccaatctttggtgagcctggagggaggtaattgagagggaggcaggggccctgaaaatggagtaggtgttgatgagtgcccataactctccaggcccagccagggcaccattaaccatcttctgctttggcaagaatagtccagatccacctggagaggcttttgggctagggaggactttatatgcagcaggactgcattaatgactttcaggcccttttcctttgtaggctccttcctccataaaaaaaaaaaattgaaaattatattttatgactgtgttggtcagatctgttaatattatata

SEQ ID NO: 104912 - DNA, 1007 bp, Homo sapiens
ataggtaggtttctttgctgctctcatatttttccttttaattttattatttttttcctcttcttattcagatagtgtttcatctctgtcattaggaaactacttctcattgatttattctgtttatgcagtttttccttccaaattcatcaactgaactatgggaaactttgtttcttaaaaggttattttgacattatttgggtcaggccaggtttcacatagggaaaaggacaatgcttctgctttgccttcccatccaccactaacagctttgtgaaaggagagagaagtagaaggaaaggatagagagagaaggagggacgcctcattcagcttacatttcagaagcagggaatgcaataaataacatgaagaaagtccaggctcaactcgctcacacctcaggaggtgattcacgagcatgtaacacagcctgctaaggtttccattattcataattaattaaatcaaagcatgcttagtaagggcccataatcttaaaaagcattctgtgttttcatctgactaaaagtttttccttcgcttgttgcagacgacagccgactttaatattatagcaccagcacggtacagttgactcagtaaacctgccacactgtggaacagaggtttggggaagaatgtggaatgtgaaatataagactattcagccccttaaaacaatgactatccaaatatgttgcttttgagctggtagtttctcacttattttgtttaaaaaaatataacatcctttgttgggttataggtttcactgaggcagatgggtttctgtagtgaattagtccctgcatctactgagagtatcctccctccagcattaaagaaggaaaataagaaaatggcccatagcatagaggaatggtcaggtgggaagtagcttctccttaaattatttctgatggaaaaaatatattctggagcttggcatttgagttcaatattgccaaaactccaggaataactttctgccaagagcaccc

SEQ ID NO: 104913 - DNA, 1037 bp, Homo sapiens
aagagtcacctgaggtattggcacatgcataagtgttcttcttgggaatcctcattgcaaagattctgtgaacatggacttctgaaatggtattttctgtaagctgtggggtcagaattaacaaagcaattgaaaattcactcaggcaaattatagaataatgaatatccatatatataccacatatatggcatctgtctaaaacttaatcaccagagtataatcttgtcaaccccaattttattttcctgactgcctctgagagtagaaatcagtgaggcaaatatcctgtgtgtttttacacaaattgaaattatttttccataatattttgttaatggtactgtttgtgtttgtagttgagttactttgacctctgaagcatcttccacactgttgcatgtaaatggaacaataggtacttgagtcacttgatcatggattccagattctggaacagcctctttagaaggcaacagaggatattatttactgatttgagtggctttagaatatcatttaactttttaaaattatatttattagatatgatcttaatctttatatatttttcttttatagatgatataataaggcattattagtattgtataattctcaagggtattccacataaatatttaaagttaatttataaaagttaattttattgcttactatgattatatgataaattctcacttattgagaatctgaactggaaaggtcaaccaaaaatttaaaagcagatatataaattagggcgagagataacgagagcaagtgctttgagccctgtgagtggctattacacactagcatggctattgatgaggatggagagggcctttagggagggcatacttaaagaatgcaggagtgaaaatgcttgtatggtgttttaattcattttaaaactatattttcttctcatttaaccataggccactcagttcctcaaatactgtgaataaataggattttattggattgataaccactgtattacaaccactactacgtgagaatacaagaaa

SEQ ID NO: 104914 - DNA, 1107 bp, Homo sapiens
gatgagaagcttagggtagaaccttggggaaatccatgtttaagggtgcaccgaggaagagcagccccagatagagaccaagaaggacataggagaaagtacagagccaggcaaagggtgcagtctgatgctgcagagaggaagctgcaacctgcagggttgagggcctgggctctggagctgagctagagtttgaatcctaactgcctagcttgcaggttgtgtgatatttgtcacctgttgtattactttgcaaaggctcaatttataaaagcagtataattgtaaagcctacttcatctacttgttgtgaagcctagctaaagtatgagaagtatggagtaccatgcttggcatataagaaatgcttagtaaatattcggtgatgctatccttattattatcaaatgacatgaggactcagaaacattcatgaatttgcttcttggaggttgtgggtgaccttggcaaaaatccatttcagcggagggacagatggtttgagagtgagtgggaagtgaaacgtagaggctgtgagtttagaattttctcaaggttagttgtgaatgggattgggcaggggggtggtggtgattgctgcacaagagacttggaatttgagtgctggctttgaacgtacaccacagccgcagcatagagaagagtaattctgagcggtgaggatacctgcgcagaaatgatgatgatgatactaagcacaggagtgagagacaactaggaaaccaaggatcgtgggagagaggggaggagggaatgggctacagggaggaggaaagaaactgctctgcactaggacttgtctcagagcctatagaggctaccagagttaagatttgtaggttcctgaaaatgagagtttagtggaccattttgaccttctctccataatgacaacatatttttaaatcctgaaaggcaagaaaagaggtttcccaaaaagacttctgggaaggcgggcaggaatcagagcttcctggtgaagttatcagacactctgggagttggcttggaatgcatactcaactcactttgcaatcattcttaacttttagagaaagcctcccaaatctaactttattgaacagc

SEQ ID NO: 104915 - DNA, 1059 bp, Homo sapiens
taactcctttcccagtccctcagggtcatcactgcctagtgacaatttctaaacactataggaagcactaatcatctagctgttccttatttgctttgacatttgcttagctcctggacctgactctcagggcccttgggagtttgtccctccctctgtctcccacctactcagcaccacttgacgtttggtaagctgcattctttcttttggtaattttagttacgttaagtccttcttgtttgtattgcctgcttcaccccattcttagtcctacccacctttcaaggaccaccaaaatatctctgaatcaacaacatctgaagtcagtcctgtaattgagtatttttcatttatgtcttgtatgtggataaataaatggtcccatcaccttccctcagaagcctttccatatactaccatttcctaaaaaatattataggctccattttcctaacttactttaagcttaagagtgagaatatatttcatacccttctctgtctcctctggtgaccaataatatacaaagaataatttcaataatgacttcatggttattaattgttatcagtttaaatacttagcaagttgagaaaatataaagaaaataagatttcaaacaatccaatcatctatattcagcaaaacacaaaaagtttctgttagatatgacagggtctagtgtttatggaattaaagcaatgttttctaaatgaaatatatgctgttgaggtatatgtcctcgtgtttcagtggagatggagaccccacgctttccttaggataaccttctaacatttaaaacataaaacgatttcattgtatactcgtggtatttagtgtataccactagcaaatgttgagactgggactagaagttgaagttcttatatcaaatccaaagacctttccactgcacatttccatatattctattcactcatttatttatttattcagcacatacttagtgagcacctactgtgtgtcaggccatgctaggcaatgagatagagccttcaaagagcttagtctaccgatagagactgacaagtc

SEQ ID NO: 104916 - DNA, 1048 bp, Homo sapiens
tcttgaggcagaacagggtgtggcacatataaatgaggaaataagccttgaaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatatt

SEQ ID NO: 104917 - DNA, 1044 bp, Homo sapiens
tatttaaattcatccctgattttcagaagatatctttctgaatatatgatttctgaaaaaatcataagtaatatttattaagaacttttagcctttagaaacatgcttttatacctactgccattttaacattgtgagccattttaatctaattttgctttcctagaagttgcctacaaaaaataataaagtaaacagaaaagacaagaacggtgccagaaaacaggatcatgtgctacaaatatctaaagtaaagtaaataagcttacaatctggaataaatatactggaaattgaaataaaacctttaattaggaccaacttcacataggtgtaaccagaggaagaataaaacctcacttgcagagttacaaacctcattatttgcaaaagtcctataactgcagtttaaaataattatatgcatatggtatgtcttcttagccctgtaaaaattcaaaaggtataaaaggtgtctcctagaagtgcttatgtatgggagtctaattaaatggcatttgtggagaaatgctcccatcttttgggcttttatgctgtcatttctgtgttgtgtttttataattaggcaacctgaccaatcatttggaaacccatgtagttctctcctccaccaggacaataaacacagatgttactctacttaacaagggttttccccctccccacttacacgtgataagaccaactgatgaaaccagccagccagcaccagggcctccagctgagtttctcatagcaatgctggctgggcaaaaccatctgcgtgctctcccttgctgttcctggcaccaagggtaggcatctgcacaatggctggcccagatagaagggcctgagccaagactgtttttcttatgacaaagctaattgatccgtgtgaagatgaaatgtacacacttgcacaacttattctctgggctaactgacctctataatgtcccaatagagacagacaaaaaaccgtaccctgcagcaaatccaagctgaggatcaagtacagtttaagaactactttaagtaaca

SEQ ID NO: 104918 - DNA, 1033 bp, Homo sapiens
atcagaatacaactaaagtaagtaaaggtatgaataaagataaaagaaaagatgaacagcacataataaaacagattacatgagtgaaaccaaaaggtagttctttaaaaacagtgaagtaatccaacattcagtaagtccgatcaagaataaatgagagaaaaatactaacacattcaaaataagaattatgaaagaactgaagatacagaagaaggataagttgctgtaagagactactgtatacaactttataagttgaaaatgtagagaagttttctcttgctgacttaaaaattatcacaaacttagtgatgtaaacaatacaaatttatttaacatttctctaggtcaaaagtctgacacaggtttctctaggctaaagtcaaggtttcaggaggctctgaggaagaatctgtttccttgtttatttgctatgttggcagaattcagttccttttacctataggaccaaggtcctcattcccctactgtctgttaactgaggcccattcccagcttctggaagatgacatcttccttggtttatggccccatttctccatccttaaggccagcaacaccaggtcaagcccttctcatgtttgaactctctcctctttcttcttgagttcgttctctctagctcattcttctgccttcctcttctactttaagaactcacaggaaggggaacatcacacactggggactgttgtggggtcgtgggagaggggagggatagcattaggagatatatctaatgctaaatgacgagttaatgggtgcagcacaccaacatggcacatgtatacatatgtaacaaacctgcacgttgtgcacatgtaccctaaaacttaaaatataataataataaaattaaaaaaaaaagaactcacaggattaggttggccaaccatgataacccaagatactctctccatctcaacatccttaaccttatcacacctgcaaagtctcttctgctatgtaaggtaacaaattcatagactctgggaattaaaggcttagg

SEQ ID NO: 104919 - DNA, 1044 bp, Homo sapiens
tttctaagcttgtgcattattttcttttgtactatatttttagtaatttgattaaagtattagaacattcagtataaaagaaaagtgaagttgattatttcctttttatgaaatctaattattttttcttatgaaatccaggcgatgtagttacaggaagcgatgctcaggtttctgttcctgtccagactctaactgacctccaaggtacagttaccataacaacatagtgtttctttttctttgcctacagtattatcattgcctactccaaaactccatttttctttttgcccaccctccattcatactgttttcaattcactaccattgttcagccactgagtggcactattgttaagaacaaaagtcccctctcatgtcataccttggtgatgccgaatatggctgtgatgtgggttttctattaggtgtgcacaagcctctttgcaaaatatgattcaccctgtattttgtggttattataacatagtatactttgtgtgccagctcacactgaggtgttctttttgttacactggtgctctgtgacagtatttgaccaattagttctgaaaatagacatcttatgtgctacgattagccagaaatacttacattttgcctgaaataattacaacctgattttgaaatgtttttaagtattgcctttgaattacgcattatgttaacacaattaaagtacagtgtagcaaatcttcatttatggtaactggcaatggttttaaaaaaagaatgtttaaatatcatatccatttgttcaaaatatagaaaatatagtttttaaataaatacaaaaagtgatcatctacctcctatgcaattttaaaacatataaatacttaaagtggctgcattaatcttttattatgcagtcttttagatgaaatatgcgatagagaggatttctgtgttaaatggaagcctagagtaactttaagaatcttctattcaaattcagactaaaatgatagcagtattaattaaaatccataccatgtttttcttaatttaaaataccac

SEQ ID NO: 104920 - DNA, 1058 bp, Homo sapiens
gttttcacaatatatgttttcccatcaaaatacataggaattattagtaaataaaccagaagtcattttgatcctgatgctgaaataatattttagtcacaaccaagttacaaatatttatattcttttttaatgaaaatctgtattaatttgatggatgcattgtattcacacattttgaattttgtgtattatttaaaacaaaaactaggttttattttccaaatctgaggttttgtgaatttattttatactaagtatatgaaattaactcatggtaaggctgttaaagaaaagtgatttagatcaggaaggtacagctcaatatactattatgcataaatatgtatagtaaaatgaatattgtccttagtcacaagtaatataagaagaaaatcaactcttggataaatgaagaataagaaataagatacaaagtctaggtttgataatatttagataatattcaggcaatatcccttattgatacagtgtgcatatgtattttaaagggaataattttgagagcatgtgggattataacgtctgcctttttgattccttgtgttactgtatctgtatttaatgaaaagggcagtaagtggcaataagagacagaaatggtgagacctttgtgaaccctctagcaatcagtgaatatcagaccacaaatttttccagctttaattacaggcaaaagaaaagacaaaattagcattttaatatagaaatatcttaggctttaggagaattatgataaatctaatgttgcctagtgaaccagagagggaacattacaacaaactgtctccttaggaatatttgtttaaataaaggcaacaatacttaatccttatcttttttagataattaccactatttcaggctgttctttgttccaggtttaaaataccttcagttaaaaaaaaaaaaagcaattggcagtgtttgttttctataaaactataagaagagaaaaattctgtttgcttggcactaacgagataattattttagggagagtttttgctctgcagctctagttcacgcgtgccatg

SEQ ID NO: 104921 - DNA, 1035 bp, Homo sapiens
aagctatcagtcctatgcatgtgtgttcagaaagtctatgaagccccaaatggaaaagtattaaaatgcattacagcgaaatgaatgtgttatatccctgaggtcaaggaatcaagtggctgccctcctttaccgccgacttgctattttacccccagggaaatcattcaaccttttgctgccttaaattcaggttcattaattgttttttaaagggtgatgtgtggctgataaggccttaattagcctataatctctaacagtcatttccagctttaagtgctgtgactacctagctaatcacttatttttcttattatatatgaaatagtttgttcagaaagggacttcttagtatttctgtgtcatcttaaagttatgatttaacgaaattgaagattacaaatcataagttatgaaaaaaagattataaacttaaaactgacagaacaaaaaaaccatcactttttttaatatagtggttatggccacataaatattttatttgcctcttaagtatattaactcagtaaatatattattgctaatttaaaatgttaagtatattgattttataggaagaaatgccaatatattcaagtagtaaactgtataactataataatcagctactttatttaaatatatgctttgacattttatctgtcccctctctccaaaaaagcaaaacattttatcatggagaattttaaagtatatttcatccagttcaagcacacatatgattaccatattgggaaatgtaagttagtttatcatactgcaagattttctctatacctcagtagtgactggaccattcacacgaacctggagtgaccacttcgtacgcgtgggtgagcctccaagctcctccagacagaggccagtgtggcactatgaaggaggtttttctctgacatttgatacatgagtatggtcctcatatgctgatagttacacatttttccaagtgtcttaatatgatttggaaaagatctttatttacttagttgtttttttctggttttaaag

SEQ ID NO: 104922 - DNA, 1018 bp, Homo sapiens
gggcaaattctatcagcttagcattaggaatttttagaatcatacagagtgaaaaacattgctaaaatagcaatttgaaatttctacttgcatgatttgttttaattgaagaaagaaatgaatatgttatcaaaacctatcgatcttggtaatttttccctagctaaatatggttgatgtttctgtgaatcactcactcatccagcttcagaattctttattctaagttcatcagtgtttattagtggaacctaaatgccctttcatgttagtatgattttaatggagtactttttatctcaataaagtcgtgtacatataatgaagcaaattctataagcattaaaatatagattctttaaggtttaagagaaaaaaataatagtgtatccaaaaaagggaattccccaccttcacattcagagtcttaccaagtaaaaacatgatcagtacaatgaccttaaactgatattcctgggacataataaattgggcatgatgagggagtcatatttaaaaggctcagtagaataagttcatggaatgatgatatctataggaaaagtaaagaaagctgtgtagcctttgaaaaggggctttcagatggctaaccctgcaaaatggtagatatagttaagtgtatatgtggctgactcattaacatcattttacagattttaagtagtaactaaagtcacttgacacgtgtgttaatatgggcctgtggcagtgtagtgttccgtaaggaacctgagttaggaattgggaccttgggtcaaaccttggctctgccaccaacatcttcattattttggaaaaatcatgcttgctgagccttgggcttctcttttgtaatatttggaggttgaattaaattgtctctgatgacctgtgtaagcagaacatcctttgtctttgaagaactgactttttttttttttttgagatggagtctcgcactgtcaccaggctggagtgcagaggtgtggtctcggctcactgcaacctccgcctccca

SEQ ID NO: 104923 - DNA, 1088 bp, Homo sapiens
gatgtacactcactgattcttaaggctctgttccttagagatccaaaggtaagcttccccagtagggtatgcataattttaagttgggtgaaaaataggcttctctgtgtagagtctaagaattccaaatgtggaatttgcctaatggtagatgaattgcctaatggtagcatttgcctaaagttgtaggccaaaacccatatacctcattggccagcaactcaacaggcaaattaggtagaccttgccatgagaaactggaacacatgtctcttttcccacagaaggttattctatgcttttcccttcctcacaagtcaaggaaatagttgaggaactacctctccttacagccaaactgtattgtcattggtaccccacacaggggttgatttatccaagtagaaccttgggggccatatgaagatcaagaaagtagctttatacaaaggaccagttctataagactggatacaatgaaacactaaattatttcatattatgatatgtattaatatttcttatttgggcggttaagagtaatctaataaaataaagatttaaacagactttaacactgatttctctatttgagcgtaaagcaattcaccaaaattttctttacacttcagagaaaaagtgtgctcttttacaactaatgttatatttcttgaaaataagaacatttaatgatctaaaaaaatctgtgaatccttgctacttttgagccaaacaaaaatattggaagaagtatgagagagaaagcttcaaacacgaatatcagaatgccaggcattggatggtaatcccagcctttggctctttggcaaccctcccaacagtcatgttggcagttgtcgaactgtctctgagtcagtcagtctgtctgtgggttccattgccaaagctctgtctgatcaacttgggcctccaagtttaatgtaaatttagattctaaaggatttctgtcctttccttggttgttgacttcaaccttttagtatatcctttattctttgattgatttaaaagaattcacttccttatgcctatatctgttctgtaaatttatgaactttcatatcatt

SEQ ID NO: 104924 - DNA, 2021 bp, Homo sapiens
cagaagccagtgcctgttgttcagaagtttatctacagtgagatgacccagtggtgactaagaaagtaccagagacatgggttactgatagaagatttctagataccgctactatacacacagctgtacttattttataaatgtatgtgaatagataaaattctttagatccctgcaaggaagctagtcctccccaccccatcattgactctagacttcattatggtgacatgtccctcttaataatccctctgctctttcagctgcccttggaagaatttggaaactccaagggacaacacttgtaagtcagtttcctaacatgaaacaataaatacttttgttaagttacagtgacaacccatggctatattttctatttgtcagacatgtacttccttcataaggctactctaaatcaggtattgatatagtacagaggccagtgaaatcttacatctcactcagaggccctgtatgtgcccagcccctcagccatggctgcaccccagcactgctgttgccacctccctgcctgtggtagtagctggaattatatgtgagcctacttcattggggatttcaaactcctgattgtctgaaggccgaccccactggcccaatgtggttatacctcaggaacatagaccacttttttattgtctctccttgtgaacttctcaaactgaacatttgcaggcaagacctgggtaactgcttatcccttcatgttgtgacccattcccagtatagaggggacccaaacatgaaatggaaacacagaactcttgctatctccctcttgtgttactttaccccccagtacccgtcacttccatctggggagctctgagctgccttaagggtttgtaaacacagtgggaactgtttaccattcttctagcttctaagaaaaactggcaaatttgcctactgctagcaactatatcaaagctttatcttataaaaattaattaattagctaattaattaagcaaacatatactgctatatttctcacattaacattaattccatttcaaaatgtaaactttgtttttcttaattgagctttttaatcttctactgcaaggtatgtgtttgccctagcattaattttagaaactgaccaatgtctttacttctctttttccttaaaatgaactcctcactaataattaaaaggattatcttctcaactttcctgagtaaattcactgcaaatgtcatgcaaaaatactgtaggcagtaaattttttgctatatggcatgtgtgtgtacatatgtacacatatatcctttctaatgctgtatttatagatttctatatatcagtatacgaaaattagtttctcttaattactgaccatgggaatatgtggggaaatatagataaccagctattactggtcaagtaaaatttcttcagttagtttgtttaaacacacatgtcactgagtggtttttcagagaaagattagcttgatgggtcatcagataagttatttgacatttgtccccagtcagaccggatgccacgtgaaaaatttactcaggcaaaaggctcctaggaataaacagttctctagtgttgctcacaggggacttggcaaggtgagcggaacttcaacttgtcacggatgcactgttctgacaaacataagtagatgctaatggctaaatcgtgacagaataaagtcccacaaccatatggctaattgccacaacaatatcttcagtgttattaatcaagttttcatagtgtgccatgataattggaataattagaaacagcataggcattgcttgtctttaccacacgttttgcagacagggacctcagacaaccacaattgcactttcagtactgtgttgtttaatgctatcttttcttcaaaaataatttggctgattaatgaattaactgcttgccaccagtgtattttgtgctaacttctgtagaagcaggaatatctaaatgagaccatcaaaccctctgtgaatctgtttaaataggcagt

SEQ ID NO: 104925 - DNA, 1038 bp, Homo sapiens
ttccaaggtgattttcagcaaatacacaatgctattgcaattataggagaaattatttgtccaatttaacttattttggaataaattaattatggaactattaaatgtgatgaatgatctttaaattttacttgtctcttcccaagaatttaaagtccaagatgatattgtaagtatgaggtgggggggctccatctaatggacgactttttatgttgtagagacagggtctcgctctgtcacccaggctggagtgcagtgatgtgatcgtagctcactgcagcctccagctcctggactcaagggatcctcccacgtcagcttcccaagtagcaagaattacagggatgtgtctccacacctgactaatttttttgttgttgttttttagagatgaggtcttgctgtgttgcccaggctgatctcaagcccttgggctcaagtgattctcccacctaagtgttaggattacagacatgagcctctactcttgtcccaagggataatttagatttaaatctaaactcaaaaaattccgagctcagactttctttgatttttttttttaagtgatagaaagtgtagggatttttatatttttacaactcagttgcttcatctcaggaaattaagaaagtgaggcatgtttattattactcttccctcctgctatgtcagaaaaaaaatttaggcttatgattttaggtaacttgtcaataattttttttaatttaatttgtacctgagaaaaattgctatagttagttctcaattatctatattgagaggaaacaagaacagttttaaaggtgactactgaaataagtgactgtgtcatgaggagcatttcaaaagactagattattttgaattaagacagactaaaccaaatttacttaaatatatatagtcattaaacaagtggtttcaggtgcttgatatcagatgccctcatagcatcactatgagttagacaaaaacgaatactgttccctgagacatcaagaagctgagtaacatatccaattcacatagttg

SEQ ID NO: 104926 - DNA, 1043 bp, Homo sapiens
atcttaattctccactcttgcagtaaataaataaaagttatgaaacacccgggcaacaataaaatataatttatttcatagggcatgacagaactctttacatatctaaaatgaacatgttatttacaaatgacttgtgatactcatataaaccatggatctgtgtgttaactgctttcattagggagatatgcatttttttcctaattgtttaatcgtttaaatgtatcattactcctaaaggcatgtgagttaaagtgacttctcttggtgcgattaactcataaggctaagaagaacctcagaaatgagctcttctgcagctgaagacattaagaatttaatggaaaggacaaaacaataattttcatttgggaacctctcagctctctgctgattatcttcctgcccttatttatttttaggaaccccaacctctaaaaagtttttaagcattgctatacatcagtcaaacagaacaatgttgtaagcttcttgtacttgtatttcgtactaggtagaaagttacaatcaccatactgatttaaaatgcatgggaaatgagaagtatcactcaaatgaaagcccagatatttaaaaagtagtaattagttattttaaacagaaaaatcatacacacaactggttttcagaataatgtataccagtgattctcaagtgtcatcccagaaccagcagcaccagccatcacctgagagcttgtcagaaattcagactcttcagtcccacccacctacttaaccagaaagtgttagaggcgactaagaatctatgttttaacatgccctgaaagtgattctgatgtacagtaaagtttgtgaaccactgatatatactgatagactaattgaagcaaaaataaaacattgtgggacatttattaattcctcatgtatgtatagaatcccaaagaaagcaagtggatttctttcagttttggataatttccatcagatgccattaatctcattttcaactccacctatttgagtttctgctacttttccccatttctttttctc

SEQ ID NO: 104927 - DNA, 1074 bp, Homo sapiens
atattttctggattcattaataattgcttgcaagagaaaaggagcaggtagggaagtaaaaaaaaattctttaaattcttttttaaaaattatagatatgtgctgtactgtttggtagataccaggcatatgtggctgtttaaatataaatttaaataaaattaaaaattttagtcatcacagtagctatagctgataatggctactgtatatactgtactggacaactcttacagaggatacttccattcttacagaaagttctttggacagtgctgtatagataattcattattatgctcgccccagcagcacaaatattaaaattggaatgataattcattattgttttatttttgtgtaatatgtaatgtaaatgtctacattttgctttttattcatgttgaacttttagatatggcctctgtgaaacatttacttttatttcttttctctcacctttagaaaatgacatgaatttttacagtaaatctttcctgaatttttggtcaaatgtagttattatgttacattgtagtatgtggatggaaactagattagttttgaatttttttctatgttaagcatattcgaaagttattttactgagtaatttattgatttttttttttaatttaaagatcctctttctcagttcctattttgaaaaagaaatactcccagtaatttggtccattgatgtcacactttacaaagttaagatgtcctaaatgtcggtatctcctacacagtttcctccaagcccattttttattgaaataaaaaacaaattcctctgggaagaaggattttacaagcaatttcagagcagaattgattttggtgtgtgttaatgccgacaatctgcccagtgttaaaatgttaaagagaaaaaaaaaatacaagctgccatattcctgtgatcacaccaaaatagcagcttgtatttatattttcagtctcctcgaggtggactgcaggcacacatgaatgagtggatgtacttggtgttgtgttgtgattttatttaatgcaggcaaagtacatgcttgtgcatgcacgaccagccctcac

SEQ ID NO: 104928 - DNA, 1050 bp, Homo sapiens
gtgtgtgtgtgcatgtatgtatatatgtacatgtacgagctttatttgtgtggagagcatgtaatcattattttcccttgctgatgtaatgtagaattcgttcctctaggacatattagaacaatgtgtttaatgctcttcaatttaatttgctggtatcacaattaatacaattagggtcacttggaatgaaactattaacaaattgagtaatttactttaacaatgtcaatgtgttctcacaattacatttgctttaattagtgtacaagctattatttaatagcatacttcacatagaaaaatgtaataatgcattcttggctccttaaaaaagaaagaaggaaacttaacggactgagtgattttgtggtagagctgttagctgtaaagtgatggaggagaaagtagaaagtcagaaagcaaagtttgcaagaatgtaactaaaacattcttggtacttaccagtacatggaaaggtaaacactattgcctgaatagtattgagaacttttaatgatagttaagaaggggaacatacatcctggaaatttttaatagagtttagttgtaatactgcaataataattcaatttctgaacatcataaagtaggtcattcctaacttatcacccttatggagaggaatgtaatggtgcagaattttaaaaggtgggaaacaaaaagttataattctcaaatgggcttttgttttattttctaatgtaggtatttctgacctaagaatttactaatagcctatgaaaaagctctgcagaaggagatggtgagcaagcttttccactcctgtggttacttcttctatctggcctactctgttgaggtcagaagacccaaggaagaataagttgttatatttctatttctttatatgtagagtaagcagaaggtgatgtgctgtcaaccaagtcataattaataagatctgctgttctctgtaaacagaaaagcaagatttactatcatgttatcaagtggcaacttaatgtgaaaaggagataaaagcaatccagagaattcagtactcta

SEQ ID NO: 104929 - DNA, 1050 bp, Homo sapiens
gttgctgaataactttggaagtattttcatagagaagtgattgccatcaggtatgcttgttttctactgatatatgaattttgtttgtttgtttgtttgtttttgagaccgagtctcgctttgttgcccatccttagtgcagtagtgtgatcttggctcattgcaacctccgcctcctggattcaagctattctcctgcctcagcctccagagtagctgggactacaggcacgtgccaccatgcccggctgattttttgcgtttttaatagagatggggtttcaccatgttagccttggatggtctcgatctcctgaccttgtgatccacccaccttggcctcccaaaatgttgggattacaggcatgagccaccatgcctggcctgctatatgaaattttaacaactttgattagaatatggcttatacagagtactatatgttttagatcttagccaacttacattttaatcattgttttataaaatttaaaagaagtaaaagaaaaatcagacaagattgtaaacttgtcagtcaaattccttacatcttattctgagaagagtgaggaagtataattgagatttcatagatgtctcattgcacatactgcaataaacagaattatatcatgaaatcaactatcctcatgtgcagtgtgatcaggatgttactatggtaacatttccatttgtgaatttttgtgtagttagaatctgtagtcatcacatcatgctaccattggcttttgatttttcatctaaataaatcactgtgctacctgcatgctattaagtggcaccatgtatagtacttaactatcatctatacactctaggctaggaaatcaaaaataggaaaaagaaagaaatgggaacattctgctaaattacattttaagactgtcctgatgttgctggtaaaattttaaatgtttcttaagagaagtaaaagcattgctagttattctctgagatgctttaatttttataagtatatgatgatgaaattggttaggtatggtaacagtaggaggtaaggagggcttt

SEQ ID NO: 104930 - DNA, 1035 bp, Homo sapiens
ttttcagctctaaatagctattgtgtacatatggtaaggtactgctgcttaacaattagtaactgctttgatgaagctaaattacatgtttaagttcccatcaggaagtcgcttcacatatctgtattaatgtattcaaggatcgagaaggaaagttaattttccagcttaaatatttaattcaagcttaaaatttagtctgtaattagagctcccaaatggcaggaacatggagtatttgtccattttaattagattgttgtttacctattaattatatatcatatcttgtcatatagttttgatggtaacagatggtgctaggagttagtaagggtttgaacaaaataagattccacatgatttattaagttgcactttattagtgagtggtctgctttagtcaggttattctcccaaataaggactgtgaaacatttcactaattttggtaattattcttttgtggactcttaagaaatattgagcataaaaagtctgagatgagagatgtctatttagaaacaaaatgatttacttgaggcatctttatatttaaggaatatgtattaccaaatcatataattggtatgaagtttagtgtattttggtaggacaatgttagggaagcaaaatgtcatttattggtaaaaatgtaggcatagggaatgttttatgtatgtatacaaaattatgatttaggataggaaaataataagatggtgatttagttatgtatatcaaagacattcctttcctgacttttgaatttaacagaaggactaggttcttgtttaccaaaatattctaagagcaatctctagtgtctagtgaagttgaacaacagaatttccatattcaaaaagtaaatgtcaactaaatagaaaggccttctaagtttgtttattcaagattttattaatttttctggttaccttctcagctttctaaaaggaataaattttatttatgtatatatgcatatatttgtgaagggatacagacagtaaaacagaggagaggaaaagggagaaa

SEQ ID NO: 104931 - DNA, 1050 bp, Homo sapiens
gctctgtttcatatgcagggtggataaaaattacttaactttttatatttatgtaaatttatttaaaattaaattcaaatttactaccatatgcctcatgggctaaacataatataggctattataatcatttatataaattggttttaaaaaccagttcaatatgttgaatcaatatgtcatgaatttcatatctatatagttgcatcctagtaaattccatgacatgtacttttatagcatacagattttaaataaaattgaatagacttttctagcctacattatggaggaacttctgttatcatccagtcgactgatttaatattagaaaagaaccatgatgcttaaatgtgaaccagccagattttgtatgtctatcaaatcttttaggattgggtttttatctttcagtgatatttgctgattattctctgtttgcagatttttagatgatgtaggataacatgaaaataaatatttacttcaagaggttattcagagagtgcccttgttctctttttgtgggtatttgccagtgtatggctacaaatctttatgaaacattagggtaattacaaggcatctttaaacccatatacctgtgtattttgtcaattaatgaagagtaaaagcacatcttatgtggtatgcagggcagatccgtgacttttttgaaattaaaatgcatcaacattcagatagttgtggagcagtagtttattaggaataccaaatgctgtatagctacatgagtaaacatttaaacatgagtaaaacttgggcaattttaagatcgaaagaagagataaaaggaaatattgggagaagaaaataggcaatatataatgttatatgttaatattatatatgttatccttgagcaaaaacctagaacaatagtaatgaattataaaatattaaatatgttgcctattgccaatacagaacaaaaagttcctttttattcttaaaagatcttcttaagatttaaattttaattacttaaattctggtaaaaatttcaaataagggagatttagtataatc

SEQ ID NO: 104932 - DNA, 1049 bp, Homo sapiens
tagataattgggccctatgaatagaaatacagtgttgaaaaactacctggattttaaataaatggccatatttatccattttgttttagaaatcttctatgatattgtctcagggaccacctgcagcaggagcccacaaattgaataaatgcaacataaggagaggattttttttttctgttgttgcttgtttcaaaaatgctactatccagattctctattaaggtacattgtgctattttaaatattatagttataactgaattaagaccttctttctagattaaaattatccagtgcttagaattgaccgaaatctgtactttactgcctcacttcttggctgttcttacttccttcatgctcttaaaacctccatcacctctcaacccccatcatttttttaagattgaggtgtatttcttgtagagatcaatttaaaagcaatacaatcttaaacacgtgtacgtgtttcctttttcttcatcaaaatgtaaaaattctaggaggattggatattaaaatccaagaataggcaatttaagggatggctaagagtatcaaaataaatgaggaaaaataaagagttctattcttagtaactgaacattttggaatttgtcagtaatggaactttgaggaaaaatttcttgcataaagcacttgatgggaaaaatatattaacctaaaatatttgcatattcattatgtttacaaagccaagaatttaatttctaaatgtatatcaatttttgaatgaaattgaagtaccagtgatgttgatattcaccatacatttagtttaaatgttgcttatatttttagagaatttgcattattttcttttagttcattctctgtcttatttacattcatagtttgttggtacatattaccctccaaagtaaattctgaactgagtacagaccttgcaagaaaagttaatgtccttttcttatgttctcatgacataaagaacgaatcctccccatcatagggataaccttactaataattcccagccaggcaggttatttcctgctgttcat

SEQ ID NO: 104933 - DNA, 1069 bp, Homo sapiens
gtgtgtgtatttttaaaaataggtacaatacttgttagattttttttctcattgtaatattttatagcatttaggaaatataaaaatatagtgtataatttatatggatactgacctaaacctgagagagtagtaataagagctaatgcagatgtgaaaaaatacgaaagtgaatataattgatatataaagcataaaaagcacgtgacagtgtttttcttttaatcttgtatgggcatttactttgcatgctgtatggactcaggactttttaaaaggaaaatgtccagctttttcttttagtgaaacaaaacagtaagaaattatatgtttaaaagtttttgtttcctcagatatttagttttcgtctctcatttatatcctaacatagcccctctctctctctctctctcaaaaaaaaaaacccagaatatttaaaaattgttcttccttgcagtacattctaagaccccgcttgtttaacaatgttgggtaaagtttttgcaagcactctctttatgggcctgtgttctccttttttgagttattccttctgtactggaactctcttatatagtcattccattttatttgactttagttaatttcctcaggtgtatttatagattttgttagtgtagtataattttcagtctctgctctttgttcttcccttccttttcaagattttaaactattatgtattcacagagaactctaaaatctatagctctacttttaacctcatttttatgtttccatccctctgtcccctcacagtgaatgtctggaactggaagcatcgtcttgccactgtctgtccgctccagtcagatccagccattctttgttccctcctgttatccttcagactctttatcttagatctaagaattcctagtcttgttctctcttacccattatatctcattagtcaatgtattgtcttagtagtttttgctcctgccagttctataccattctcaaaagcctagatgactcctctgcagccttattcctggaatactttagaagtctcttaatttgtaccctgctgtcctcaaatctg

SEQ ID NO: 104934 - DNA, 1052 bp, Homo sapiens
tatatttatcttcagagaatatgcagatacaaattaggtaccttgtaagctttctaagcaactgtcagaaaatgactaccacaacttccccagtgaccccgtttaatagttaagactcttaaataaaatcttgctcatggccatgctttagaccaagagtgttttgttttgttttgttttgttttgaataaattaaaattttcacccaaaaatgaagtcatcataaatcctgcaaccataatcttgcactagtttccaggactaatcatgacagtaatttgtaagatcagaattatgagtgggatttcctgttttctcgtgtatttttgtctcccaaatatccattatgaaaataaatcacttttaaaaatgacttgatgtcctttacaaaaatattgtagttttcggatgataaagtttaggaatatatttccacatcacttagattagattctgagtcattttaatatctttcttaagaagtaattaaaatgtgtagttttttgaatgtgcagaaggaaacttcaacttttgtagcctgcagtggaagtagtctagaagaaattatggattgttgtcagtacttactcattaatatttgttatgtgccaggcactgtgctagttgctagtttactgtgattttagtttgaagaatgatattagattaagtaggttttacttataatagttgaaatatacttgggaataaatagtgtatcaagattgcctattaaaataattccgtgtattctgggtgacgttaagtgctatgaagtaggacttctcttacatagtaattggttgacattctttgacctcagtgtaagactgaagtatttaatcaacaaacacagaggataaagttttgataaataaaccactttctttaaacctttagaaataaacttgaagtcttttggcattagattgatgggctttccttttgtgaaagagtaagtgaataatttaagcttataattcatgtttgcaggtcctcatcctgtcataggaataatagtcttgaaaattggagctctggaattcaccatt

SEQ ID NO: 104935 - DNA, 1028 bp, Homo sapiens
cttactgttactctgtatgccgtcttttctgtctggctaccagcaggagtttctgtttccatatcattttggcttgcattgttaactttcctacctcagcaactaaggcagaagggaggtttctccatagatgattcaaattgtttgagaggcacagaaaatttgagcagcccttcctttcaaatgaaccaggttctgaaggttctggtttactgatgaccctgagcctggtgccaacccaatgtccgatttattgttgctggtgtggtatacagctagcagccatggctcagagactggattcagggcagcttctttgagagagtgattgtgatcgctagtttcaataaagtatgctggtctataggagttgagaaaattgctcctttaatctgaaagatgttctaggcaaaggctactgagtgaatacaggagtacactgcttcatttgctgcataatagctgtattagtgtcctaaggttgcggtaacaaagtactacagactgtatggcttaaaaacagaaatgtattttcttttctgggggctgaaagtatgaaatcaaagtgtcagcagggttggttccttctgagagtgagaatacgtggttctttatttaaatgtctgtatcacttcttggccttttggctaagatcaagtgtatttaaatgtctctttttagtgcaagttgagtatttcttatccaaaatgcttgggatgagaagtattttggaattcggattttttttctgattttggaatatttgttccaatgagcatttcttttgagcatcacatcagcgttcaaaaagtttcagattttgtagtatttcagattttcggattagggatcctcaacctattgcaggtttaatgaagatgattgttttctcattattaggattatggttatatatagtatttggatgccacgatgtgaatatggttaatgaaagtggaagtttatagaatttatattggtgggtttcattttttaatttaatttaatttaatttaattattattata

SEQ ID NO: 104936 - DNA, 1025 bp, Homo sapiens
agataggtgttgagagtttaaaatctacaggaaggaaagtagatacagagatgtaaagtctctaaagaggcagaatgactaatggacttggaagccttggccactttcctgattgactatattgatgcagctaaagaaagaatttgtccggccggacatggtggctcacgcctgtaatcccagcactttgggaggccgaggcgggcagatcacgaggtcagcagatcgagaccatcctggccaacatggtgaaaccctgtctttactaaaatacaaaaaattagccgggcatggtggcacatgcctctagtcccagctactcgggagactgaggcagggggaattgcttgaacctggaaggtggaggttgcagtgagccgagattgcgccactgcactccagcctcgcgacagagtgagactctgtccccccgcaaaaaaaaaaaaaaaaaaaagaaagaatttgtccattgagggtggagagtggattggctgccatccaaggaagggcccaaaggttgaagttggtagtacttaccccagcttttgttgggagatttttaatattctggtttctacctctctgtatatagagatatacgcagggagttgcaggtggatgctccaggttttttgtttgtttgttttgttttttttggtggtggaatagtgattaaaagatagacttcagcagacaaggttcaaattcgggccttttttacttgctacttgtgtgtccttgggcaagtttctatcaatctccagtttttagtcagtgtggctgaaggctagacctggaacctattaaattcataggataatgactttcccatgacacctttggagagccagccatcctgtcgctccttgacaaatctgtacctcattccatcagcagtgtgggcctaggtgcttgaactattccattcgaatgcgcattttatatatatatatattcatctgtatgtttgatgataaataaaatatctagttcatcattttctagcgaaaaaacatatgaaagtg

SEQ ID NO: 104937 - DNA, 1069 bp, Homo sapiens
ttagtaattctgtatagcttgttatacacctcaagagatttagttgagtttaatttcaggttatgggatactagtaattcaaatataagctatagcacagagtataaaatcaaacagtaaaaaaatcaaactagaattttgaaaatctaagcgggtattaagttatggaaatgtttattgaaacacttttcttccctccctgtagccacccccccattcctctagtgcttttatttcctcctttctcagctcatacacatttctttccctatgctctgaatatgtgggagatttaagatatatatatatatcttaaatatatatatatatttttaagtgaaatgcctttatatatatttttaagtgaaattaaaaatatatatatatttagtggaatgcctttattagattacagggagaattaaatcatatgtagaatgttgttacttttaatagaatataacacagtcaaaggtcaaggttttagtaaatggggacctgtttgaaataaaagtcagtggttgtttatggttttattaaatgcgttaatcttaaaatacaaattaaatattcctggagacaacatgtatcatttcataagtgtttgaaaaaaaaatcagactaatcagttgttagagggttcttccacaaaaaggttttgtcttttgaaagacaaaaacttaatacttgttataaacttactattttggaattattaaaaataattttcctggctgggcaccgtggctcatgcttgtaatcccagcactatgggaggttgaggcgggtagatagcttgagcccacgagtttgagaccagcctgggcaacatggcgaaactccatcactacaaaaaatacaaaaattagccaggtgcggtggtgcatgcttgtagtcccagctacttggaagactgaggttggaggatcacttgagcctgggaggtcaaggctgcagccatgattgtgccactgctctccagtctggactcccgtctcattaaaaaaagaaaaaagaaaaagaaaaaaaattttttcttagtggattcttcaatcctaccttataacaa

SEQ ID NO: 104938 - DNA, 1108 bp, Homo sapiens
tcttttcattaaaccattcaaattttaaaaattagagtttttacaccaaaaacatatagatagtaagtttctgctgtatactagtattttgcttcataaaacatggttgggattctttattctatgttcacgtattttcatttaaattcaacattcattttcaagagtagtttcaggataaaattaaatatatgctatattttttcactcaaatgaactcattttccccaccttgtgaccttattttcttgagtgtaccacttagaccatctctatcacttcatctccccaacttccatcttttattgtttactgtactttctatgttatattgaatcttgtatacacaaacaaagtttatgaaaagctcaaacccagtgcaggaaggtcctagaaaaaaaagtataattatgttattgtatgaactttaaaaatgttgtctaggaacctaaaactgcttaacagatgtgattgcttcatagtttcaaatttatgccaatcagagttgataggatttgatcacactctagtagatttatgagataaattacaatattgcatgacatacttcagatagaaaaacatcaatataagttggatatcatttctcatttaagataacaaggtagtaatttttttgaaatcagatggttgctactttgagagaatatttatcagtttttatggaaattaatatctctcatattttcttcatggtgacaaaaagtatattaaacttttgttttcatgtacaaatttaattgtaaatgagaggcatcttgtttctatttcgcaatagatgacctgtcaaattttcaaaggcatataaagaaatggagttggacttaaaagaaatttggctgcaggaaaggttaacacaagatggaaaaacttgtacttgtggtactgaatttctttacggtttcaattgatatgtccaaagtcttactaggatttttttttttcaaatatgtagaagtttaacacctcacataacaaagaaaatggaaaagaacttaactcactaatgaagtgacaggttcccccagggaagtcagagtcaaggaattgggagtcaggctctcaagcctgtttgttctcatagcaa

SEQ ID NO: 104939 - DNA, 1011 bp, Homo sapiens
ttattctggtcttgtttccaataatctattataaaacatctctgtaacttcttgtattacatttctttacctgttccatttaccttctgttttaggagggtgtggtctctgttgcattatacaaacttcatgtatgtatgccttgacagtgtggcaggaattctgggatagatagtagtcacactgtcccacattttagcaatctcctcagagattggatacctttactttgttcatatccgtggatcccaactcattgtttttttttttttctgtaactttttcattatatggaaataggccctaggaaaggttgaaataactctattttactctcagacttgattaatggtttggatatagaattctagattgtagataattttattttagatattaaaggcttcatttcacaacattcagtgttactactgagaaatccattgccacttttttttgtccaccactttttttttcctggctatatatggcttgttcttaatattctagaaggctttaggatcatttctttatctctgaaattctatgataatatgtcttagaatgggttttattcatttttttaaatgaatcttcagaggacccttttaagagcaaatgtctttcagtttgggatgttatcttgaattattttcttttcctgtttttttttttttttttttttatccctctttttccctcagttctcttagttggagattcagcaccagtgtagaagggggatgtgtgaggttgagtcattgcctgattgtgggcagaatgatttgcttcttagtgtcttttctgatgtgttctgttatgagtaacttcttttgataagttattcatctgttttccaaaaatttgtgatcttctttctgtttttctctccacttccacttttttgtccttgtgaaatacaccttaaaaaattattaactgctattttagtagggttttgggagggagaagaagcaatttcatgtggttaatctgtgtttggtgaaccag

SEQ ID NO: 104940 - DNA, 2056 bp, Homo sapiens
aatcattgtagctttgtaggttgtgatatgtttgggtgacttattatttaggttattttgcagaattatttatttgctgttttatttatgtatttcattatttatttatttgattatttagtaaattatttatctgatgaattattaatacatcttcacgacatcctttaaattatttataagttaattttgagtttattgcttttagacgctgcattgttactgactagttttgatttttttctttgtggttcttgaaaattaaagtatcagctctaaggcaaaagtatagtcattgcaatgctcatggattttttttaaatttatggcagagataaaatttcagctttttttagctttaaatttacctatttagagttaccagtggtagaatgtttgtgtattatgtgcatactcattttagagtcacttacaaattaatgatatagcctatcatttataaacagtgattgaacatgtaaacctcagtctgcattaccctttgtgtctttaaagaacagatctgcattttttacttgttttaaaatgaataagtcttggttattttattttaatggcaaatctgttctactactggaatgtttttaggacagttcagagaaatgaagtccaactcagatttggattcttgacgaataaatttgactgctgtaatctttgtttttttaaatccaccttatatttgtattgggaaaacatcaggctgtttatataaatctttctatataaattgtgtatgtcagtcataatgacatatttcttatggaaatttttatatttaatgaatgaaaatggacaaagagctttataaatgcaagctgtagtttctttgacttagttaataattctcttgtgtgaagtttctatttttaatcaaatttaagatcatttctgattctatttcgtaacatagagcagttattagggctctcttattgaaagggtttaatgaataggttaaagtagtcattcgggtgagtgccatatgcacaacatggtctttattttgtgtttgcttgcagtgaattagtatgtactttacagttttcacacttcagagagaaactgcattgtacatttcaagttgagatgctactgaaatatagtgaaaatggcctctgtagacaggtttcactataaaattgtaaattatgcatacatatatccaaatttcttattttgaaatattgaatatatgaatatttaattggaatgttcctttagtatcttcatatgcttgccttaaaggaagtgttttcctttgatttatatacatggatttagaaatgtgtgtgtcatacatatctgtgtcttttctggagatgaacaaccacagatactattagatatggcattttctttttaaatgtgcttcagtaatgccaatgtggtcttcttttgaaaaaaaaagaaagaaagaaaaaaaagcttccttctccagtattgaataatctacccagcccctattattaacatatatttggggagtgctagctgtgtcatctaagtgatctttccttggaagatacacagatatgtgcacagacacacatgcacatgtgaaattttcttatgacatcaaaataactttttaggacttgtttttgaaaagagacattaatgtagacttttataataatacttagcattgttgatttcttatgtgcagatacagagctcatatcttttacatggattattcgttgatcttcacagtgatataactactgttcattttcgagttgaagaaatagagacttagagatgttaagtagcttgctgattgccacacagctgaaagtggtggggctcgcattaggactcatttactctgactcaaaggcctttctgtgtagcccattacagttttgtacacatagatagtactccgtagtttttaaccaaagttgttttactttttttagagagtactggtattttcctctaaatatttaacttgcaaagtatattcgttttgtataacatttagtcatctttcttaaacagcagacaagtacttgagcctcttgaattt

SEQ ID NO: 104941 - DNA, 1037 bp, Homo sapiens
agttactactattgtttgttaagtagagtttattcatgtatctcttcagtgctgtagtttgacctttctgcaaaaccaaagggatttttgtggataatcatgtcttcacattctgtaatactgttaagaaaactgaggttaaacaaaagaaatctagatttttaagtttatctaatagtccatttaaaaaaataatactggacaaaatgggcttttctagttatgattgcttatgggaaataaataatatgctaacaggttttactgggtgatttttgtggtgctctgctgagaaacctttcatttttcagatactaaataacgttctagatttgtagtggaaaaatacataacactgcagcttctccttagtggtttgtcagtgtgtatggtgaccagtgttattagttgatggtaagctttcatttgaaacattgtagttttttttgtcttaaatagccattatcctttataaaaaagtttatttaagaaactataaattattgcagtattgagaggatcaatgaaaactttggtggaagcaaatcttttttgtaatttagttgattttatttttaaaatttcaatacttgatgataccaaggaattattgatattgttgagataatgacattgggattatgtaagaagaatttgtactttttgtgtgttttcggtatgtagtggtgaaataggtctgggacagttgaataactatagcaaaatttgattatttttgagtctgggtcatctgtctatagggttttttaattctatttttacttattttgtatatatttattaaatggtattataaaaatcaattagagattaccatgggctggaggaggagcattggggaatgattgtttaattggtgcagagtttctgtttggaatgatgaaagttctgaaaatagacagtggtaatgatggtacagcattgtgaatatacttaacattgatttgtacagttaaaaatggttacaatggtaaattattttattttatttttttgagttggagtctccctctgtc

SEQ ID NO: 104942 - DNA, 1199 bp, Homo sapiens
ttcaggtaaatcttcagtttactgcctgctgtcttaaccttgaattatgcattcagtggcatcaaatgagtgcatggttacaagaccatgacatgcatatatttgcttaattaaaagacatgttgaataggaatactagtagatgtcatgagatacagcagtcgtcacgatgagctgcttagcagataggccttaggaagccaatatgtcagttttctaccttttcttttaaaatatttcaaggaggccatttttgggagaacaggccatgcttctttccactatacatattgcagttgaagaattttctctctaatcgtttcagtttgagaagggaaggaaagtcatgccatcctctggcctcactcctggtaacataagaaacaaaaccctccttggctagatctaaaaattacataattaaaaaaaaaactatacttccattttcatccaactaatttatttaaaatttccgagaaatgtctttgtcttagatcaagttccctaaatgcagagcctaggatggggagtcaggtgatcatgatttggtaagggccctgggaagaaaggaggaggatagggaagcgaaagaggtcccataaggatatggtctcaggcaaaatctagccccagattgatggagggagcaagaagaatggggatgactgtctctagagagtaaattgaagggtagagtaagttgtccattttcagaaacaggggcagagactttgtgccactgggtcagccagtcactggccacccggggtgaggaggtcaatgaagaagtgtagagttggtttcaagacattttttgagagcagagtgcaggtgagaggtattagcaggcagcagaacagctgaggggtagctgccttggctggtgggggtctggatcagacacccttactcttccccttcactccattgtttagtgtccatcatggcagccaaggtgaagactcgagatgactggaaaatatattcttcatgatcattcagttcttgatagataacctcagggtaaaaaaactgggccttggaaacatcagagaggtgcagattttggcagtcattggacatttccttctctcttagcccaagaaacctattaaattcttgcctgacaaatcatatgctcccactgcagcaggcggaaaaataggactccagtgtctctctttggagagttctttcat

SEQ ID NO: 104943 - DNA, 1001 bp, Homo sapiens
taacaaatagatcttaaaagtccagtagaggaaatgaggttacagtaactaagtagtattctcaagaaagtatggtaaagagctattaaaaaagggtcatagacagttcaaaagcaactggtctgttttcccagccccctgctaattcatcttgttctgttatttattatttttcctgttttaaatattgtccccttttcaaatccaagccagtatttctcttcatcaatgaagaattccttgacaaccctacctcaactcttcttctccatgtggatccacttgatgtctgcccatcaatgacctttatcacatgctatcttgcactaatagttatttttgaattccaggttttcccaaatgtgcttggagacatttaaggcaagtgctttcagtaaagtttataagaccttttggtagttaccatggagcaggcattgggctgaatgtattctgtttcacttgtactggctactatcctgtgagattaataccattattatctacagtttgtagaggaagaatcttgaggctcagaaacattattcaagttcacatagataaatgcctatatgagatataatcattttattggcatacagaagtgcttgagcgtgtcttgaaagacaagtagtatttgaatgggcaccaaaaaaaaaaataggagaaagggctttcccattagagagaattgtataaggaatggagaatagaatgtagggcagtgctcagcaatagctaataaatagcccaacagatttggacatcagtgtcattgggaggaacctcgaaaacagcccctgagagggtgaacttttctcctaccttgggaagccactgaaggtcatggtgcacagtagggtaactatgggcagtttgaaagtggaagactaatgtaaagattctcactctgggatctgatttacaaggatatcacaaacatggttaagaggattcaagaaagcttaattaaacccgtttctttacctatcagtaagttt

SEQ ID NO: 104944 - DNA, 1443 bp, Homo sapiens
tccactgctaacctgctgtgtagtcccaggcaagccgtttaacctctcagacattgaacttccccttcaggaaagtaaaatagattaggtcatattatatctaacgtcccttaaagttctaggtctgtgtgtttgtgactgaaacaggtacacaagtattacagaggatgctattttgattgaagacactgctgacaggtgttctagtctgggaaacaaaaggtaagagtttggataatggaagggcttagtttggggggtaggcggaaaagtgatattttggggtctagagccaagaagggttatttacaggtggcatataatgggttgaattgattgttggaatccagtatatgaactccatattacatggtgtgagttgagctcatgattgatatacacttttcatctgagacttgttgatagatgactgggaactctccctattatcatacagagacctagcagcatcagtacagtatagagtatgagatgagccgaattccattggggaatgggcttggtttaatatgtggtagggtggtgattgctagcatgatatgatttgaaggttgctaaagactttcctctttaaatatgtctcttttttgtttgcttttcaattgatgcctgaaggtccacccttagctgctcttttgattgattgattgattgattgattgattgattgatggaagtttttttctggcacattaaaaactttaatagcacattaaacgggaaagcagggcaatgtgagaatactcgattgatgagaaatcacagatttggaagagattagggagatagggagtaaatacaaaggaaaaggaagcagggagtgacagctcatttgagagaataccttgaaaaaaaaaaagaataccttgaaatccatttttgcaagtttataaattggtacctgtagcatttaatagctgctgagatgtgtccatccccaaatgtcgcgtttaaatgtttacccattttacttatggtaccaacaggagtgctgcttgtcatgggtgttacttgactggtttactgatgaagtatttggttgtttaaatgaaatgcagattaggtaaaaataaattactttcaacaaggtcaaggaagtgaaggttgtaaataaaatatacattcacaaacagacaaatgctatttggaaatctagcttagtccatgccaagctgttactgtctaaattaccttctttcttcctggcttgcaattaatttttgcttctatgtttggagattgggggaagggtaatagcctaatgggtaatgattttattttagtattttgattaaagagactaaatagcttggaccctggataaccataaggacgaaagccttatccatcaagcttaatttctaaacagaagtttatgcttgtatttctgagcaaattagcattgagccacatataatataa

SEQ ID NO: 104945 - DNA, 1119 bp, Homo sapiens
cctgggctataggctctgggccagacctggttgctgcaaacattttcacaacttacatgctctaattcaacaaataagaatatcttgcacctgataatgattcacaccctaacttgataaaagctattctgaaagcagctgaatacattaattcattgaatcctcataccaacctttccctagaagaaaaatgagaaaaccaagtttaaggttgagtcagagttttcaaatcctctgctaagtctcttgctccttcctctacttcaagccacctcctcagaataaaagcaaacttattttagaaagggaaaagtgaaacttggagatctttttgtttgtcatagaggatgggaggttttcttgttagaatgggaagaggagcatgtgctaaagcattgtcctaatgaaataacttgtttgacaaattatccagttgggaaaactagacaatggcatttctgggattgtggggagaacagccccttttaaactttggtctcatgaaaatatctgggagaacccagtcctcccagcttccttggtcttaaggtttcttttcactataagctttgcagattttcctgatgagtttattagaggaatttttatgaacaataataattcatgattattatctgagaattgtatattttacagaattttaagtgatgatttctaccgtaagggtatactttttaaaatttgatttgtgcattttatggtgtgtgacttttggagttaaattaatttagcagtttgtttccatgaagactgtttgaaagcatataattactgagttacagcttttacatgaattacacaaaagtctttttttcttcattttttacatctctttatgtaattcttcattttttacatctctttatgtaattacctaaagaattactaaaggtatgctatttcataacaatgctttagaaaatttatgaagttaatataaacagtatatgattaatctggtagttgcactattttgtctctttacaagaaatccctctacgatataatgaaacataggttcatcttgatttcaggttcagttacaggcaggaacttaacacttggtaaaagttttatttcttatgaatcccttgaaga

SEQ ID NO: 104946 - DNA, 1031 bp, Homo sapiens
gaatgaggaactctttatgtataaaaaatatgacttctaagtatggttaaagagaaaagataaactatgacttctaggaatgataaaaaagaaaaaatatacgaaatgaaataaaataatttggtttggtactttttctgtagtgtttagtgttaatacacacacttttattagttaactttgctcctgaagtcaccactgacagggctctgagcagagaattactttacttatcacttaatctgcaatactaataaaagaatggcttacttaagaccaatatgaacttcaacattgaactgctttaaaaaaaaaaaaaaacatctagccagatatttgactttgtggttccttaatacagcttttgttttctaatttttctaggactctggttttatttattttccaaatgtgatttgggtgtccttactcatcaagctttttcttgagctaaagttataccaattcttattaagtgatatttcttttcatatgctgttaagatactataggataactttcctgtatgtatgcttaaaggctttatctgctgataagttgggatagaatatatgtttaatttatttttgcctgaattattggttaactggttgtgccacccttagctgtatttgtttgttctgaagaggagctgagaccaagcccatagctagggtattcagccaatgatgaaaatatacagtatatacatactgtagattcttagtgaaactctttcaaataaaacatttctattactgcagtattactggccatctaaccaaactccaaaatgactaactgatatgtgtatgtgtgtgtaattttattttgctgctgcaatataaatctttaaattattaatattattataatggagatcactaccagtttgttcacattcttccctttaaccatgattaaatgaattaaattttaagaaatcttaaggtattaaaggtattatcaatgcaaaattagtactttagatttggaaaaacacgttatagagcacttgaattagtgctgtc

SEQ ID NO: 104947 - DNA, 1058 bp, Homo sapiens
gagtggagaagaaaagggaaggatcactgctggccaggcaaagcaaggcagcaggctcaccctgtgcctttcatttcttgcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgcggtctccttttcctccttgcccttctttgtttagcttttttttaatgcttgaggaagaatctcaataagaaattagatagatagatacatagatttatatgtttttaaattcgtatagttgcttgaggagaatttggtcccaaatcattaattctgatataaaaacaataagctcctaattagatagagggaagaaaattgctttgtgttccttcattctttgggttatttgggggtgaaagtagtctttaaatgggatatttgtctctactgttgttattaagtaaagtattttaaactcaatagaaaaagaataaagtcagttttttcccaactggtttcagaatcgccatttgaatagtaaataaataaaaataaataatttcatttgtatttatactttccagtacgaactgcagctggtaccaattacacaccatctcatttgtaatctttcataattaagtttaataaaatccttgaaggcagctttaaatggggctgataaggaattctatccatactccaagatacgggcatgttttctctttcttaaaatttttggactttttaggaaagaaagttgccttccgggtaactttgggtatgtgaatctgtattgttttttaaactaagttttaaaagtaacctcataactgttataattcagtaaatcaatttgcattacaaacccttagataaaagtttgctagttagtgtattagactcaaaaaccacaagcaaatatattatctttt

SEQ ID NO: 104948 - DNA, 1229 bp, Homo sapiens
cgctagatgccctcgttgggggtgcgaggctgtggggaaaagtttaaggtttgttaatattagtcgcgattgttggcgaggggggtgggggtgattggaagggaggcgaggtggccttcccaatgcgcgttattcggggttattgaagaataatattgcaagtgacagccagaagtagactttctgtcctcacaccgaagaacccgagtgagcaggagggagggagagacgcgaagagaccttttttcctttttggagaccttgtccgcagtgatttttttttttttaagagaatcctcagtcaccacgtcgtttccccagcaccatcacagtgtacagctcataacgggttttgctttgtttttacgatttccccccaacgaatcacttgtcagatcaattttatcttcttcctcctccctgcttcccactctcccctcctccccatcgcaaaccctgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttatttttttttttttaattaaaaaaaaaaaggacatagaaaacatcagtcttgaacttctcttcaagaacccgggctgcaaaggaaatctcctttgtttttgttatttatgtgctgtcaagttttgaagtggtgagtttcaggtcggttttgctaatttcactcagtaaaactgcagtgtttctgtttctagatagtactttgcttctttgtctctttaaaaggtcacagtgaaagcttggcctggatcgtgccggccatatggaatggataagggcacaatcttaaaatgtgattatggggttgtgtgggggcgaaggaggcgatccagctagaaactcattgaaaaggatctcgctttgcaaaaaatcggttcctaaaaaactagaatttcgagattttctttccttttaaaggaaataattgttgttactgagttcactgttttattcagtaattatcatatatggtcttagtttatgggcagataaatgggattttcagaaagtagcttgctttctgtgtggcaaccagacattgcactaaaatgggttgtaacgtgtaactcaaaagaaactc

SEQ ID NO: 104949 - DNA, 1006 bp, Homo sapiens
ggttgttggcagtagcatgggaggaagactagaggcaggaagaatactttggaaaagtgggcaagagatgactgaaaccgaacaaaacagtagcaaatataataaagtggaggggtaacttggagctttctggtagattcagttaggactgaattactgccccactctttctgctgaagaaatgagtgtcccttcacccagccacaattcatagcagccttgtttactcacctgcagctctttccccactcccaccccaatatgtatatgtgtgtgtgtgtgtgtgtgtgtgtgtgtgtgtgtgtatacatgtatgtattttctctggactaatttctaaaaactggcaagcctgttattttatcattaagtagcactgagacaatggttgtagagaacaagactcatcagacttaatgtgaactaggaggaacacctggaaatgtttaggtcacataaccctgatgctcttaacccttgggatattatgttattgttgctataatttcaaaaagtaaagatgttatgtatttatcattaaaaatttattcaaaatcctgcttgatattagaaacaagagaacatcaaatgtgtccatatctcactttgacctattgtgttatattgagcaatgcactatttcccatcatgacagcacagtcattaaagagagtgggaccactcacaactcagttttccttatacctgcacctccttgtattaagttattaaaccatgaacccatactagaaacattattattagttagctattatgagtttttatctattgacaaatatattttagtgctgtctggaaagcatatgagttctctaataattataaatattagcaaaaattagtacagctactatgaagaaaagtatggaatggtcttcaaaaacccacagataaaacttccatataatccagcaattccattaccatgtatatatcccaaagaaaggaaatcaatatattaaagagatatctgcattcctgtatt

SEQ ID NO: 104950 - DNA, 1028 bp, Homo sapiens
agtgaggcaatgcctctccctgcttcggctcatgcacggtgcgcgcacccactgacctgtgcccactgtctggcactcccaagtgagatgaacccggtacctcagatggaaatgcagaaatcacccgtcttctgtgtcgctcacgctgggagctgtagaccggagctgttcctattcggccatcttggctcctctccctgtatacatattttaaatttactaatgtattgcccacagcctgattattattgtggtttccatggaaatcagtaattttggtgctatttctttggaggaagctttgaacatttttatttacattggataatccaaaaagtgcaatgggaagtgtgaagagactcaaaatacactggagtggaacaaaagtttgggatactaaacaagaagcaactctcattcccctttttgggagaccaatagtgaacaaagagatgtccaaaattactgacttaaaaaaatatgaagacataaaaaggtcattcgatgggtacacagcaatgctgtgcacaggtaaggcagagaatgagatggcacaaccataaacatacatggaagagggtagacagaatgtcctttattgtgtataagttgtcaatagaacaaatgtctagaatacaatgggaatctagaatgtaagttggatacatctgctatgctaggcaatgatgaatcctggaagaaatagcagggaggttaacagctgtagcagccaacaaaaatattgttttcaaaaaactaaaataaaagatattagtggcaaggagacaaatgaaaagacggtattttctgttagttgctgaaacacatttctgctgtacaggatccacatcaggatccatctagtgattaacacacacttttttaaggttcctgatcagggcattgagtggatttgtgcacatttgttggagaggtgagaacacatggtcaatttcaggtaatctggatgtattctgagatgattaagagtccaagggtggttatagccatttaaatcagacgtaggg

SEQ ID NO: 104951 - DNA, 2050 bp, Homo sapiens
atatgaacattcactctacagacatggaaagcatcaataccaattaaatattcaggcttggaagccgtagcaataatacatggttatctttaattcttctctgcaaactgtgcccaaaccccattaactgaattcggacatccttccctaccatcctctcccaggactgactatgatgatgactttgggaactgtatccaaaccataaaaatgtgagaatctcaccccactgaacagatgcatccctcttgaagacctggagcccttggtcctacttctaatcatctttctccctaaagcggatgagatcagggcttgggggagggagggattaagggtgcagagggagagaatggctttgcactagtaagtaagaaatatttactttgattttgagtggcatggtggtggcatggtagctccatgaaacaaaccaccagtgttttcagtgcacacaaagccctgcatattaggcggtaatttatcgttgacagcatctgtttcagttttggggctctcttgattcaacagccacatcccgcattgcttttcagctaggatgagtgtgggtttgcatttttggttgtagtagagacttttgtttgtttttgagatggaatttcactcttgttgcccagtctggagtgcaatggcgcagtctcggctcactgcaacctcggcctcctggattcaagcgattctcctgcctcagcctcccgagtagctgggattacaggcatgtgccaccacgctggctaattttgtattttcagtagagacgggatttctccgtgttggtcaggctcccaaagtgctgggattacaggcatgagccaccgtgcctggcctgtagtagagacttttataaaggagtctgctttaatccagggcatttgcagctgtattgtcaagatcatatattttaagttctcattctgtttgaatacaagggttaagtagggaagttttccagggctgtgggtctgactgcaagaatttataattcatcgagtcagtttctcgttctccaggggattgcctccatcagcattgtaaatccagtcctgggcagtaagagcttaaatactacgcagtgactcatttatgattcctcttgggagttatttcctctcagggaagtctctctgagggggccaaagctcccttatagcaggaagaattcactgcagaaacaaacaagaaaactgggacctttgccatcatctctgaatggatttaaggttggcttgatagactgcaggagggactgagtgctaagatgtcccagctgttgacattcttccttaacgaacattgtgtgctctgccccttcatctcccaagtgaatcagccagtttctgctgagagcccttatacatttccctctgttcatactcagtgtaggtacttctgtctttaactgctgtctgaaaggaggtgagactttttccctccaccctcctccccctacttaccaggatgaatcttagtgttacttgtttcaatggggctgaccatcagattggtagcatttccctcttgcccataggagtgttatgaaaaccagaccactgtctttgaacccacctccgtgaacttgtcctgcaactatctccccaatttctccttaataacaggcaatgaaatgaagggccatttattgccaggttaaaacacagaaggtattaaaaactttgtaaggataaaaattgtagagagctgtcaaaagtacacacctattggtcatatgaaatgtcaagcccatatcatggtaataatgctctaccacggtctaaccagcgtatttgactcctcttctgtgaaaattgagacaaatttgaatttatgtgatgaagctatttcttttttcttaaactaaataatgttgcctactctgctcttgaagacaactcccattttatgttcttttgcttcctgtataacagaagggagatgggatgatagataaagacgagctgcaggaagcttgtgaccaggccaacttgagtttagatgacaagctcctggaccagctatttgactactgtga

SEQ ID NO: 104952 - DNA, 1004 bp, Homo sapiens
atgagaatggggagaaatcgtccatgaacatggagattggacatccccacgaaggaaaggatgatttaggagacaagagggtcatcatgggaacaaaatttcccatggagttggggatcagagtaggattaggaaaagaagattcccgatgcggggagagccctgtggttagtaataagtgtgagggaaggatggcaccaccagaaacaaaatttccattgagcaaggggcttgaaatgggattagaaagacagaatatttctaggactgtcatgcagaggggtagtttaggagtcgacagtgtctcagcttcacagggaacaaaaccttctctgttgccaggaagaatggggttagaaaatgagagtcttcttgcaggatatacccatgaacggataatacagcctcctttgggcagggtgtgtggaagttcacaggctgcagggagcaggagagctcctttggctagtggccctgaaggggtagaggaattagtgggaaagcctgctttcgttatggaaccaagacaggaaatggaaaaagagtctacctgtgttttaatgaaacccaacacagagattaagcttcctgtggaggtggacattggactaacccaagccgaggggccagatgagactaagaatacagagccccaaatgggcttggtgatagaacctccccaatgccagtttgcccaacaacatgaacagagaaaggaggctggaaacattgaatcaggagtggaacctccagatcgcatcagacccatatactctgggaagttttttgatcggaccccttgctggccaagtgtaagtttttttccactttccataggaactaaactgtgtatagccatgtctttattgagatgataaagtgataaaatttgttttggtttgaagagacaaatcacaaggattttatgagattcctatatttcttgccccactggaatctttgcagatgttacttagatttctgattctctgcctcccttccta

SEQ ID NO: 104953 - DNA, 2008 bp, Homo sapiens
cgccgctcccacaagggctgggcacaaaaaacaaacaaaaaaacacaagttattttgatcttcccccaaagaatagtaaaggaatttcccccgaccccggccgccaggagcccagagaccccccagcctaaataacaatggcgctggagagggcgtggccgcgcgtacctggggtgggggaaggggagaaaggcggccagttcggatctgagccactcgcagggtcacgtgacatcctgcctcgccccgccccgcgaacaaacctaggcggggagggattcgggaaggggcgaggaagcggaaggagcaggcggactggcgatgatgggaagtgacgaagtggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgccggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtaaccgaaccgcccctcctcctgcgcagcgggggcctggaccccaggttatccgcggtccccagcctgtccgcggccctgccggtactgagaccccccaccccttctccctcacgcgcagcagtgccctggaccagagaactatcgaacccggcgtcttgttctgccagccctggtgactcatcctccaggggctctggagaccgggatttggggactgactgagggagcgacgggtgtcaccctttcccttctcaagatggcgccgtggaaagtgtactggaggccgcggttccgcctggtctccgtcctggcagtcctgggggtctcggtcaaagcaaggcaggttcgggggaggaggttggaaaggccaagggacctggcgagtgctgcttatccaggcgatctgtagttggctattagctactcaggtgctctccaagcaggaacctgggcctactgcaggtgtcaatgtggggagctccgcctatcttcaacttccaaagatgagtagtgtcggtgggtgggaggctcgtcaaaataggctgtctagagacttgttttctgtttggaaggtagtgaactacagcgttaaataaattcaagataacaggaccgctgaactccttcactgggtagagaccatggaacttgctctggcgttatcttccctggaagctgcttacctctgagactttcaaacttgttaagttctgaacgtcatagttcacatacttggtttttgtcttgcttaaatggaatcaaagcgttcaatcagttgcctttcacataataagaaaaaaacacttgtacacctctgggaatactcaagactgctcataaactttattcctaaagtaaaatggaagtgataactcagcatttgtataaacaaagtaaatggaacagtgcctggcacaaaataagtgcccagtcaattttttgatcaaagaacccttagaaggattttaactatagaatgaataacagttattttcaaaagattacaaatgtatattatgcaaaattcttgttttgcaaaacagaagtttcagtaagcagtgaatacaaatgaatgcacgtaatttttaaccttagtgttatgctaagtgtatatttaccattaactttagttatttcctgtttgagatccttagggggagtagccacaattaagtagctttaaaccttaaaagtcaaagtgaaatcagaatcttgtttgatttttttttttaat

SEQ ID NO: 104954 - DNA, 1048 bp, Homo sapiens
tcctctatttagacttttttttttttttttaagatggagtcttgctcagttgcccaggctggagtgcagtggcgcaatctcaagctcactgcaagctccacctcctgggcttacgccattctgctgcctcagcctcccaagtagctgggactacaggcgcccaccaccactcctggctaattttttgtgtgttttcagtagagacagggtttcactgtgttagccagggtggtctcgatctcctgaccttgtgatccacccgcctccgcctccaaaagtgctaggattacaggcgtgagccaccacgcccggcatacttagaccttttaaaactgtgcctgttctcttgctctttggcttctctactagaagggcggttgtggctgttctgtatatatcagtgatgaaatagttttcttttttgatgacgtagatggaatccatgtattcttgcatcattaggtattaagttgggcatgttacatttgtaattttatttaattcttaggacaacgatgtgagatgtagtatccattactctttccaaaattgttgccttcccagcacaagagtggcagagaaaacacttaaattacagtcagaagtggccctgtcacataacagttcagaggaacctcagttgtttctttgtccaatgggaaagatcattggttacccctcacaacagctatgaggatcaaaagtaataatatatgtaaactgtaaaagcatgacaaaaatgtagggcagtgatgtaattttcaaaggaatgatttatgatatattcaagattataatattgctgtagaagtcattgaaaattaaatatgaggttgtcatttagtgtttgaagccagtgttagatatttggtttccctttgtcttcattgcagacagtaagtgcaaataaaaattgccgttgagatcaaagagagttttatttagaataagataattctcccccatctctggaactcagtatttgaaagcagatttaatgtaagaaaagattaatcaaggtgggataatgcaagaatttcagacaaaa

SEQ ID NO: 104955 - DNA, 2246 bp, Homo sapiens
aagtgtatttccactagcatgctaaggtatgtttgtgtgtgagtatgtttcctccagtatgctaagttttgacacatgcaggcatctaacttgggtgttatctgtccttcctttgcccaaagcatagattataattgttcattctcaaaaatgcaactcttatctatttcccctttatttgaaggcagctgatggttactctgcaaggtgtaagtttctcttttaaaaactaagcggtcgagcatggtggctcatgcttgcagtcccagcacgtgggagtctgaggcggaagagttgcttgagcccaagagttcaagaccagcctaggcaacaaagtgagaccccatctcactttggaactcaggactgcagtaagccatgatcataccactgcacttaatcctgggtgacagagtgagaccttgtctcttaaaaaaaaaaaaaaagagagcatgtatatagatgttttaaggccaaaggctgtggaagccaggaaggaaatagtagatatgatctatcacaattcggggtgataattagttgcacagtagaggacaagttttgttggggtgatgattgcaaaggtatttgtatcctgacttgttctaaaaaatgtttgtggcagtctagagaacgctgatatgagctgagcttctttataaacttactggctggccatcatctttattgacttagattttatttaatagaagtaataatgaggccaggtgccatggctcacgcctataatcccaacactttgggaggctgaagcaggtggatcacctgaggtcaggagttcaagatcagcctgggcaacatggtgaaaccccgtctctactaaaaaacaaaaattagctgggtgtggtggggcatgcctgtaattccagctactcgagaggccaaggcacgagaatcacttgaacccaggaggtggaggttgcagtgaactgagatcacgccattgcactccagcctaggtgagcctgggtgacagagtgagactacatctcaaaaaaaaaaaaaaaaaagaagtaataatgagtataaaataaaatagaacttttctggtattattgagtgaatcggtatagagaattacataaagcactagttaggcttaagttttaattgtatctacaaccagtccccatctaccgttcccccaacacaattaccccagaaatcaaactccctaagacagcaaccaatattttggcattcaatactcagtaaacatttgaaaagaatgaacatatggttatatgatactttgggggtaacctaactggaaagaaaaattatagataagcaggtgaaactgatattaatatgagtattcaaatattctatttatttgatcattttctttcagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccg

SEQ ID NO: 104956 - DNA, 1127 bp, Homo sapiens
aatcttaatatctggttctccctcttccattcttgccttactcccactggaataaattctttggcttgtcatcctcccaacttcaggacaatcaaatacatatggcttaatgggaaggtggtcagattagaaaatattcacagccaatctctccagtaggcagcccttgtttggcttaaaactgcccgttgaattcaagtttcttacatgttccacaactatgattgtaaaagtcaaggcagcaggcaccagcctgtgtggaagaaagttatatttagtattcctttcggagctgtctctttggatatcgtggagattctggtacaggctgttactgtttgagggcttctgggcctgtggcagagaaggagtgggtggtttgctgacagttcttataaatacccccagtatttatttaatggcagaaacacacagagagaacacacagagtattagaggagagaacatagcttagctccattcatcccctgggcccaggaccaagcacttctaatctgttctgaggaactgcttctggggccagctgcagccctgtgtctgggggaagtcacctgcctgcttgctgaaggaggaaggaaggaaggaacagggaacaatgaggcccttgtaaaagccaagttttgcttttttttttttttttaagtttattttctaaccatatcactcttctgcttaaaacctttcagtagctttccactgtttctggaataaaggtcaaaagtcctaatatgatgagaaaggttctgtagggcctggccaaagcctgactcttcagcctaatctctccccactttcccattcattaacattcctcaaacataatccacactctgcccacctcaggcctgtacatgctattctctctgctcaaaggcttttctctccactggcactcagttaattctaactcattcctcaattaaaacctcatttccacaagctgaactttagcatcatcagaaaaatgtttcctgatgcttcacaggaatcctccacactttgtcaaatgcctccagaactccttatgctttgcattgattcaagttttttattttattttatttatttatttatttatttatttatttatttatttatttacttac

SEQ ID NO: 104957 - DNA, 1045 bp, Homo sapiens
gaaggcgatcaacggtacaccactttcaaacgcagcactgacttgtatgctccacagtcatcaacagtgaaaacaacagttttcaacaagagttggaaacactgagttgagggttttttttttctttttaaagtttgaggccaaaatcgatatttattcttttgaattatgcttatatctttttcctggttaatacgcacgcggtggcacaattttgaaaactacgtaacgttatagaaccaccacccagaaacgaatcctgttaacaaactttttgtattcaaactttttccactgcatagtttttgacaatgctttttagacaatctttcttttagcaaccagcactttcaaacaaaaattacagagaatagtaagtttttttcccctcctccggcagatttgacccagaaattgctatgggaagaaagtgttaattatattaaaaaatagtttgacagaaagtatttaaaaagagaaagggagaacatcacgtctttattttggtgaattagcaacaaagaaaaagattagcatggacgggtacttttcaaaaatatattttttttcctctggctcccgctagggtggaggaagttgtctctctgtcagagacagggtggaagagagtgaaaggacaaatgattgagaggctgccccctcccactggtgcaggcgtgcgggggtcggatggggggccgcggaggggggaggtggccagcaggtgcctgggctccaggcccctacccccaccctcgtccccaccctcacccacacccagggattggcctcgccccctggcgggcgagcggtaggtgtcgaagcactggggtggggggtgcaaaccccgcgggcagcggaaaagaggccgtggggggcctcccagcgctggcagacaccgtgaggctggcagccgccggcacgcacacctagtccgcagtcccgaggaacatgtccgcagccagggcgcggagcagagtcccgggcaggagaaccaagggagggcgtgtgctgtggcggcggcggcagcggcagcggagccgct

SEQ ID NO: 104958 - DNA, 1327 bp, Homo sapiens
tcactctgccacgtaggctggagtgcagtggcatgatcgtagctcactgcagactcaacctccctgggctcaggtgatcctcctacatcagcctcttgagtagctgggactacaggcatgcgccagtacactattattattattatttgtattctttgtagagatagggtttcaccttgttgcccaggctgttctcaaactcctgagcccaagcaatttgcccgccttgcttcccaaagtgctgagattataggcatgggccaccatgcctggctgaaagtgttcatttttatgtatccattcattcagtaaatatttagagggttaccaactgggtgtcaggcattgggctaggtgctgggcctatgacacacagaatttgtccttcaggagttacttattgtgtgtgtgcacaagtgcatgtgtgtgtatgcatgtgttgggggcctagggatgagggcagtgaaccaaaattacagagaagttcagaaaaactactttcttggagtagttgcggacccagagcaggacagttcatagactggggcactggtagggtgggattggcttcctggaggaagtgtcagtggctgctaagaactcttggcagggcagagtggggtggggtgaagcttcttgtagtggagaaactgaaagcagttgtggaagcttggaggtgggccaactgagccagacctttgttgcctagggccaccggctggggtgcgtggccaagagggcactgaggagtgcaggaatcttaacctggagagtgacattatctcagatttgctttttttaaaaaaaaaaaaaatttaactggacttgattgggtacgagggagtgtaagagagcaaaatctgtggttctctctcagcttgtttctgcacttaatatgagcaagcccaaaaggacagattgctctacctttgccacaggccccttggcaagttagattagagagattagagaatgaggagggatctagaaagagataaggtagttcactggggggcttttgaaagaaaaacaggtcccaggcctgatataaatctggcctttaaacttcacaaacgaaaccaaaaaagaagggagctaagtcagccagggtgacgtgccacaccccagagaatagaaaaagaaaaaaaaaaaagaaaaaagaaaagaaacaaacaaacttgtttcgcaggatccagatctttgaactgtgtcctggtaaaggttgcttcagagtcattttggttctgtgttcattaaaaatgtagatctaggccaggcgcagtggctcagacctgtaatcccagcactttgggaggccgaggcggga

SEQ ID NO: 104959 - DNA, 1048 bp, Homo sapiens
ccagactggagtgcagtggcatgatctcggctcactgcaggatctgcctcctggggtcatgccattctatgggatgaatctttaactaagcttttgaaagaaaggatgggaatttgatagtcatatttggaagaacccaggagggcaggaatgtggataagaaatcaaggaggtggccgggtatggtggctcatgcctataatcccagcactttgagaggccgaggtgggcagatcgcttgaggccaagaaatcaagaccagcctggccaacatgacaaaaccttgtttctactaaaatacaaaaattagctgggcatggtggcacacacctgtagtcccagcttcttgggaggctgaggcatgaggatggcttgaacccaggaggcagaggttgcagtgagccaagatcacaccactgtactgtagcctgggtgacagagcaatactctgtctcaaaaaaaaaaaaaaacccaaacaaaaaaaacaaatcaaggaggggtacttggccaagtagatgtagataaggaatatgaaaggaagagaggtagaatgataaggaggtgggtgcatgtgggctgatgatgtcactgctggtagtatgtctagcctgcatagctccttctcccctggagtccgtattggtgagtccttactggtaaatattcatgtgaaatcctgttgccacttgtccctggttctggaagatgactagagttgctatacgttgtagtcggtgagccatgcagaaccatacatgttgagagtgatggcagctttcctaaaaggctggcagagcccagtacataaagctccagtgggcaatgccacctttcttatgtgggcctagttgatagagatgttggaaagagaacattcagtcctgtgttctctagaactacttgctgaggccattaaatgccaccctctccccaggaatgacagtgagaagcaaagattactctacagctccacaaagatttttcataacaactgtccctgaaaagtagtattgaatatatgatgagctcgttatttaatggctgattc

SEQ ID NO: 104960 - DNA, 1037 bp, Homo sapiens
gcaattctcctgcctcagcttcccgagtagctgggattacaggcatgtgtcactatgcctggctaatttttgtgtttttattagagacagggtttcaccatgttggccaggctggtctcgaactcctgacctcatgtgtgatcctcccacctcggcatcccaaagtgctgggattacaggcatgagccaccgcacctggctgggacatgaactttagggcacacactatttaacccactgcaccgcattaaaaaaaaaaaatcagaaaagccaaaaatttaattttattaattctaatttttactttaactgaatatttcaaaatattattataatatgtaatcaatataaaataattcttaatgtgatattttaacattttttaatacgaagtctttgaaattcagggtgtattttcaaacactcataacacatctcaatttttattgccaatttttaaagactccgtattcgcttgtggctggctgccacatcttggacagcacagttggagtgctgcggggctgacaaaacttttatgcttctcagtgtttcaccccatgttgtctccctctcttcattcctcttagttttcagggaattttaatttgtttgggaagtctcagtcattatgaacaaaagaaataaaaatatactttgtactgggatcccaagactcagtggaggaagtaaaatcagccagttttgaaagaaaagatctttattcagttacatttttaagcatcagtgtttattgtatggtagaattcattaagcactctatcacaagtggtttcaacacgtgcggttaatattcaagatgtaactttttttttttattgagtaggggaaatataagaccttattattacagatctccctgccatgagatttgtgactcacccatttatgagcccccagtgaacacagccattattctctgtcatgttaagacaagaaggggcataaataaactttttttctgggctgactgaacttagtctgttgcaacaatgaagttaagatctatatctcta

SEQ ID NO: 104961 - DNA, 1087 bp, Homo sapiens
gaagggtgatctgtagttgagcaagcaggttcagttcattgaggcctctttattttcaaagcttttctccaattatcttcattgcattttggccatcaggctgctccatgttctccaaaggttctttgaactttctcccacctctgccttagatctggaagctcacaccaccttcaatgcctttccttcattttctgccagggaattctgcttatcctccaaggcttgactgcagaactctgtagagagaataaaggccttcttagagctctgtggcaatgttccttcttatataactataattatataccaatctgtactgaactgtgattaagagttgactttttctctagtttgtaatatatttagttcgttgtgcataattgtgcttattcttttgttggtaaatagtcattgaattcaataatggtaaaatgagggctggttgcatatatttgcagaggagctttcaaagtttataatctatacctgctgtgtccaacacagtagccactagccatgtgtggctattgaacacttgcaatttcactagtttgaattgtgctgtaagcgtgaaatgcacacaggttttgaagacttagtacaagaagaggaatgtaaatagtaacttttaatattgcatacgtattgaaagaataatactttggtatatattaggttaaataaaatatattatttaatgaatttcacctgcttcttttgtctttttaaacacagctactggaatacttaaatttacatatgtggcttgcattatatttctactggactgctctcatctaatgggctcttactcttaggcttctcttttttttcattccagatctgagattacagaaaatgaaaccacttttaaatgataagccttttgcacattagtcaatttgacagatttcattgtagtcattaattttacctcttctagcctcgatgccaaattcccatgaacaaaaaatgtatttgagcagccttcaaatcctattgtgttatttgcttctggtccagaggagcagggacatgttagctgcctgcccagctgctgcctgttcacactgcagggcatgtg

SEQ ID NO: 104962 - DNA, 1211 bp, Homo sapiens
tatgagaaaggttaagcttcctagaataaacaatgaggtggaggaagatcaaatgaaagtagatggagtggacagtctgctggagaagggtggaaaaaggtccagacaagttgttatcaaagagaagcttccctgtaataagaaagccagacaagaacagctatgactacactatataaatacgtagttgtctaaatgtgccaacttctcagaccctccaatgtagcccctctccaaggaggccaactacagatcccttttgaccaaaaatccttttcagctctcacctaactcaatctctgaggaagtagcgctgaactttctgttctcaacaaatacacatcaccagctaacctcttctccagctccaatcttccccgaaccccaccttccatcctccctatcccaacaaaataggtgcaccaccatcacggaaaatgactcaaagactgaactcctcatggccctcctcaaaatggcagctacctcttgctggccctgtttctgccaacaagcccatcattcattcctttagtgtcctttaccttccacacattaccagccaccagactccactgagcttcctcattctctctcagagacactgcatttccccatcctacctttcttccattggaatgtcaaacctactataataaaatagccccctagactgttctctctgctgccagggtagtcttcctaaaataccactttccttaaacaaccccatctctaccagatccagagactactcctggctctttggggatgctgaccagaattagacttgtttaacttatctctagatttaccagtctcctaattaatcccaacccatgtcaacacccaggtgaacctcactctaactgcaaagctaaactatttactatactgacaatcaattcatattaaaccaaaaagagtcattcattattaaaagaaacccttctcttaaccttttattaagaagactttttgatgcaaataggctcccttcaattatctaaaagtatgttttcttaaagagataggcctctattatttatgagtctaggagcatattattaaaaactaaaaaataaaataaaaatctataaactacaatgcacaaatctatagcagtcaacctgccacaaaactcaagatatgaagtcgctgctatgtaaaactttgatgtatcgctccctaatttaacctccctcatcaag

SEQ ID NO: 104963 - DNA, 1030 bp, Homo sapiens
gagcttggttttctgcatctctgaaccaccaacttacaagtcctgcattcatgactaggaccatagagaaccctcttgacatggtggagaatttgcttatatggaaacctaagaagttgaccctattaggaccagtcttgatgctaccagtactgattcttaaaatatacattatttgcatacattagccaccagcccatttttaacgttgggtggggaggctaaggctcaagaacatggtagtctcttaattataggtagattttgtgagaagacttcagtcctacaggagttcagaaattttctcttattaccagtgaacttaaaggattgatggtaagactgatgaaagaggaccttccacttaaaaatggggaatgtttggtttccaattgaggtcttacatatgtttctttgatcttatcataagctgctcatgtttcccacctggagaatgtgtcagaggaagaaatgaacagactcctgggaatagtattggatgtggaatatctctttacctgtgtccacaaggaagaagatgcagataccaaacaagtttatttctatctatttaaggtgagattttaacattttaaaaacattttctctcattattcaaatgtacccagtctccatatgccaggtcgtggctgtgaaggctttcagctcctggtacattttgccctcagagtttgctgaacaatacgtttcttcatgactgattctctaaaatggcccaccatagtttgaacacatcattctctttgaggcttttacacttgtatgcaaagttgagtatcttggtttgcatatgcaaatagattttttccatccacccaacaaatatttattgcacatctgttctgcatgtggcactaacgtaggcatgagggatagaacagtggacaaaacagagttcttcccctcatgcaatatatatttcagcagaagagacagtcaacaagtaaataatacctttgcaggtggtgataagtgttggccgaagagaaacaaagtaggataagtggaa

SEQ ID NO: 104964 - DNA, 1049 bp, Homo sapiens
tttaatgctcacaagaacccaatgaagtaggtattattgttgtccccattttacaggtaaggaaggaaaggctaaatagcgtaatcaaattttcaaagttatgcagctagttaagtgacacagctggaatttgatcccaggggctgtttcattccaggactcactgtatgatgctgcagaataaggtgattttaacagaattagacacaagtggtgatgtaagggtaatctaattgcattcccaagtttcactagctggcagggatattgttgcttgttattgcaggcctagtttttttctgctatagttaatagtacgagataaacataattgaatatttctgatgacctgggggtttatgggatattgatggtgcttgacttctcttgtcacaggtggctgtgttactgcaacgtgccacagttctgcgacagtctacctcggtacgaaaccacacaggtgtttgggagaacattgcttcgctcggtcttcactgttatgaggcgacaactcctggaacaagcaagacaggaaaaagataaactgcctcttgaaaaacgaactctaatcctcactcatttcccaaagtaagggagagtttttgctggtctttgtttgatcccagagcttgaggttgctaaatacaatgccaaagcctgcataaataacaagatcggaaatgacagaagaaacattccaaggggatgggagaaaagaccctcagttccctttgtgaatcttcttgggtattttccagtccatttattagcctgactttgggttgactgccgtcattgctcccttatcccctcctcgtcctacctgagtcattgtctctgactcacatagaatggggcagtgctttcttttgtatattcagcggccaggaagctctaggacgatgagggagaatgtttaggtacattttccagccactcagaaatggtgcaaaagagctcaagtggcttttttttttttttccgttcaatttctccaactttttccaagcactggtgaaccatccctgcctcagctatagtagacttgc

SEQ ID NO: 104965 - DNA, 1031 bp, Homo sapiens
acatcacaggtccacttactaataatctcacagttgaaggcatcattcccagctttttatcttgaaaaatttcaagccctcataaatgttgcagaaattctgtaataaaaatccatagactctttactgagattcagcagttaacattatgccacatttgctacctctctttctctctgcgcctccccatatgctctttttctttctctccccactccccatgaaccatttggaaccatttcagaattaaaaacacatgtcataatacttcacccctaactatttttgcatgtactgtatctcataaggaagctattctcttacataaccacaatgcagtcattactcttagaaaatttagcctggttacaatattttctaatacagggttggtgaattacagcctgcaagccaaatctgctccactggctgtttttttcaaataaagttttattgaaacatattgtttgcagctgtctttgcattacaacagtaaatttgaataattgagacagggaatgtgtggcttgcaaagtatgaaatatttattatctggcttttcactgaaaagtttgctgacctctggcctaatataaaaccgtatttaaatttcccatatagccagatgatgtcagttataacctttgttgttgttgaaggatcagttagggattgtgcattgcatttaattcttatctcttcatttgtttagtctcctttaaaacaactccccagccttgttttggtcttttgcagcactgccattggtgaagagtcttggtcgctagttttgtataaggtccctctttttggatttgttgattgtttactaaggattagattcaagtaaggcatttttggtaaaaatgctgctgtcatctcattgccttgcatctgagggcatgcaaggcaatgacatttcttaagacatacctgtcttaagacatttctgacagcttccaggaaatgaagaaatggcttggagattatattacagtgttaattttcaatttgtcatgtttctttaaata

SEQ ID NO: 104966 - DNA, 1324 bp, Homo sapiens
aggccattcatgaggggtctgccctgatgatccaacacttcccactaggccccacctccaacattggagattgcatttcagcatgagatttggaggggtcacacattcaaactacatcaggatgcagtcacatgtttgaaaatattttggatatattaatatttagtagtgtactagagctggcttgtactggaatgcacaagaaaattgttaaattttcaggagttttgtgagctggttgttccatatgttggtagcttgaagttgactagcatggcacctggttacctggatagccagttctggactaatgagatgaagtgtcaccagttagggccttccttccttgaagagctgtttgtggagcatctacttgcaaaccactaggcagattaaataagatggggagcataagtgctggcacatggttgtgcttccagctatggttgagtgtaggtcaacagatattctctggaaagaaaactgttctttaaaaagaggtgttaagaatatatacatgaggccgggcgcggtggctcagcctgtaatcccagcactttgggaggccgaggcgggcagatcacgaggtcaggagatcgagaccatcttggctaacacggtgaaaccccgtctctactaaaaaatacaaaaaattagctgggcgccgtggcaggctccagaggctgaggcaggagaatggcatgaacccgggaggcggagcttgcagtgagctgagatagcgccactgcagtctggcctgggcgaaagagcgagactccgtctcagaaaaaaaaaaaaaaaaaaagaatatatacatgagtgctactattgggcctgtaatgagaatttgaatctgtcatctcaagggtccttaaagctcagctggagaggattccttgaagccagaggttggcaaactataacccacaggccacattttgtctgcttactgtatttttaaataaagttttattggaacagtactgcacccattctttaacatattgtctgtggatgcttttgcattatagcagaagaaggagtagttgtgacaaacaccttatggctcacaacgtctaaaatattttctatctggcccttcacagaaaactttgctggcccctaatctacactgaatatcatccgtgtacacatataatactccaatttctcaaaatgctttacctgccttttctgtcttgtcttcataacttgtatgtgtatgtgtctctgtgtgtatgtgtgcacacatgtgtatttaggactctgaaaatccacaaatgtgtatcttattagaacaaagatgagaagcttggatgtgtcc

SEQ ID NO: 104967 - DNA, 1058 bp, Homo sapiens
aggatactgtacaagttcaatatgtaactcaagtgtagtcgatagcaaatgaagggatatttgaaaaatagatctcagtgttcattgttaatttacacatacacgcaaacatgtaatcacaattagtgacactgaactactggaaaggatatggttaatgtggattagaaagatgatttaggcagcttacacttcagaaagatttcttatgaccttgtccctaagggaaaacaaggactaaggaaattctttaagggaagtcatgaaattctataagggaagtcatgtaaatttatgaataaatttcagaagttattcctgtagggtttggcatgtgttggagtgtctttttgttttgttttgtttttttttgttgctaatttatcttcccagttgtctttggcttaggtcccttcctttccaggaactgtgtccatgttttattggtattgcagttggtgtcgcagtctggcgagaataaaccagactctgaattgacagaaagagctctcatctataccttgtcctgttctactttcttgcttttaagaaaagggaaccagaaaacatgtccttagaatgttattcatttagggctgggcagtggctcacacctgtaatcctagcactttgggaggccaaggtgggtggatctcctgagatcaggagtttgagaccagcctgaccaatgtggtaaaaccctgtctctactaaaaatacaaaattagcttggtgtggtggcacatgcccgtagtcccagctgcttgggaggctgaggcaggaaaattgcttgaacccgggaggcggaggttgcagtgagccaagatcacagcactgcactccagcctgggcaatgagagcgaaactccatctcaaaaaaaaaaaaaaaaaaaaaagaatgttattcatttaggattttcatgggtggactaaagattagcagctccggatgattaagatggctgctgagaaaaattattggaaggtctaaagcaatgtgtccaatagaaatataaagcagcctgcaaatatgaggttataaaagcacacatattatg

SEQ ID NO: 104968 - DNA, 1269 bp, Homo sapiens
atttacttttatctctctttatgaggttccaaaacaatcacattagatttacacgttttctgtaagctttgtcactgaaaaaacttgatattataaaaatatttcaatgactgagtttattcaacattgttgactacctttagttactttctaatgtcttctggctgattcagagattctgggcttctcagaccttacttggaaaggtctgataagaccaaatttaaaatgctatgtatgtgatgattcagttctttagaagggttgccagtttgtggtgtacagtaaacacttggattactaaatattctagtgaagattagcacttttcatttgcatcttttttttttcttctgagattctcaaataccttaaagataagcagaaattcataatctacattcattctgaaaacttttatattactattcagcaagtgatctttaagattgagctaggaacttgtggccctggtgtgttattttcaaataactagaaacttacattttcaaatgatgatttttatctttgaagcaaggattttgattttgttttggttttatagcttattttcaaagttaagaaacgcaagaaagggtgttaatatatttcattcaggaaaggtcctggttggtaaaatatgtaaaagtacaaacttctgaattcaccatcatttcctgatggatttgtaaaaatttttctccccagtctaatgtatttgtttgtatactaacttccacacagggctatggaacacacctgatgaatcatttgaaagaatatcacataaagcatgacatcctgaacttcctcacatatgcagatgaatatgcaattggatactttaagaaacaggttggtttctcaccacgcaacactgttttgtcactccttttcttaatatgttctcaggtagcgttcttccaaataagtttctcccccagtgttttctacttataagaacaggcatttgttttacaagccttatgtcaaaaataagcttcagcctggattagagagtgtcactagcacatagtaagtattgaataactatttgttgagagaatgaatgaatgtcacctgtcagtgaggtataatattgcatcctaacattctaaaatatggtttctaataagaaattcccagtcctggaatttggtgggtagcattctctgtgaatgagaaaaacagattcagtttctggaaggcctccatttatgacagcagaaaggaaatcctggagtttataaaaacctgcaaacagtcctg

SEQ ID NO: 104969 - DNA, 1077 bp, Homo sapiens
tacccatctttgttttctggtttctactaacctccttaatcccagttcttagttttttgttaggcattatctacctaacagccctaaagctttttacacagtgtctggtgcatagtagttactcattaagtatttttcttttacttaaagtggctcagtcttgttcttgtgtttcctggggaagtgagcaaaggcttttttttttttttggaaaatacaaacaacttttgttgctttttgttcaaagatgtcagcctaagagagaattccaagtaggcacttggaagagttaataaagcacagcgggctcctctctctccctgtctctctgaagagctggctttcctcattgttctctctggagcttaatgagcaggtctggattcagcagcacatcgttccgcattagaggctgctggccaactaaagccatcaccccgctgtcagctgctctttcctcattcctcctcccagcagcactaattcatccccacggtgttagctgagagcaggattcccttggcagagtctgcaaattcacattgtacatgatctgttggcccttcaaacctacaggggaacgccagaagcgcagagctattttagatggctaacaaagcagtcaactttttagaagccaaggctccctccccattcttttttctcctctcctccccctctgcctccagccttccctcacacattccgttgaatgggtgatggaggtttggagatcttaacctagtttttaaaaaagctatctgaagtcacttcaataaaaatatatttggattcatgtagtatttttttccacagaattcagttgattttttataagtattatttgttccaactgtgaaaaacccctcaaggaaggtagggattcatggtggcagcaaagaaacagtgaatattctgaggcatttcctagcccctaaaagtatacaggagcagaataagttgtagttgtcattagtagagagagagagagaaaactagtatagttggacaggtggaccaagagtggagagttaagtgctactttgtgagtgttgactccaagggaaaggtaggatc

SEQ ID NO: 104970 - DNA, 1081 bp, Homo sapiens
ggatgttaatggaagtgatttttttttttccccaccaagcaacttaaagaaaaacggcaaactaattgtaatcactaacacaacagttggtgggttttgagtttcctaaaacattctggaatggttccaatttcaggtttttgtaagaatgagctgaatagtaatcagctggcaatagggtaaaactctaatcattgctccttgtttccctttttcctttcaagtaaagagcccagagaccctgaccagctttacagcacgctcaagagcatcctccagcaggtgaaggtgggtgtcctctttattcacctcatgcaaatattttgaaatgatttcccacatggaatttccatattagataccttacttttttctttacccaagagccatcaaagcgcttggcccttcatggaacctgtgaagagaacagaagctccaggatattatgaagttataaggttccccatgggtaataccattaacattttctaagtatagatttaaaactctggatggcggtgtgggggacaaatggttgctgaggttgatttgtactcctctgcttagggtaggaagtgtatgacgggtggtgggattccatgcaccgtggcgggtcagtgatggcagagaagtgggtggctgtgttcattagagacattctgcagctgtcgtttagagcccacatgagcttaacgacactagacgcagaaaatccacggtaactgcagacagcactagatttgaaagctggcactttagatataactttgcttatattctaactctttggtgcaaatagaaaaacatcagcttatcctcttgatatgctttgcgtctgtcgtaaataggtattcctttgaataattattcaggataataatgaaagaagttagattaaagtacttgactgctgtactttcagagggagaaattctacttaccacaattcttgattttccatgcccttgatgggtactgttaatgtcactgtatatactctttattttacgctttgtctcatatccaaaatcaaacaaaaaaggatgtcttcagaaatgtagaattgtgcagtttggtgctg

SEQ ID NO: 104971 - DNA, 1097 bp, Homo sapiens
tatgatattacacatttgtgtagagaaaataattattaaaatagtggttatgtactaacaagtttgttgtaagtagacagaattatcaaaaacctagatgcttattttaaaagtttgcattatttagaatttcttccttaggaaccaaagcagttgctttcctggaactgcatttttcagaactgctcaaagcacctcatctagatgagtgttttaaaaaatatatataaaaagtctataaagagacttcaaacatcacatatttcacctcttacaggcttttttaaaatcatgtatcccttccttaaagtccttcagaataaaataaaagtaaactctcacattccattagaaaaaaatggaaacattcattcatggtctgaaaatgttatggatttccccaaattttgctactgtgtgcaatttcctcacacacaggttttgaggaaacccctaatcatctatcatgaaatagctaatggacatgccatagaaaatttaccttaatagtagtaaatagattaaaatctattccataaaataaaaatgtcctatgacttcaatttaaatacatatctgaaaagctaaaaggaggttttttgttttttcaaaagtgctaattattacatttacaagtctcttcaatacatcatgtccaattctttgtaaaaaactaaaccaccttgctttaggcacactgcttggtgagtttctaagaagcagaggggaaaaaaaatcacttgtcaattaatccagcttccttaattttactgaagaagaatttctccaggatattggcacatttgtagtattcactctcaggggggttgtactctttgcaattggtaaagactcgctgtaagtctgccatgaataatttcttagacacgtagtacctattcttgaggcgttcactcatggttttcagatctgcacaggaaaaaaaaatattagcaatctttgactccctttaaacaccagctgacaaaactgggactgggaaaggaatctatgttgttggtttgattacatttttatcatcccaatgcttttatttaagagaaattcttatgaccaaggaaaacagttcttaaatc

SEQ ID NO: 104972 - DNA, 1052 bp, Homo sapiens
ggtttttgataattctgtctacttacaacaaacttgttagtacataaccactattttaataattattttctctacacaaatgtgtaatatcatatttgactttgcttatgcaggccataagttccaaaagataatttccctgcccacaaaggcataaacttgaaaacacatgagattgaatcaacatgctttaataggaaaagatgtatggtctatatatgtatcaatctggtgaatcctcgttctaataaaggttctttttcttttctatgatacacacagccacgctgataatatgcaaatgaacattttcctttatgtctctccagataatgtttattgtctgaggtaaattaaattcccaccagggtttgctgtcagtattttaacacccacattagtatatgcgtccagggtcataaccccctaaaatccatcatgcaaccttattaatctgtcttgggattccagtttagtgcttggatttatttcctgattacactacatagaaaagtgagacatctgccattcccaactctgggaaaaccaactaatatacaaccatataaatgaaggccatcttgatggtctcaacactaatttttatgatgcaaatttatacactgatttttgtaaaggacaaagttttaaaagcgtatttaacttgatgttttctatcagcataaataaaatggtcatgaatagtcattaaaaacagttgccagtgataatctgcatgaaggaaaaagaaccctgcaaatggctattgagttggaagtattgtttttgatatgtaagagatattcagaatgctcacactgaaaatgcctcaactttttaaagtgtaagaaaccaccatgagtggtgtctagatttctaatgaagaatcatgatacagtttggattaagtatcttggactggttttaaacagtgctttgtaccggatctgctgaagcatctgtccagctggtatcctgtgaaagtttgttattttctgagtagacattcttatagagtattgtctttaaaatcagattgtctcttctatatt

SEQ ID NO: 104973 - DNA, 2291 bp, Homo sapiens
agtttttgtgtgggtttttttttttaaatcatattcagtaaaaattgttttgtagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgtaagtatttggtttgtgggaacttatttttaatgatacatgtcggggggaataaggttatggagctttgttcaagaatgagttttttctgaaatataaacatttgatttaaaaaaactgaagtgagaacatttaaaattggtgtgttttaccataacttggtagggaagagtaagttaatattgggatgcttacattatgcctgagatctctttttactcttacaggaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaataactgagcttaagcattatcatcatatcgatttcttatgctgcctaaacctcttaattttagtcgaaatatatctttttttttttttggaggcggaatttcattcttgttgcccaggctggagtgcaatggcacgatctcagcttaccgcaacctccgcctcccaggttcaagcgattctcctgcctcagactcccgagtagctgggactacaggcatgtgccactacgcccggctaattttgtatttttagtagagacagggtttctccatgttggtcaggttgctctcaaactcccaacctcaggtgatctgcccacctcggcctcccaaagtgctgggattactgagccactgtgcccagcccaaaatgtatcttatacaaacattgtagaaatgaataatgattactcaaataagatcttttaattataagcttctggcatctctatttttcccttaagtaggggatactaaagtgaatgattttctaagaggatcttttgaaactctttagtacaatatttgagtaaaataaattattgtggatcttttgaaactctgtgtagtattcgagtaaaataaatatttgacatttacagtagggtacaccctaagttgtttatgaattccttataccactgttatatttaatttttcagataaaatatgtatgggaaaatgactagagaaattgattcttttttaggctcagggacaagataagtgactaattgtgaaccccaagctctaattgtatgttcagagtgatgtctccataaaattacaaatgtcatgtactttcagggtagctccttatttagtcagaaatctcagagattaaatgtgtgaatatttagggtttttgcatatttttgaccaaccaatgaaagcgaattagttcagtttagaaagtttgatgtctatacttgtatatacctctttaaattttagaactttgtaggttattcatttttaaagagcaataaagtttgtataagatagtgattgctttccttctattctttaaatatcaaaaatagagtatctctctgtcttcactattctcatccttggacatttcctctcccctccccttggtattctcttttttgaggggggggtgttctaggtgagttaatccttagtattttcagtagtcattgctataaaactctcagcttcccctccatactttcaacctaacacttctctctcccaacttatctctgtgtaatctcccagttcatgattaacaaattataattttattgagggactgttctaatcctgatatctcagattttcttggctgttatctccctatctttctgtattctatgtcagtcagagccaaaatccttttcatcatcccaaatttttctatccgccacatcactgattcatacaccctagtcttccatcacagtctcttaatttttaagttttttttttcttactactcccttcatacttattctttaatttcat

SEQ ID NO: 104974 - DNA, 1047 bp, Homo sapiens
ccggcacataccaccaggcctggctcatttttttgtatttttagtagagatggggtttcaccatgttggccaggctggtcttggactcctgacctcaggtgatccgcccacctcagcctcccaaagtgctgggattacaggcgtgagccaacccgcccggcttacagcatatttttaaaaaagatacttgcctgctaccactgactaactggccgatttagaaagttggtttggtttttaaggttttaatctccttacaaacaaaataagcatcataacacctatacttcacagaattgttctgaggatcaaataaaatgatgtgacaatattttgaaaatgatacaacttgactataaatgttagttttacttgtattaactaaaattgccaaatgagaatctttgtggacaggtgtaggttgtattacgaacatttgaactatgcctacttttgatctaataaaatattttctgagccagtttttagagatgtcgtacaaaagaatactaagcctatcaattgaggaaatcttcactaactagaagattattttaaatcacggttcctgtcaaatttaatataaaacaaggccattaaaataacaagtcactggattcaaatttgatttcactttcaaggggatacttcagttaagtgtataaaagctacttcaattcaacctaagtctacaaaaaagtccctctgtccccttgggagtcctaatttactgaaaataaaaattctgtctccataacaagcaatctctgaattaggtcagagcaatacaactgtgatttccacacccagccccccactgtttaatcagaccataacttccaccaaagagagacagatggtaagtctccaacctccaccagagaaacagatggtaagtatagtatataagcatcaggagtgatcatttatcacgaacattaaaaatacaggtaaacaagtagatcacttactggtaggagtttttgttggcttagaaccctccgtctctttttcatctgtgtatttcagtgctcttttagctagagg

SEQ ID NO: 104975 - DNA, 1840 bp, Homo sapiens
ctcctgcctcagtctcccgagtagttgggactacaggcacccaccaccacgcctggctaattttttgtattttttttagtagagacggggtttcactgtgttagccaggatggtctcgatctcctgacctcgtgatctgcccgcctcggcctcccaaagtgctgggattacaagcgtaagccaccgtgcctggcctataatgtttttaaagattataaagattgaatgtcccttatccaaaatgcttgggaccagaagtgttttggatttattttttaaattttggagtatttacattatatcagttcatcatccctaatttgaaaatctgaaatccaaaaccctccagttagcatttccttggagcatcatgactgcactaaaaaagttttggatttcagattttcagattagggatactgaacctgtacaagattctttcacatgtcagatataagccatcagttgatcactgacaagtaaatagatggtaatatttaagttcccaggtttttatttacagattttataatgtaggaaaactacagaatgaccttttggtcattcacttttttagtttgaattctaaagttcttgaaattcaaatttccacaaagtaaaactacttttctcatttattttttaaattctcagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccagtaagtgatctacttgtttacctgtatttttaatgttcgtgataaatgatcactcctgatgcttatatactatacttaccatctgtttctctggtggaggttggagacttaccatctgtctctctttggtggaagttatggtctgattaaacagtggggggctgggtgtggaaatcacagttgtattgctctgacctaattcagagattgcttgttatggagacagaatttttattttcagtaaattaggactcccaaggggacagagggacttttttgtagacttaggttgaattgaagtagcttttatacacttaactgaagtatccccttgaaagtgaaatcaaatttgaatccagtgacttgttattttaatggc

SEQ ID NO: 104976 - DNA, 1049 bp, Homo sapiens
attctgaatgtacttgcaagtgggcaaatagaggtcatcggaatcatctcctgaaccacttgattcacagaggctcacttcagactcgttgttttcttctctattagagtcattgctcactttttgtcggaaaggagtaagatgaacaccctcttccaaattaaaattgtaagcatcattggaactgacagatttgtgcatttttttttggggaacagtttttttattttcgcttttattctctttatattttgacatacgttttgattttctcctgttagcttttcttttctcttctctttttctttcttgtgtatctctttgcttacttttagtttgttcagatttagattctaaaatgtcttcttttgttttagtaaacgttcctggctgaatcagctttggtgataagttaacttggtccttgctccattgacaagcattgtgttgtacattttcaggtatgtgcatgtttactagtgggtctaaaaatccaactctttcgaattcaaaagacttccctgccaaatgactggtttcaaaatcatccaagctatcaaactgacatatactgttacaatgtttctttaaactgctacgaacagatacagttctaggtaagacattatcagtagacttagcttcacctgaatcaaaatcaactcccagtgtgtcttgaggaatagtaggtatctgatctgagaatttaaaaaataaatgagaaaagtagttttactttgtggaaatttgaatttcaagaactttagaattcaaactaaaaaagtgaatgaccaaaaggtcattctgtagttttcctacattataaaatctgtaaataaaaacctgggaacttaaatattaccatctatttacttgtcagtgatcaactgatggcttatatctgacatgtgaaagaatcttgtacaggttcagtatccctaatctgaaaatctgaaatccaaaacttttttagtgcagtcatgatgctccaaggaaatgctaactggagggttttggatttcagattttcaaattagggatgatgaact

SEQ ID NO: 104977 - DNA, 1079 bp, Homo sapiens
agatctgttgtgggcaaaaggtaagataaggtaattgaatttgtagaagatttctaaagtagttattatttaccacagccattacttacctaaatctgtttaatgtctagagtagaaaattctctacagagaataaagaataaaattacaattagaatgaaactgccagtaatagtgttagagtataaagaacacttcatgtttcatgaaccaaagaacaacatttgtaaagaaaatgaacaatgttaacttcagaagagttcaatagttaagcaccataaaagcatatattaccaacaaatcacagctctgctaatgataaagcaggctcctaaagagttgagtgatcaaactacattttttaaaaaacatttaacaaattaattctcatgggctgtttccgtagttaaattgagttatataatgtgttttcaggtggaactctccaacttgataggttggttcttcaagtgggaattgaatgtcagtcataacaaatcagtctccctgtaatcagcataagtgtcctttggtttcctttgatacagaatagatgtattgatttgaaatcgaattatgaaatgatactaaaggaaagaaaaattataatttaggaaaatactgaatttgtttttattacataattgttaaatttctgtttttcattggtattttctaaggcaaattcctcttgaagaaactgaacttccaggacaaggagaatcatttcaaatagaaggtaattcaagtgaaaatctaaaaatattattaagggcaaaataaggtctttgagaacaaataatacaattaaatttatctaattctttttttttaactttttaaatttgttcatctggtattctgctcaaagcaaatctgtttattttacacagagtaatagagtgttaaaatatatttattgtgtcaaatctgtaatctgaatctttggctataactatggcagcaatttactgattgctactacgtgtcaagctctatgttaggcattttatgtgcataatctcacctaaccctcacaacaacctaggactataagtacagttagtcctgttttatag

SEQ ID NO: 104978 - DNA, 1038 bp, Homo sapiens
acttccccttgtctcccccacagatgctgtatacttcctaccttcctttataagtcttactcagtaaagtagcctacatgtttgcttaggccaaaaccacaagaggctttcctctccctcattgttcccatctccatcccttttcagtccttgagcttgacctgtcatctcaaggccttccactgggcttcacctccatagccatgactctaatcttagctgatatcatatcttgccagatatgcaatgatgacctctcagctctttctacccccggcctctttcaattcagactgatctttcaaaaacttaaatcagtttacttcctttcttaatattaagtaccttcccatcatacttagactaaaatctaaactcatggctctcaaggccctacattatgtggcccctgcatgtacatctcctactgttctcagtgactatgttccagccacaacaacctttctttcctaaacacagcaagatttttcttatgtgtatttgctgtttccactgccttcttttcctcctgttctttcagtggctagctcctttgcagtcttctgatttatatcacattcactgtatttaaaagagcaatccaacctgagttactctctatcacctcacactgggtatttccttcatgacatttatcgcaatctgaaattttgtacatatatcttctctttttaaaattttacttccctgcactagaatgtaagctttaaaaggataagacttactctgcttttgagctgttatagtctcagttcctagaaccatggcatggcaccatgatagactgtcaacaagtgcatattgttgaataaattaatgctttcttgtgaatacttcagttataacagtgttttgttttaatacattaacagaaccaggaaatatgttcctctggaatggaccccaatagtgatgacagctccagaaatttatttgtgaaggatttaccgttagtatcaaattctttatcatgattattaatactaagaaaggtttaattctgtgattcatttatga

SEQ ID NO: 104979 - DNA, 1684 bp, Homo sapiens
tagtaaatcaataaacattgattgggtccctgttgtaccaaatatctataatcatcactgctattaacacctattgactacatactctgtgtggaaccttgtgctgtctacttttaaaaatacaatgaagcagtaagtatagtaggaaattccttatctgatgtgatcaggatcagaaggtgagtaaaatttaaagcaaagaatatataactgaagcatttttatgtttaacttgatacatatgagtgtacattcattcaccaatttctaaatgtagggcaaagatcttccttgcagtatgggtgtttatcatcacttattttgaaaacccatgatgcctaatctacctggagcacacagtattgattgcctgtctagaagctactccccctcttctacgttcccaagagcttcttttttttttttaataaaaaaattgtatttacttagaagcattcagaatgtcaacaaaacagctgcaactttttttttttgcaattacagagtggtattcagttaacagaacaacaattatttcgtataagctgcatcagagacaactgaagatgaaaaaactaccatccccatatataactaatttgtgctgtgcaccaacaagaacctgctttaaatttccatgccaatttacaacccccatactgtaccaggcaaagttagtggctattgaaaataccaccaggacagggctatctaaagacacattcggtagtgtgttaactatacaaaaaaagacactgtacagtttaaaaacaaatcttacaccgccttacatttcaatttttttctttaaaaagagtgaattgtgtacaggggggttaaatgctttatagacaagaaaaaaaactgcgctacaaccaacttattcatcatcatcatcttcttcttcatcttcttcatcttcctcctcctcctcatcctcttcatcttcctcatcttcctcctcttccttctttttcttgcttttttcagccttgacaactcccttttttgctgcatcaggctttcctttagctcgatatgcagcaatatccttttcgtatttttccttcagcttcgcagccttcttttcataaggctgcttgtcatctgcagcagtgttattccacatctctcccagtttcttcgcaacatcaccaatggacaggccaggatgttctcctttgatttttgggcgatactcagagcagaagaggaagaaggccgaaggaagcctcttgggtgcattgggatccttgaacttcttttttgtctcccctttgggagggatataggttttcatttctctttcataacgggccttgtccgcctttgccatatcttcaaattttcctttctctttagcagacatggtcttccacctctctgagcacttcttagaaaactctgagaagttgactgaagcatctgggtgcttcttcttatgctcctcccgacaagtttgcacaaaaaatgcatatgatgacattttgcctctcggcttcttaggatctcctttgcccatgtttagttatttttcctcagcgaggcacagagtcgcccagtgcccgtccggctctcacttgccccggcgctgtctctatggagctcaatgtactgccaagagcttcttttacactggtgcatttccctttcccaagtgaattgggtgattctctggcttacc

SEQ ID NO: 104980 - DNA, 1633 bp, Homo sapiens
cattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaggcggacaaggcccgttatgaaagagaaatgaaaacctatatccctcccaaaggggagacaaaaaagaagttcaaggatcccaatgcacccaagaggcttccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagaagaagatgatgatgatgaataagttggttgtagcgcagttttttttcttgtctataaagcatttaacccccctgtacacaattcactctttttaaagaaaaaaattgaaatgtaaggcggtgtaagatttgtttttaaactgtacagtgtctttttttgtatagttaacacactaccgaatgtgtctttagatagccctgtcctggtggtattttcaatagccactaactttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaagttgcagctgttttgttgacattctgaatgcttctaagtaaatacaatttttttattaaaaaaaaaaaagaagctcttgggaacgtagaagagggggagtagcttctagacaggcaatcaatactgtgtgctccaggtagattaggcatcatgggttttcaaaataagtgatgataaacacccatactgcaaggaagatctttgccctacatttagaaattggtgaatgaatgtacactcatatgtatcaagttaaacataaaaatgcttcagttatatattctttgctttaaattttactcaccttctgatcctgatcacatcagataaggaatttcctactatacttactgcttcattgtatttttaaaagtagacagcacaaggttccacacagagtatgtagtcaataggtgttaatagcagtgatgattatagatatttggtacaacagggacccaatcaatgtttattgatttactatacataggggttaagagaaga

SEQ ID NO: 104981 - DNA, 1025 bp, Homo sapiens
tctcttgcatttaatcattttttctgggatgtcggccgtgaacttcatggatttttcttttcccttcaagatgatctcgtttacatggttttaaccatagggaacttcagtatttaaagtcagttaaatggcaaggcaaattcataacatacatttccatagtgtgtttgtgtgtttatgtattatcagggaaacatatacagggtgtgtatgtaaaattgcagtagtttcatttatggttacttgaccataaatattttttttctgttcagtaacacagaatagagattaggaatctttgaagtagttactgagtgagtgacagtttattttccactactcccagttggtaaagtcagaaatgctgacattagcaacaggtgcatcttggtttcattacattagtcagtggatccatcttgatacggattttctctttctctagagaatagatggatctggaaagtaggtatttgaatgattttctgttggtactcaatctcttaaaatgattggcatgtcactggacttaaagggaatctgtttgatattgttacattatagaatatctcttggaaaataatttgaaagataaattaaatgtagtgtctttcctgatcctgtgattttatgttcttgctttgttttcatatattttacattgaccaagtcggaagtatacataaaagcgatctgtaacttgtaggcatagtggaatgcctgaatgttgtattacagctttatatgttattttatggtgtgggttaaggggaactcctttctcaaagataaaaaaccattattttgttctagtagaccttgttttcctttggcttagtcagtctacagggttggaaagaaccttctcaggacccttggtgagagatgttggagggatggtgagtggttattccaaggtactagagtattcagtttccctttcgtgggggtgtattgctgatctctgttgaaggagctgtttgaaagtcagagagccctgaactttaaactttgagacctgtata

SEQ ID NO: 104982 - DNA, 1403 bp, Homo sapiens
aagttgtctagatgagatgaagggttttaaaaaaattcctgctaagaaattactttgcgaatctgcgtatccacacattcatgttctacttggctctcagtaaatttttgaattttctttaactcaagaaatgtatgtgtgtgttttaaacatgttagtacatatacactgcttcatttttctgaacccttagcccaatatattgatgttaaaatgagtgtttcgtatcttctctgttctgtataattttggtaccatattcttcatttaagtctgagtgaatcatgattgttatgattcccctcctctgctattttttttaaagcaaataacagtcccacacagcattcttattgtagtcttatcattcattcctggaacggttaaggtataaggtggagtaatatacattgaaatttaattgtgtattgctccttgacttgtctcaggaacaatgggcagttgctgacttctgtatcatactaacctaagaggtggcactgccttatgaaaattggaaatttaggtgattgttcaggtgatttttgtgtaaaataattttgtcttaaaagttctgatgagggaagtcttcttgtttgacttagcaagataatagttctccatctttcaccttaccagcgtaaaataattagccttagttttccttgccttttaaatggggactgataaaacagatacttagagaattctgtgagatttacctaatcacttttaacggtaaaagatcatcatgggaaaggtagactgtaagtgtgaattattgatacttttcatttttcctcaccctaagagacagtgcctgaaataggtacctttcttatcccacttgtcaaggctgagaaacttaatacataccataatcacaacttttgagatagaattgaattgctgtcattcaaaacagcaggacatcttacaaccgtttaaatagcaattcttagtataatcttttctgtcaagagacatacaaccattttaggtaacagtagctcaaaatataatattattgactcactgctcagacttcttgaattcatcagtaaattgctttttgtattgaataatatagacctagaattatagggatctggagttcaaattttatatagaattatatgacagaaaattatgatttatcagttttttttcccttagagacagggtcttactcttgcacaggctggagtatgtggtatgatcatagatcactgtggcctcaaattcctgggctcaagtgatcctcctgccttggcctcctgagtaactgggactataagcacacaccgctatgaccaacagtttcctgaattttttgtagaggagtctcactgtgttgtgcaggttggtctcgaatttctggcctcaagtgatcctcctgcgtc

SEQ ID NO: 104983 - DNA, 1157 bp, Homo sapiens
tcttcaccgggaaagtaataagtaaataaagactatttagtggcattgagatttcaagagtaatttcttcagtaattttgcaagattattcatattacctactcaaccagactccataattgggctcaggagggaaggctttcccttagagaagcagagttctgttcgtctgaatgttgtccagtcaggctttgggacttaaaaatgcttttgaggattcttaggtccttttttttttttttttggcctgtggactgaacatagctgttcagtgtgtatcattatttattgcctttctcttactatagattatttctcacaggagaagaagttattgctggtagcatgtcagtttacatgtgtctagctcccatctctggaacacataattaagtgtggtcgacatatattcttcttcatttttgccgttgagaaagctgtcagaaatgttacatctggagaacaggaaagactaccctcaaagccagcgttggcctaagtgtactcttaaacatttcctgtggatgtgtggaccgcctgtctctctatctcttcatgacttctgcctgtgtcttgtgtgtgcagaggccaaatagtagtagcagagatggaaaaccttctcctacacatgtgcaccagcatggtcctttgtctctctctttcatttgctcttcaaggcttcgctcaaatactgcttccattctgtaattttctcttcccagcgcacccgtgggacctgttacattgagttagaggcagtattacacggtggtttcttttggagagactggctagactacgtatacatagcctcttggttagttacataccttctcagtgcctcagttccttcatctgtaaaaccacatggggttgtgtgaggattatatgagttaatacatgtaaagcactcagagtagtgcctggcatataagggctcaaaaattgttagttgttgatgctgttgttgctgtttataaggcttgcgtgcatttcttttcttcatttgttttgggaatggtgaaggcatataatgtattattcattatcttcttaatatgtttcatgtaatagacaaatatttttatgtagttactaaggcagataacttctgcatgtcttatttttctctaaaatggtaagcatacatataagta

SEQ ID NO: 104984 - DNA, 1053 bp, Homo sapiens
tatttgcatattcataatgagcgatcttcaggatgtggcctaagtctaaacatgaaatgcatttatgtttcttacacaccttatacacatagcctgaaggtagttttatttctcccatggggacgctgaataaactgtgtattgtgtgcctgcgatctgactgggacctgccacatggggttaggtgtggagtttcccacttgtggcatcatgtcagtgctgaaagtttttgattttggagcatttcagatttcagcttttcagattaggaatgttcaacctctagccggagaaagaagatagttttctataagatggaaaatttatccagtcatgcctttttggaacatgcgtgaatttgttgagtaactgaaatgtataccttcaggttcctaaatttaatttatgtgagataaaatttgtttctaagtagttttatatttccctcttctttgaaacagtatgagtttaacattttcttattagtttaggacctcattctcaacctcagttatgataccgtaatatagtgatcaattatggaactactaagttatcgaggtaataggactcttgtctcatgccctaagaaggacttcaggctgcccatttaaaaaaattgagatataatttaaataccatacaattcactcttttaaattatgcaattcagtagtttctagtgtactcacaacgttgtgcaactgtcactgtcattacttccaaaacattttcatcatcctagaaaggaaccccacatccattagcattctccattcccccctcccccccagcttctggcaaccacgaatcgactttctgtctctatggatttgtctattctgggcattttgtataaatggaatcatacaaggtgtggccttttatatctggtgtctttcacttaacataattaaagcatttagttttataataaaaaaggctaggcaaataattgagtggaggttgggaggtttaagagattccattaaagaagaaggtgaaataagggggagagatgagatcagatgaagttcagatttagcaaacatt

SEQ ID NO: 104985 - DNA, 1091 bp, Homo sapiens
catattccttacctgtggtttaagggttaaatataaaagaaaataaaactaggagaaaacagatttggaggctgacttctagaaatgttagaagaaattataaagaaaataataatcgatttgactagataaaattacacactaaaatgcttttaaaaagtatgtctttggtgaagagggaggaaaagaaaatactccacaaaaagcaaacaacaaactggaaaaatgtattcacagtgagacaggcagagaatgacaaaccagtaaaaatacccatgatgactgtgataggtaaatgggcatagtacacaaactgttcacaaaggaggaaatatggttagtaaacaggcatgtgggatatgtgttcagccttgttagtaatctaggaaatgagacttaaaacaagaaattgtacatagtgctgctgaaactactaccattgctactggactgtgaaaggtataattctaaattgaaagcacattggtactgtgcttcagtagcaacaaaaatgttagttcataatctttaattcagtaatttcatataaggggctctagcttatggaaaatgataaaaaatatggactgttacctgtaacaatgaaaatgtggaagtgaacaatattatgtgaagagaaatagctgagtaaattaggattagtccattcattggatggttatatatccaataaaaataaataggcaaggtatatagtagtatgaaaagatgcatatgaaaggactagattatatgtaaattgtgattatgagtttataaagtataaatatgaaaaatccctagaaaaagataatttataatccttgtgctacagtaatgagttgcaggtgatctttcttctgacctctctcaaatagggtatattaattttaaaatttaaatttagatttgtgattttaagaaaatttagttctagctctcaaggaactgccagtctaataggatagaactacactaaaaagaaatgtgctattgacatgaaagagacataaccacatgttctgagagtaccctcaaatatagttttgtattttatggagtgcttataaagtctccaggcatatatctgg

SEQ ID NO: 104986 - DNA, 1035 bp, Homo sapiens
atatcagttttgttaataacaacgacagtaaaatgagctgtctacccaaaatttagattattatgttgattataacaaacatctttattttggtaatgagcttataaaaatgaatctaggtcgggtgtggtggctcacgcctataatcccaccacgttgggaggccgaggcgggcagatcacgagctcaggagatggagaccatcctggctaacatggtaaaaccttgtctctactaaaaatacaaaaaattagccgggcgtggtggcgggcgcctgtagtcccagctactcgggaggctgaggcaggagaatggcgtgaacccgggaggcggagcttgcattgagctgagattgttccactgcactccagcctgggtgacagagagagactctgtctcaaaaaaagaaaaaaaaaaaaaaaaaaaaaaaagattctaaccccaggaaaggagaaggtatttgtcataattgtcataatgttttgacttatacaaaataagactttttctgaaacacagaaatccttgacagtttatttctttaagataaccaattttatacaggtgaattcttttaaaattgaacattgtagtggaaaagacgtcacaagtcactttagggtatggaaaagtgtggaacaggggcataaatattaccaaccagcacttctgcgggcagtcttcccacatccagtgaggccccctaaatcactgtctacttccttgtatatgtgtgtgtgcgtttgtgcacatgcatgcatacatgtgttcatggccatgaactaggagttatcccaagtgtagctgtgctcgctaagtcttatatttaagttatcttttgggcatggtttggcaagaggttaggtttttttcccttttctgtaaatatttagtgaaagcactccattgtttgctactgaatttttttcttatttttaaaaaagtattgtttgaaaaccttacatgatggcttgcatctgtaattccagctacttaggagattgaggcaggaagatcactatggcacacatatac

SEQ ID NO: 104987 - DNA, 1103 bp, Homo sapiens
ctgaaataacagaaatcctcactactgcttttatttagaagcattttcagacaaggaaggatgtacaatttatttttattgtcaggtataaattttccatgtttaattcagctttagaagtcatatgataatgtttgaattgagaaacattactcttaggtaataagaatgcatttaaatatatcctataaaatagacacgttatgcatgagtgaggggtgcattttcagtgacaagtataacacttgaaatctgaagaattgttggtcttccatacagcgtacttggaatgaaacaaaggtttacaacaagttactacaagaggtagaaatagaactagggaacaatttgtttcatctactcaagtctgttgaagtataataattaacttctgaccattcttggccttttaagttctcagggctctcctcataggaattataccgttaaccctgctctcctgggcaaatttcaaccaatgtaattatattcttagtcttacctgaattctctccatagagtgtaattatctgagctggattcttcccagggcactgggctttagcacagctactactctccctatctttagtccacgactgttgggtaatttcatttctgctcttgaacagttagctactatcctgcctgaagaattggcattttatgttgagtagtgtacatttgatttcactgtttaccttgtataagattaaaactaaccttagcaggccacttttgaccgtgggcaggtcaaagacgtaagtgtggtgaaattatagcagaaggggtaaatattttcaaataaagatcgtggaatcaaaaacatagagaccttttaagttttgatgtcaaaaaccactgtttttttccacattattaaaattagcagttaagtttttttcatctccaggctttatactcttaaaaattactggattatatctgtgaatatttgttgtgttagaacagatttagtatacttttaaaatttgtttaaaatattactaaactcatgttaatgtaaatatattatgaaaaatatattttgaaaaatcttgaaaagagtggccttgtttacagttttgccagtctcttaatgt

SEQ ID NO: 104988 - DNA, 1051 bp, Homo sapiens
aaaccttgtttcaaaaaaaataatatatatatatacacatacacacactaagtgaggtggtgtgtgcttgtagtcctagctgcttggaaggctgagatgggaggattgtgcccaggtgacagagcgagacccagtctgtattaaaaaaaaaaaaaattaaatgttgtatacttagcacataagtgatcattaaatgtttgatgaatgaattaatgaggaaagattttttttttgaaaaagaagttttatgaggagagaaaacattgcatatgtaaggcattatcctcaattccattgtggactctcccccaggtgtgcagccttgaatgatggaaatatcctcatgagattctgaaagaggaggaaacgaattttgcccttaaataggtgtcagtacagctgcacttatttgcacatttctagttctgcctctgactagagatcaattgtgatgactttgaatttgtagaccatctgcctgtcagtgcacttaaaattgcaactgatctttataagctgagtataactattattgtagcaaacagcaaattaagtgactatacactggaaagagttaggttcatacctccttgaagactgtgagctgttctttatttggacacctggtattaaactcttattggttattaatatttgggacaggttaatgaagacaatattttacagaatatagcagttttcaatataatagattcaatacaacaactttttgtgtgtttataattttgttacttattatttaccataagtggtttaaaatatacgtggcaaaacattctttagagctttgattgcaataattatcacataaccaacacctcttaagtattacgtacttaagaaggaacttgaactttatcttaacacaatagcattgacaaattactcacaaaattagtagttgtggaagaaaataggtataggaagagtaagtcactgatattgagtaaattaaagttatagacattaaattacagacaataaaattatagaagcactaaatagataaattgatttttttaatgtcatg

SEQ ID NO: 104989 - DNA, 2232 bp, Homo sapiens
agtgctgggattacaggcgtgagccaccgcgcccgaccccaatcttatatttggttttatttctcccatttgtctctctaaatcccttagttgataagttaattacactatctttgtttgaaaagaatataaacttagaacaagactagaacattatgaaacaacttccacgtaatgtcacaccaggacaagttattatcaagtgatcttacgtgatagtcactagtacttcaggagataagtttgccggaggaagtatatcaacaatttactaaaaaaccattttggccagaatggtttcaaagtttttagttccattaaaaactagtggacatttcccaaaaactagtactagatgagtgtcagggttgattaaagtttagaaattgttttaagaactttaattcagctgatatttagttgctagcccacatgtcctgaagattttcaaccatctttggtttggaaattatttgcaaataacatatgatcaccttttattaggtatttagaaaaaataacttcatctgacatttgtctctaggtatatggttgtgatgtcatcagggttacaatacaataaatactctagttatatgttttaaataggaatatatagcagtagtacaaagtctcatttttatttcagtaacttttcagaatgttgccatctgatctagctcaagacccttagtttgtgacactcacttgaatacttaggaaaagtctatggctttgatctgatgcctgtttgggcatcaaaccagagatgtggttgagtcccaaccagagtttaaccacagctcaaccacccttgacatcctttgacataccttaagctttatgggccaaaggctgcttgaggaggggagtacatggcagcctcaggggcagattgagtgctgcttttagaaactgagggacaggctgatctgcctagaatatattggatcttgctatgtaaatggtttgtatacattcagaatcaaattaacaaaagataaaaaagactagtgaaattgaaattatttgacttcttgaacaaatataattatttttgcacagttaccactagtactttgcaatacttgatctaagcattcaaacaccacccctgtgggcagaattttatggacactgcagtgactgtcaaaaacatgaaaatttcacatcttcccaacattttcagtttcacttctccattaatagtcactaccttatttttaaaatcaaaccttgtgttgtgtttagctgtttgtaaattgcctacgtcaaacgatacaacactctattggaaagttctttgttggttctgaatatacatacttggcttttcatggaataatgctgcagccacataacagaactctgtcatcagtgttttaaatcctgagtgattatatgcattaaatgtcattgtaggggctgggcacagtggctcatgcctgtaatcccagcacttagggaggccaaggcgagtggatcacccaaggtcaggagttcaagaccagcctggtcaacatggtgaaacccggtctctattttcaaaaatgcaaaaattagctggatgtggtggtgcacgcctgtagttccagctactcaggaggctgaggcttgagaattgcttgaacccgggaggtggaggttgcagtgagccgagattgcctgggcgacaaagtgagattccgtctccaaaaaaaaaaaaaaaaaagccattgtaggatagtagtaattttaaaaacatagaggacaaacaaaaagtactttctacttcaatccaagatgaagaattaaccatgtcagtaacgaaaaggtggaccattgcagcatctgtcattattgtttctcattttgccttcttcttcctgtcttctccccattgccatctcattttctctgcagccatgagcaggaactgtatgcaaagtacaaaagactgtattcctgaaacagaacttgttgaccccattttcttgactcttatttgacattgctttctaagagaagggttttggattacacactcacacacacacacatatgtacacattcatagtaataaatgtatttatcaactcagttgcaatgagattctgcttgttggaatatcatataataaatagctatattggtatttattgaacattggctttttatatgactgcaataagatttgatgctagtatttttaactgttgctccctctctgcctccatgcttagctgtttaaca

SEQ ID NO: 104990 - DNA, 1020 bp, Homo sapiens
accaacatggcacatgtatacatatgtaacaagcctgcacattgtgcacatgtaccctaaaacttaaagtataataataataaaattaaaaaaaaatctgagaaaaaaaagttaatttaaactttagcacatcgtatggttaacactaggtaaaatttcccttttgaagtcactaatatgaaatacataccacatttgttttctgcagcagtagagctaatatactttgacctttttttcccaaatgatactttataagtcttcaggggagagattgaaagtattaaatttcaagttacaaccatcatcattaagatcagctcagccttaatcttttggccttgtccctgcctttccctgcagtgccccagccagtctgtactttatttccttcagcttctaatgttttttcttcacttttggtgtaaaagattctcctctctctgcctggaaccactccttggccccactcttccccttggcaagctcattctttaggttttagcttagacatcactttcttgaagtaaatttcccttaccttctctgtgttcccacagacccttatgcttcctctttcctaacgtcatccactagagagtaattgcctgtattttgttctctaggccctaatacacggtaagctctataaggtcagggatgctcccaggctaccagcactgcacctggtacatgtcaggcatccagtgcatacctgatgagttgaacaaatgaggaatcattccactacgtaactagcaactaagcattcaagagatcagtatgaatgcatatatttatcgttattactatatatctgtatatcttggtttttacatttgttccttcttttgtatgtttggagaataaaatcctttataactcactgcatcccttccttaggaactcttaatacatctgcctcatcccatttatctgtgtcttgaaagggaataaacaggacccaaatggtagattatcccaatgtacaacaattcagcatgagaaattccatgttaa

SEQ ID NO: 104991 - DNA, 1031 bp, Homo sapiens
tctttaataaaatgagggaactggatcagaaagtctaaaagaagttccctttattgctcaatttttatgatcctgtgatttagaaaaataattttaatgggcagtttcatagtttgaatgacatattattcaggctttttaaatataggtgttagaaatgaagcttaaagcagttggaagcaatagagaataaggcaggaattaagtacttctaattaacaatgctagataatgtcagtgactgtttcttgtatctgtactgtaaggacaaatgctgttcatagttgtaacttctaagacaaggctttgatttctttacagtattcttcacctacaccagaaccacttgtaaagaggcaagaatatttactaagagttgaatcatgatatgttttttttgcaatatattgtttaaggtttcttttaagtcctgcctctttcaggaagcctttacctaatagttcacttctctccaggaaaggactgatctttacatgtatatctttctgttactgtatttaggcccacaaaacccctaactagatattgcctatgggttaagaacagagtaaagatatgaagaactgttttcagacatgtaaaataaggtaatgtgaatcatgtagaagagacaatatctttattccttttactctcaaatcataaaaacgaaagttataggagggaagatttgacttaataatagggagaatgtttctgaaaggtagaactctttggaagggacatgatctactttctactgtgtgcactagtagtgcttaggcatcttgtaaggattgttgtgcagggagtttctctttcagcttgaaggtcagctaaatatatcatctgagaatctgtaattgaatttaacaaatattttagtgcatctttgcagtaggcattaaactctacataattaggtgatggctggtatctgttacagtctagcacaactggcttaggaggcaagtcttattcttgcagcactattcacagtcacaaaaatatggaattaacctaggtttcca

SEQ ID NO: 104992 - DNA, 1051 bp, Homo sapiens
aaagtgatggtgcaccttattttatagtcaatgaaatatggtattacatggttgtcttcagagcctttattaacattcatggcattttgtgtgaattagaaaaatgtattcctttctgcaggccaaaacagccttgcagctgcatgtgaggaagaaaggttattaggaaactttgacagtatagcaaagtaaatataaaatcaatgttcagaggagtaagtttctgtttttaaaaattatctctttaattaaaggcagtatttttttttctaatggataagccagttgtgaagaagtttttatctgtggatatcagggtcttttagggtagacaggaagtctaacagagtttaattttgactgagtctgtcgaggttagtgaccccgtaatcttttcagaatgaagctcttgccacgaagccttccagttccacccctaggaacttaggtcaactcctgaaaggcatttctgtttttgatgtttgatgtaaatctttattcttacatctttggcaatgtttttgtttgaccatatactctggaactacttttcacactgatagtgtcaaaaatttaattttcacaactagcagcaggtaagcctaacttacccatgttatggagatttggaatactattaggaatagtctactaagttagtattttttaatacatgacctaatatgaggattctgattggaagctaattgggaatgatattagttcctgtcgtgaaagtatttcaacttttacagtaacattaaatacttgggatctagatattttctatttaaaataaatttctctcaccaattggagggtgataatttgtaattcaaatgtgttacctaattttgtataaaataccttttcctggttatgtttcctttctttatcctcatctttcttgtaatgtagacagaaaagtgcagtttgtagtaagctgacctctgaattgctctttgggagcgtagttacaagggattaaaggggccctctgcaactccagagattaggagattaagtcaggcagatccaggatctctggtac

SEQ ID NO: 104993 - DNA, 1004 bp, Homo sapiens
catggtcctcagtcttccactcaaaggaattagaggaattaatgccagtcattttcattaaacccttttaatgttaaagatcataatgttcttaaatgttcaaaatatacagaacatatgaactgtgacattgggctccatttcaaaatagcatgtttgcatatccctgttgtggctgttttccacttctaatggtcataaaaccctggcttatatttagcagaaaatcaacgactttgacagaggagcttagcctggtaacagcgcaaattaataaccatctttaatagtagtgagaacagtctttgaaggggtaagccaaaacctgacccccgaaatcaacagtattgtcaaagtattttacggtagattggctgtttaatctactatttaaatgtacttactagttttatctaaggagacaaaaccagtaacttacctttataggaaatactttagttaaactgtagtgtaattgcagtgctccagattaactaccctcaagcagtaaactatattggttgcagtatagaaaggatgtctgcttagtatctgcataatatcaaccattgacataattttttagatttatttttaggaccttccaaatacaggatactattctaaaacctaataagaataggggagatatatatatataaagctatgctttaagagttcatttagaaactttattttactgtgctggaaaatactgtgtcaagttgtacttaaattcaaagacaaaataaattaactgtgaccttaaatcaaaatttaattatgtagtacctatttctttatcttaaaatgtgaagcaaatagttatgagggcacagttggtgtagtgagaaaatacttctctagttactgtaattatgggataattaaataacctttctgaacttcagtttcctcatctacaaaatgtgaacagttcttgtactgcttacttcttagtgtttgcattgggaatcaaatgagatgataatgtgagaaaatgc

SEQ ID NO: 104994 - DNA, 1073 bp, Homo sapiens
tctccaataaaatctatgtacacaagagcaaagaagactgtacctatacttttcccatattatctacaattgcttggcatagtgccagaaacaaaaaagatgttaaatcagatgcattgaaaaaatgggaaagcagtggtcttaaaataaaagcccaaaacattctgatacatttagtttaggtatagttatactatatcgagtacaatactaactacccagtaatggaaatgtaatggagaaaagaagaggaaatacactaaatcccttatgtgagacctagattcaaattctgtttctctacttgcatgacattaggcaagtcacctaacattaaatgtaaaattgcagggtgcaggagatggggagaacaaaccaaacaactaataagtacaacagacttggactctgaagattgaaatcttggctctggaactaaataactgcatgcatcttcttgaacaagtcatgcatctcttgatttccctcatctctaaatttagcgtgacaaaatccatctcacaaggctgttaggattaattagaacttgtgtgtgtcgatgcctggtatattgtgggcatatactaaatgttagatttatttatcaaaaaaactctgtggatcttatgtgacctcattgtagaaatgagggactttagttagccaatcactgaaatccccttgagctcttagttttgggcaggtataacaaagtaccatggactgagtggattgtaaacaatagaaagttacctctcacagttttggaggctggatgtacaagatcagggaactggcatggttgggttctggtgggttctctgttctgggttacagactaccaacttatcactggatcctctcatggcaaaaagagaataagaaagctctccaagtttcctttcatcatattgttgttaggatttaaacatatcaatttgtgggggacacaaacattctatccataacaagttccaacattctacatcagtcatctcagagagaagataatagataaagaatggatattgttctttttaagctcactagggattcctaacttatctacagga

SEQ ID NO: 104995 - DNA, 1437 bp, Homo sapiens
acaaatgtttatgttggagtgcccggcacatattgaatgcttactgaatttattatttctattattagtttagcctatatgaagccccttgtgaaataatattataacctgtaggaaaatttagtaaaggaacatgggacagaaaaatgttaaagagatcttctccttcctcaggatattctctagtcttccagcttttactcttaagttatggttctaaaacgctcttttacctaaaaaacaataagaggttataacccctcagagaccacgagcctgtggtgtgttagcatttgttcaacaaacagtgggctctttatgtatgccaggcagtgctttggacatcagttgaaagacaatactttcatgagtaattcatgatttcatgaggaggtcctactgcaagtatagtattgaagtaggaatatgatggcaggacccccaaagaggagattgcttacatttcaatagataaacacataacacttcttaaaacttagggatcaagattttgtttcctgcttcaaaaggtggtagttgtgggagtctctgacattagaacatgttggaacagtcagtgtgtctgtttaattcagtgtggtttaattcatgaacacctgtcagaatagaagttgacaaacatcatcatcaaagtagatccttttgttatcattataaaatattcaagtttaaaactctgtccagaaattcacaggattctttgcaaactcaaattttattatttttcatccagttatactttggttttaacgaaatgtctccatttaaaacaccataaagtcaacaaaatttattaaaatttttaataaaaactgagcaaaagatgtgacaaactgtagaggatatccagataacacataaacaaatgaaaaagtgttcaacattattagcatttaaggaaatgtaaattaaaaccacactgaggtatcattacaccttatcaaaatggctataatgaaacatagtgataacaccaaatgctagcaaggatgcagagaaactagatcacattgctagtgagaatataaaatggtacaaccactctgggaaggagtatggcaggttattataaaactaaatatgagcttaacatatgacccaccaattacactcttgggcatttatctgagagatataaaaacttatgttcacacaaaacacatacacagatgttcatagcagctttatttgtaatagcttgaaaatggaaacaaccctgcgatattgtgatttttaataagaaatatatactatttggtcctgatttttggcacaaagctactaaaagccttgcgatctcagaaatgttaagtgtcttctgatgctaatgaggtgactggtggctggggtctcctggaaggcctcaggatggaagctggttgccatcatgtcacaatcatgtgattagagggttgg

SEQ ID NO: 104996 - DNA, 1044 bp, Homo sapiens
acctgcctgtggtgctagcctagggtaaggagttgtccagaccgccaaacgtcttcccaggagagctcatcaagagcccatgagtcccctgcccacagcccacctgcattttctccgtgaaatatctacttgaagacaggcatctcacacctgtaatcccagcactttgggaggctgaggcaggaggataacttgagcccaggagtttgagactatcctggacaacatagtgagacccccaaaattacaaaaaaaaatttgaaaattagccaggtgttgttgcacacacctgtggtcccagctactcaggaggctgaggcaggaggaggattgcttgatcccaggaggtcaaggctacactgagctgtgatcatgccactgcactctagcctgagtgacagagcaacaccctgtctcaaaagaaaaaaaaaaaaaccaatacgaggggagcaaggtgagaagtatgtggtgggtacagggaaagagaataagacttgtcaagaaatatgacaagagctatcagtaaaatacagataggtgactcttggggcagctggtgtgaaatgtagtctgtcagcagcaggtgactggctcagccgcagcaatggtggtccaggttagaacagcagcttctcatctcctaccctcccactccttgccagctttctgaacacttcttcccccacagtgctggtatttactgactcccaactctgctttccttgcagctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgt

SEQ ID NO: 104997 - DNA, 1048 bp, Homo sapiens
cactgtggctgataactgcacttctggtaacccgacatttgctttgtgtcctggtgaccgctgtagccctacgtgcagtgaggcttgtctaattcaattacaggttcaagtgtatttttcatctcaaacctctaatatttctttggagttgagttgcttagcatgtggaatttctccagctgtcagtagcctgatgattttatggttgttatagtaaattgctatcattttacatattgactgggcattctttctgttacagccttctttatcaacaattaaaatatgtaactccaaaaatagccttcttgtgaaagtgaagtctgagctaatcattgtgttcagccactttcaactttatttctctcaaaattgttacagtgattgccctcaagctttgtattgttcatttttgttgttgttgttgttgttgttgctgctcttttttctccatgattttagcaaaagaagtaaactcaactgtattggtcacggtcagcccattcaatgacaagggtgtctgtctggcttcaccttcaggctattttagtgtgcagctataggaggcagaggaaacgtgggtggtgtagtttctaaaacacgctgacttgctgattgataattcagggttattagtgtaacaaagcgtagtggaaactcctactcctgctgcaccatacagttacagaccctaccatactcttggtctcatttaaggaaccattaacaccttcactgctgaaaagcaggatttataagcataagtcatccacctctaaatattttaacatttaaaatgcctgattcaaaagatacagtttttgttgtttttaactagttaaaaataaatcctaagaaaatatatttaaatattgcaaatgccacttctaaaccaaaatacctgagaatattttttgtctttttaataacgattttaccattcattttatttaaaaacatttctcagcatagcagggcactgtatggtctctgatgcactactcaaccctctagttgtagtagagggagccacagacagtacataaat

SEQ ID NO: 104998 - DNA, 1064 bp, Homo sapiens
cagcaccagctcctcctcatcttcgtcttccaaccagcaaaccgagaaagaaacaaacacccccaagaagaaggagagtaaagtcagcatgagcaaaaactccaaactcctctccaccagcgccaagaggtactgtgctcttttttttttccacaggcttcctatttccgaactgcctcttgctgcatttggtctgcctcccaatgaggatagcttaaacgctcctcatggtttatgtgttcttaaaaatgaaagaagggccttggaagccctaattattttctctattgctgcttctgtttttaaatcattgctcacatgcagctgttgcggcttgcctctcgcatttcttgctgaagtttgtaagattcctcgttacttttattagtgacccccaaatctgatttcagatttcttgtcctactaatggttaatctgtgaccttccccaaggccatgatcccatttcttaattactaataccagcccagagaactgcatcaaaatgaattctgtgaccattttaccttctcctcacctgttgcatggatgatcttttctaaatagagctttcttcacaaattgcataaggaataagaaactcatattagcaggtacaaaatttagtaggtgaagacagatgttttctggtggaatttaaagagatttttctgagagttgaggcaaatgaatgaatcagtaagtgactataaaatggttattctaggttatttttgtggttctctttaaaaacttcagtttaccaatttcagggagacttgtctttttttcatgctatttgctgtcctcatgctgtgaaaatgttactttgccttattttttcaatttaagtggtctcccttttactttattcttttcctcttaaggccctgaaggtagctactttttatccctgccatcctaagcggtcaccctttttctttattcttttcctcttaagcctctggaggtagctactttttacccctgccatccttcagtaatatcctctgatcgccatgaccctcaaaatcatctttagtggattcctaggagctctgagac

SEQ ID NO: 104999 - DNA, 1006 bp, Homo sapiens
ttgagtaatgtgaattaaaatttttacttttggttggctaatggtgctgtcttaatgttatatagtagtcccaatattcagctctcttaaaagagttcggttttacgttttgtgctgttaccttttggaatttaattatttagtattttaatgtactttattggagataaagatggattatttatttatttatttatttattttctttttgagacggagtcttgctctgtagcccaggctggagtgcagtggcatgatttcggctcattgcaacctccacctcccgggtcctggttcaagcaattctcctgcctcctgagtagctgggattataggcacgtgccaccatgcccagctaatttttgtattttgggtagagatggggtttcaccatgttggccaggcaggtcttgaactcctgaccttgtgatctgcccgccttggcctcccaaagtgctggggttacgggcgtgagccactgcacctggccttggggatactttttgaagtcagcgtccaatgaaaatctatgaattaagtgatatattaagtgcgtacatgtttaaaattaccctcagcatgaaagcatgagatttgaatgagttaaataattggttttcaattagtctgtcttatatttttaccctttgccatacttcctttcttcagtcagcattcagtgtgtagttttaaacacgttattaaaatatggcacttggcacatagtaacttctcagtaaatacaaaaattagccgggcatggtgatgcactccagcctgggcgacagagtgagaccctgtctcaaaaaaaaaagttgattattgcaaatcagtagaattgctcctcttgaaggaaggtgcactgtttgtgttcactaattttggcacttggcaaaaatatttgaagttactgagcatcaaaacttatgtgaaatgcaattgctcaatatgttataatgtatgaaaacataaaattaaattcttaatgttgtatattatgttgggt

SEQ ID NO: 105000 - DNA, 1778 bp, Homo sapiens
atagcttagaaggcaatactcacagtttttggggattcttgttaaattcctgtcacaaactttgagggcctgttataaatgaaaaggcacaagctgggcatggtggctcacgcctgtaatcccagcactttgggaggccaaggcgggtagatcacctgaggtcagcagtttgacaccagactggccaactaaaaatacaaaaattagccgggcgtggtgacgcgcgcccgtaatcccagctacttgggaggctgaggcaggagaattgcttgaaccctggaggcagaggttgcagtgagccaagattacgccactgcactccagcctggttgacagagtgagactctgtctcaaaaaaaaaaaaaaaaagaaagaaaagaaaaggcactgccttcaaggagttcataatctagtcaagatgttaagacatgcacacacatattttgaatggtacttggaaatataaatattatttggaaaataataaaatgcagatatcatgttataaagtttcagaggagtgagagattactttgacttgggtttgagggattgtggctggagtacttagtgatctgggaaggcttcatggaagaggtgagaagtggggtggggaagaataagggatattcgtgatggaacagtgtaagccaagacagcagagggaagacagaaaaagggcactattgggcagaagtgagtaaaagctgtgtctagagaggaagaaacattagtgggagaataaatagtaatagataaagcttgtgttcttcagtgtcaggctaagtctttaaattttattatgtagatgctggagaatcattaaaaaccttttgagtaggggctgtcattcagatagagttggctatctggatagagacagagtaaggattgagtggagcttggtaggaaccaggagacttggagattgctacagtagttaaggtggaaggtcaagagggtctggggtgtaagtggtggccttcaaagtggagaggaaagagaggtagaagacagtagaatccatagaacttagccactgatttcgatatggaggacttgaaaaggagtcgggttcttctgggtgttggggaagttggtggtgcattaacagaaataaataaggcaggaggatgaactggcttgagggaaaaaggttttgttacttgcttcgttgatcacatgcaatgcttagcatgttgctgccacttagtaggtcctcagtaaatatttgcagtttgactatatatttgagtttattattaaatcagtcattgaactcccagatctacatggcctacttttagattagattagacaaattaaatagattataaacttcctaaaagggaaggacaatgatttctgtctttgattctgaccctacatgttcttcccaactgctttagtttgacgattttcacagctacaggagatgttaaaagaatgatacagcaagcgcccacccttcaccgtgattcctcagcaaaattacaccatgtttgctctgtctctctcttatctctatatgataattttgtggagtcatttgaaagtgagcattttgatgcttccgtgtgtttagctttgcacacattgaatctgaggtggcctgacggtggagctgaggctggaactggttttggtagtccacattagatttgaaagtttgggtgatgttaaagtgcacaagattgctgagattggaggaggaaagaattgtgctctgaaggatgtcttcagatggaggatgggaaatgaagaggacttggagaaag

SEQ ID NO: 105001 - DNA, 1089 bp, Homo sapiens
tcactgggttttgctacagtgacagcaaaccattggggcagtgtgttgttcactaatacttttaacagagtagttaaaaactgaattctgtctgctctccaaagtacatgctgacccaaatatgacaaagtgaatgcaaagccctcttatatagcattcaaaggcagatttgccacaggtgccacatctgacttgtctgtagtgatctgagtcattattaaattttaaatagtaatacaacggagtagtcttagtagagtctactagcattgaaatgatgatcattatccatactgccagtacattggccatttgtatttattaaaattgatcgatggaaaattggtgtgggatggacctctagtaaattctacagaaaaaggcattgaggcacatttccaaacagatgagagtaaatagagtaacttgggatgatcttacttggagaaaagttttagatgtgatgcagctcaaaaagtcagcattattatgaagcaatgttgtacatgtgacagcagcatgagtagatcagatcgtaatcatttaaaacattagagtgtctgctgtgtgctaggcattgttctgtaggtgactaaaacagacctggcctctggcttgtgaaacctgaattttagtagacagtgcaaacagcagctaagcaaaaggattagtacaagttgtaatggctagtaggaaagaaattgacagagtgcagtgatggagaataattggggagggtgtgagggttacctagagaagccttacaaagacatttggtcaaagacctaaaagataggaaaggaaatggccttgtgaaaagtaccagaagacatctgggacagagggaaggtaaaaacaggccctgaggcggggacaagtcaggtgatgctgattatgtaaaccgtgctaagtagagagtttggatttttctcaataatgctttaaaagtcttttcccaccctccctgctgcatggaaaatagctgggaggaagatgctagtggaagaagggagaccagaaaggagggtattgctctgtttcaagctagctggtgcaggtggctaggattaaggtagtggcagtggagat

SEQ ID NO: 105002 - DNA, 1073 bp, Homo sapiens
agaggaacacacacatctcttctattgcttacttaaaatcccttactcccctagactaagggctccaacagagtctggacctagtctctcctgtttatgtcttccccagtacagcacatggcatgtggaagacatctgatgtttaatgagtaaatacattataggtgaaaacttgtgaggactaagtgaaaagagaaactctttttttatatagcattctaaatcagttatttcctaaattcatgaatggatggctaattttactagctggatattcattttagatattcctattaactttagttataaaaactctcttgtaaagatttattcacaaggctttttaaaatgctttaacttcttgctgtttcaatgtatttcatctatatcctaaacagttcttgttccaaatgtcctatttaacagaaaaatcgtaatcttaacatcaacagcaaaagctcaaaacattttttctgaaatatatatcttatctgtgccataaactagatcataaaagcagcagctgaaaagaagttattagaaatagcttaaaactcacaggaaacagatgctaactttccctccctgcctccccctttcctaatgcctttaaatataaagctattacgtgttgaaatgaaccttttattttgaggattatttatgtagattatccagagaaatttaatgcagtctcaattcaccagaatttttcaaacaataatctgcaaattgatacaggtaaaccgtgagatttaacttctaatgtctaaaaaaaggggggaggaggggagtttctaaaattgattcactttttattttgaataattgatgattatatgtcataaaagcctggaaattaccagaggtacactgtatgcaaattttaaaacgtatacattactttaaaagtatacattacttccttggttcttacccttggcttctgagttttgttttaatgcaggtgtgggaacctcccctagagatgattccaataggatggggccctggtgtgactgttttttgttctggtttttgttttgaggcaggtcttgttctgtggctcaggc

SEQ ID NO: 105003 - DNA, 1152 bp, Homo sapiens
gtagcaagataccttaagttacaacaaaatcttaggaaataagactgaataatatctgttatagaaataccctactctttaccaactcccaccctccctgaccccttcaaaatcataagcagctctcttctgtgacagacaaataatgtaagaattgtgaaaccccaatttatgtagcgtatctcttggtccactgtctggccattctgtcatgttctgctctgttggtcatatactgagtggcaatacttcccaccaaggggtcggctggaagaaaagaatgtagattactttggagaaaggaaaagaacattttaaactttagcgaatagtgacagcttgggtagatacgtacgacaaagtatgtgtgatcaaacccatcttcgaaacaccactccaccatgctggatatttttccatcaaaatttcaaaaaaacataacgttgggggaagagggaatgcttaggctttagtgtactggtctgtctttatcttagttcattccatttttctcccaacaaacaacactcaattggagtttctttactcttatgtgttaggctgagttcagtagagactggaacggtcaaggcttcagactgcaatgaacatccagctgtgttcatgtgacccttagctcaatgtcaccagttaacggcattgtgaatactgtgaagtcttcggggctgttgcagtgcaacactattaacctttacgctggttaaagagccaggttgccaggcaaaacctggacctccaattaagtatagtatttctctgaatcttaggatctttaataaatttatatttggtttacctagaaaatatatttgtctgtgtgtgtgtatatatatacatatgtgtatatatatatattttttgagacagggtctcgctttgccacccaggctggaatgcagtgcagtgacatgctcatggctcactgcagctttgaccttctgggttcaaacaatcctgacacctcagccaccctagtagctgtgactacagaaaaatattttttaaatgaaatgaagtcccaaaaaagtcacaattcaatagtcactaagtatttaacaactaccattttcaaaattgagtgccatctcagtgaccagctatgggacacatgctcactgaaccccagaggca

SEQ ID NO: 105004 - DNA, 1042 bp, Homo sapiens
ctttaaccagcgtaaaggttaatagtgttgcactgcaacagccccgaagacttcacagtattcacaatgccgttaactggtgacattgagctaagggtcacatgaacacagctggatgttcattgcagtctgaagccttgaccgttccagtctctactgaactcagcctaacacataagagtaaagaaactccaattgagtgttgtttgttgggagaaaaatggaatgaactaagataaagacagaccagtacactaaagcctaagcattccctcttcccccaacgttatgtttttttgaaattttgatggaaaaatatccagcatggtggagtggtgtttcgaagatgggtttgatcacacatactttgtcgtacgtatctacccaagctgtcactattcgctaaagtttaaaatgttcttttcctttctccaaagtaatctacattcttttcttccagccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacac

SEQ ID NO: 105005 - DNA, 1055 bp, Homo sapiens
tttcaggtcctccttggggacgccgcctgccgcagccacccgcccccttggtgctcagttctggttctgttaattcgccccaccaaaacgtgccgagcaccgctctgtgctggggttgcggaagtgactgaacgcggctccgtgggcgcagtggtgggggttgggctagctgtccccggcagttggtgcagagccattttcattcccggcggtttccttgtttttgttggggaactaagatggacggatacagtcgtcttattgtacttaaagcggatgatatttaatacacagtttgatttcacaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggtacgtgatcgactgcgtggatgcttggataaaattatattcgagaaaagttggaaaccagctgttaggaagacactgctgcctcagtgtctttcttcgcatagggctttggcagaaaaaagctagcaacactggtcagttactgtatgcactgttgtctaaagtggcaagtgtgtcaaaggttacaaatctgaatgagttcagactaaagcaaaataaacagtgtgcctccctgtgtgagtagcctaaggtgcattgaaaaagactgggatgtgttttatttttttctattagatagcattaacttactgttgaagtatttttggtggagtattagtgacaagccattgagtcttaagccttacggcttcctataaaatcactaatttcgtgtgtgtttgtgtgtaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggtaaatggttttgagtagcag

SEQ ID NO: 105006 - DNA, 2435 bp, Homo sapiens
ttgtgatttttactaatcttggtgaagagtaattgcttgaaagacttgtctttgttacaaatgcgtgtgtatatactggaagtacttgtggaacctaagctttaaagcggcaagaatatgcagaagagaccaaatgtggcctgcacagcctaaaatatatactaaatatttttaaagctaaacgttgctgagctctcagttgtatggaaaaagataaggtccccaaaccctaaattttgttacccagatattaacatattcctgccctagtcaggaatggagtattaagagggaatgatgtgtttcagtctatgtgtgttgttttagcaagtctacattatctcattacacttgtgatagtctagggagaaatgcttagtaaataacttgagtagtaaaagactcttgtctggtggtgaactagagttgagaattaaaattctttctgacttgctgctataggcaatgtgggagattgaccttgggccttttttcctattctaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaaggaataaatgtctattaaactaaaacaaatggaccttctgttattttttgtcatcttacagtgctaatgtactttaaagcaaaccaaatgccctaaccagcaaaaaggcatcaaaatgtgattatagaaataatataatttgagatagcataaaatgtacttattctctcagttctttgatcattgcatgaattaggtttttatctaaaactgttcagctgggtgtggtggctcaggcctgtaatcctggcactttgggagacaagctggaggatttgttgaggccagcctgggcagcatagtgagac

SEQ ID NO: 105007 - DNA, 1804 bp, Homo sapiens
accctttagcatgaattctaatagctttagtaacctcataagggctggctcaattaggaagtttttctctggtttgagccctcttccaatacttcgctgatctaaatcttgcctcgtggagcaaggcacattataaaaattcctccggatgaatgttgaccatccccttcccccttcagttcttccatttacagttctcatctctttgtccttgcccagcattgttttttctgatcactcatcatccttgttgccgtttgggatggagcacccagaagtgaacaggctcttgtggaagtggttggatgattatcaagttccaagttgccctctttgtcttgaatcctgttgcaaatgaattccctggcaggcttagtatttttggcatgttgctttgctgactcacagtaaccttgcagtcaactaggacctttcacgtgaactattatgaagttagatttcattcattgtgcagataattgcatgacttgaagtgtaggaatttacaatgaccattcttaaaatttctctcgttcatttggccttaagttcaaagctgttacaagctgttacccaccatgtttacagtttctgctatctatcagtaagcaggaggtctaataagaattgccttaaactggccgggcacagtggctcacgcctgtaatcccagcactttgggaggctgagccgggcggatcccctgaggtaaggagttcgagaccagcctggccaacatggtgaaaccccgtctctactaaaaggacaaaaattagccgggcgtggtggtgggctcctgtaatcccagctacttatgaggctgagcagcagaatagcttgaacctgggaggtgaagattgcagtgagccgacatcgcgctactgcactccagcctgggcgacaagagcgagactcccatctcaaaaaaaaaaaaaagccttttaactttcgaatttttgtaaacattgaccaaggtggggccagattcagcgctgtgtggcacacctctacccttccctctagtttggttatcagttgacaaacattcaaccagtgatcctgtaatcttactgtccttcgtgacatctctatgtctcctcgccccatgagtaacaagtgaaaacagtggagtaaaagacttggaaaaaaattggagaggtggagcaaagaaatctttccttggagcaaggaaaagcaagaattgaagaaaagttgctctactggtcagtagggttaagagattcaaaaggtagtgtggaaataacctacaaagaaaccactggatccttaacacacattaaaaaatgaggtgaataatgggtagggaggattagttactttggtttgaaccattctgttggaactcttctagtataatgatgacaaaaaaataatcatcagcttcttactctgtgccaggccttttacatgtgttcctcatgttaattccatgaaggaaggtgccgttgccaccatcttaatgatgcggggctaagtaaattgaagctaaataacttactcaggcaagtagtagagccagaatttgaatccacaaaatttacttgggaacacaaactgttaactactgtgctataatgtactttagcctgcataatatttgaagatttatacgcaacttggtggtcctgtcttcttgagggtgaaggagatactgcatgtgtatggatccccactcaatttgcagtgatatatgtaggttatagctagtggaaaaggatagtcatctgcagggcctcccagtttcatcagtcctctctttagtcatgctggcttatttccagac

SEQ ID NO: 105008 - DNA, 1251 bp, Homo sapiens
caggattccactatggagttcatgcttgcgaaggctgtaaggtaaagcatgcttttgtttctttaagctactgattctgggatttaagaagttgggtttagatttacccatttgtgcaattgatagtctgagagacagtgagaagtcagctgctctttttaagttttaagcattttatgtagtgtataagcataacttgttttgaataatattcttaattcagtgaaagtatttcttttttctttaagattttgaacaaagtaaatttgctatctcaattaaacatacttattgtgttaaaccaagtgcaccaaatgctcattcattaatgtgtcaagcacagttctaggtggtagtgaaataacaaggaacaaaacagagaaggcactacttctgccttgtgggaacttagtttaaaccaaactttgaattaggatctcatcatatactttgacttaatgacacgtcaggtactgggagctgggaataattgctacatacttgaaaaaaatgtggtatcttaaaaaataatgccaagtgagtaaaataatcctgaatataagttgagcccttgggaaagctagtttatttgtaagtttagttgactattttctagttattgctattagagtattggtcaaataattccaagtgagatggtctctacctccctacctatatacagggaatctttctctctttttaaaaaacttggcacaatcttttctcctgagtatcaaaaattaacgtgatgaagacacatgttcttgctgttctctgacttgaggccacaagcaagaatctagtttggcgagatatgatgggtaaacaagataatgaatatacatgatgggagaggaaatattttcaagtgtggctctgaatgaattgcgagtttgccagtttttttttttttagatggagttttgctcttatttcccaggctgaagtgcagtggtgtgatcttggttcactgcaacctctgcctcctgggttcaagtgattctcctgtctcagcctcccgagtagctgggattacaggcacacgccaccactccaggctaatttttgtatttttagtagattcggggtttcatcacattggccaggctggtcttgaactcctaacctcaggtgatctgcccgcctcggcttcgcaaagtgctgggattacaggcgtgagccacgcgccctgccaagtttgctaacttttaatggccgggtaactttgtaagacaagtcagtattttt

SEQ ID NO: 105009 - DNA, 1046 bp, Homo sapiens
aggtcagggctgcagtgagctgtgatcatgccactgcactctagcctgggcaacagaacgagatcctatctcaaaaaaaaaaaaaaaaaagaatcagtcattcatacttcaagagttttggaatttgtagtgaataaaagtatgagatggaaaatgtgactgcaggcagggtctggtaacagggtagtgtggttgttgcaaggggtgttttgggtaaggacaaagaatctctgaagggaagaagaattttgtttggttagtaggtgttaggtgcttactcataccaataagaatcgaaattaaattctgtgtgtcaacattgtatttccctctgtcctaagacatagtgtttcccagatagtgagtcatatactgggactgtagttcgtcatatacactagataggtatgggagcagtgtttataagaagttcatttgggtgtttttaaatgggtaagtaaatcttcctttgttcttagggtttctttcggagaagtattcaacaaaacatccagtacaagaagtgcctgaagaatgaaaactgttctataatgagaatgaataggaacagatgtcagcaatgtcgcttcaaaaagtgtctgtctgttggaatgtcaagagatggtatgttcccagtttaaagagtgttcctaaagtgtatggagcttggcttttattcctcatcatgaaccagagctataaaccggttaccaaggaccctcttgtatttaaggtgaagcagaaaacatattttcatgctttacaggacaccaaattgattaaagtcgtattttagcattatcatcccagaaacagtttttggctaaacttctgttgttgttgcttcttctaaaaagagccattttttttctgtgcaatttgattactttttattttttcctaaaaccaatggagtttaaaaacattttttatatggccgggcatggtggctcacgcccgtaatcccaacactttgggaggctgaggtgtgtgggtcactttaggtcaggagttccagaccagccatggtgaaaccccatatctac

SEQ ID NO: 105010 - DNA, 1257 bp, Homo sapiens
atatactacattattttattttgctaattagaagcagttgaaatcagatgacatctaattttaaaaagtcagaacctctatgttcttgtgaataaaaattcttaacagtaaagaattttgattgatcaaatgttttatgtgatatatatgctttataatatagtaactagctaacgatttgttactgagattttgagaaatttgtcaacttttgcctttattcagatgtataaaaccttgctttctattcgttagtgacactgataagcaagaattttatttatatttaatgttaataatttatcctgtttttcctatttccctattcctgatctctcttagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaaggcctttgtttatttaaacatgaactgatggtaactgtacattttgtgctaaaatgcatatttatatgtgtataccatatgtggagatagaaaagacctttaagacaataaaagattgtaggctatctctgtaatcatgcaatagctgttcggattgagaactcttcagccatgattagacgttgactgcatctccctgatagaccaatcagctgtgtcgcacttaaactggagaagttacactgaagtataatcacactgaatgttagactttttcatctgccaaaaccaaaaaccattttgatctccctgtggttatcaatataacgcacaatcacaagtgtatgaggacttagaaattaatcctttgtggtaggagttctgttgaatgatggaaatcttattactaccacaagactatttgatctggtaattggagacttcgggatttaggagatctccatgtctgtatttactctaccactgctaaagtgtgtggtcctgggtagtttacttgcttgcggaaaatgagaattgatggtgtccccaatgccccacctcacagagttactaaaaaatgtctgtaaagcatatttacctcttgggagataggcactatgtaaataaggtaaaatttctgttattacaattattcataataatattcttttcttatttctaagcctttctgggaaatcatttcagtccacaccaacca

SEQ ID NO: 105011 - DNA, 1128 bp, Homo sapiens
tataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagcacattctttgattgagtcattggttataaacttactaaatgcagagaaagcagccaatttaggaaacttctgagttggtgggacactgttgattaataatgtactgtatgaattaagtgatgctttaactttgattttacattttaaagttaaaatgtgggcattatgtcagcaaacttaagggcattatgtcagcaagctaaaacattttttttcctgtgcttttaatgtatctctttacatgatctgagagaggattcaagttgatagaaatagctgaggggaaaagggggaacatcttgggatgaagcttgtccttatggtgatggtttaattacagattaaaaaattagaaggaaatttcagtggattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtacaagaagagtttatcacttaggatatagaatttttttaggggttgggggaggggatctgttaggaaactgttacctataaacaaaga

SEQ ID NO: 105012 - DNA, 1027 bp, Homo sapiens
taatttttttgtatttttagtagagacggggtttcactgtgttagccaggatggtctcgatctcctgacctcgtgatccgcccgcctgggcctcccaaagtgctgggattacaggcatgagccaccgcgcccggcctgaattacttttctaagcagaaaaaaaaatattaacttaaaaaacttatctatgtgatttgagaactatagttcataaagtattttggaatgaatttttaaaaaacaatcaaatgagtcacaatccataatcatgtctagagaccctttttcatgctgatttcttacaggaggttacaaaggtgagagacggtgtgcatgcagcaatggagggaaaggccttccatgtaagaggaacatgaggccaaatcttggcaattcacttcctccctaaggctctatttttccatctgttaagtagagatgacgataattcttatctgtacagagttgttacaaggcttagggtaaaaagtatttgaaaattgtacccagtaactaacaatctatgaaaatcagagacggtatttcttcctggcctcgttttcttcttccttgtttaaaataatcataaacaaatgcaatacaagatgtgttaggccatttgtcctcaaaatactattggcctcttaattatatctgaataattatttgcatgaaattaagtcaactttactgcaattgtaccgaattggaacaaataaaacttcaggtgggagaaatgttagaatcaggtttgtggttcccatggggcgtggatagtacctagaagggagggattgtaggggactggtaagcttcagatttttgatctgggtgccagtgacacaatttgtgatcctttctcaaggcactcactttcaatctctgcatgtgtctatttttaagtatgtgacactttaataaaaagttgaaaccaaaataaataaataaatatcctctatgtagtctttaacggacctattttcattttctcacatttcatatgcacaacattaaagaagaaatagaa

SEQ ID NO: 105013 - DNA, 1040 bp, Homo sapiens
ccaacttcagtgcagggtttgctatttttaatcacagaacttagaagcttaattcagttaaaaagagaggaagttgtcaagggagggttgctaaaagttcatgctaaatttgcttagaaccagattgtgttcattaatatttatacatctatggttgggaaggggtgattgtgcttctttaaaaacactgggtattcattttccatgtatggcacagccttctgattagggaaggtgggttttcattgtacaatcaatggagatacagatggaaaccatctggcgcctcatcccctttttgtcaaaaaccttgtcttgtctctcacatgtcaatgatgaatggaaggatttcaaactctagctgaacaatgcagtttgaatccctcagctagccaaggggtttttggcaagcatcgatgagcttaatattttaaagaaaccagcaatcattttaattcattagttgaagcctgttgttctagacagtgtttttgatttgtattttgggcactggctttgtttttgattcacaagcgtattccatatgggtatattttcttttatacagtgtaaatcatggggataaaagtgggagtttcatctgataaaatgaccaaaatgctgagagattcttttaattatcttttgcattaattatgattcatattaagtgttaagaccaaaaattttcttgtgagctagtacagagcatgaatcagagaacacagaatttagttaacccagctatagacaattaatctaaaaatcaattcagtgttctgctttgtgagaggaaacgacataaacctgtcttagagcatctcgggtacactatttttatggcttgtctgctgaaggtgggtttctaggatggaagcaaaaaaatcgattcacatggctagctttgcagtcattattcagctaacaaaagccagattggttttcctgcccttcacatttaataaaatgaggtgaatcaccaaaaaagcaagttgatgctggagccttattcagaaactcatttccagagtatgtcctgg

SEQ ID NO: 105014 - DNA, 1026 bp, Homo sapiens
ttcttccaagaacttaagagtgatatatcactctttattttgtgaagtcaaattgattagaggaaacaataaacataattctttaaccatgaaacccaatatattttgaatacttgtctgggccacataacgatagtcacatgttcgttctctggagactgccgggctgagcccatggctcctggtaaacagtcctcacagtatttcttctcagactggaagagatctcacctttggcctttattatcattattatttcctttgctctgacatgacagaaatccatcaccttcttgatactgatacctgttcactgctgtcagatcattaccacgaagggaaaaccagtgaatacagtattttttttaacattcacctagaggttttaatgataaccatgctttaaaaattggattaattgggcaatgctgctgagcagagaattccatattaggtttcactgactgtcaaggggctatgtgacggcagctcccaattcaaaatctggtgcttcaaaccatctcttccagacaggaaccaacttaaatggatgaagagaccccttagggaagtagataaaacattaattttaaaagacagggagacttaatttcagatcttatctttaatacttactagctgtgggacctcagaaaaggtacttcattgccctgaatttacattttctcacctgtaaaagagatgtaacatcaccgacctgtgagaattagttgaatttacatagacaaagtacctggcacattctgggtccattttaaagtgagttccacacactcatttccctcatatagatttgaatccaatatatatctcctgccagcccacacaccatcaaactaatatatcagatcagcaagaaaattagacgagccttttactactctaactatggtccccgatgagcagcatcagcatcatttgggagcccatcaggaatgcagaactagggctcaaccccagacctgctgcactgaaatctgcaatttaacaagatacccaggtaat

SEQ ID NO: 105015 - DNA, 1084 bp, Homo sapiens
accgttttccaagctaagccgccgcaaataaaaaggcgtaaagggagagaagttggtgctcaacgtgagccaggagcagcgtcccggctcctcccctgctcattttaaaagcacttcttgtattgtttttaaggtgagaaataggaaagaaaacgccggcttgtgcgctcgctgcctgcctctctggctgtctgcttttgcagggctgctgggagtttttaagctctgtgagaatcctgggagttggtgatgtcagactagttgggtcatttgaaggttagcagcccgggtagggttcaccgaaagttcactcgcatatattaggcaattcaatctttcattctgtgtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatgtaggtttatttttttcccttcttctaccaagaaaaaaaaaattgtctctcttgcatgcaataaagacgttggaaataaactgcattggtagcaagacaaaggatttaatga

SEQ ID NO: 105016 - DNA, 1041 bp, Homo sapiens
atctgtaaatgaggacacctaatgcggaatggtcggcatgatactctatccttcccccattaagataacaagatgagaggcaatgattcagatcagtatatttttggagctttgagcggataaaaattaaaaattaaaagagatgatgttctgaaatactttgggtaagcaagctcataaaagccatttggaaacctgaaattacacattaattcagaatctccttctgaggggctcctaaaacacctttctgttttcttggcaggatgaaagcattacttttgtgtcactgcctggtgctttcacggggtctattctaatgctcactaaggcgtcatgctctgttctaatgtgcctcttgtagccatctttggtttgaaccaactaaacttcaggtgatgttgaaaacaaataggaattaatacatgaagctttatatcttccctctatagatatgttaaatctcaagttaccaggataatgtgattcatggcttattttccagcctggagggagtggttggtccaatctggagggatttattcagctgctataactactgttgacagtatggggaattggccccacaattccccaaagtctagggactgtgctatcccacagaaacaaaactgctaagctgttaacaagaggtggttcagatctttggtggttaaatgtagtttaatcatgatttacgggggcccggctctttttcctacacctgcctgtgaacatctcctaattattcatttgagaaaactctgaataaaaatatcaatcttgaatatgtgtgtgttccgaggaagaaggccagccatgtccaaggaaatgttcagtcctgtttcatctaaggaaaataattcccaaatttcatccacaggctgatgcttaggagagactgaagtgcttttggatgagttcaaaataaacactccctcctaagttatctcttttgtccttctggagaaaatgagaagggtaaatgacgttccatggaatgatcacctgaggaaagcaaaattaggctgaaacaccccc

SEQ ID NO: 105017 - DNA, 1059 bp, Homo sapiens
acgatgtgcagtgactattgacaactagatttagcagcactctgtccagtacaatacccactaggtagctaaatttaaatttgttaaataaaatgagaaaaacagtgcctcagttgcataagccacacttcaagtgctcgagaacctcttgtgtctggtggctactgaactggacagtacagattatttctgtaattgcagtaaattctattagatatcactagtctagtcatctatacagaatgatagtattatgttaaacagcctcatttttaaaaatcaaagataccgtattcacaaccacactggtatctgctgtttacttctactcttaattccatgcaaggatgaattcagaatgctcatctaggagacctcttagaaggagctcgagttaagactgcttgtcaaacaagttccctgtgcttttaagcactttctgaaatacagagtttattccttggctagcaaacatcttcagagacagagtaagtagtctgatggggaaaggagaatgacaatagcccatttggtaccagggatagctgctgagttgtctctctacatagaaaaaccttactgttaaacactcaactgtgatatggatctaggcacctctattaattgcttgagttgctacataaacagaaaatcactaggcaaagaatatacctcttaggcaagaattcctttgcttagaagtgtgcagaagaaaatctgcctatatacaaaagagcaatggctaaagtgattgagagaaacttaacaaaggtttagatattcaagaaaaactggagtcaaggtaacataaaccagagatgtgtagaaagctggaattaaatgtatgaacctagagaattagcctgttttagtacattctcttgaaaacaatgtttttctaatcagtcatgaattttaaagctctcaatcgttaagataattgaatagggtaagatttgaggtgttttttttttttttttagaggggggagggatagtatttccttttgatttcaatgagaaatgagttccaagactttaaaagcagccattaaacatc

SEQ ID NO: 105018 - DNA, 1096 bp, Homo sapiens
agataactggtcttacacttaggttagcattatgattctaattttaaaagcaccattatttgtaatacttcctaaacataagcgaagtttaaggagtgatagttcttaatactagtctttacttcctttcataacttttaaatctattgaaaaaaaatctagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactgtgttctctgtctctttactgaagataaaggtgtagtaaaagctcccacacacctttaaaataaatatattttattctttgccaggagactccatggaaaaaggtaaacagtatatgaacatagaaagcattgttaaacaaacaatctcaatgtacaaacagagccagtgaaagtacatcacagacttgctaatatatcaaaaaaaaaaaattccactagtgcttaaatgagaactaagaaactgacacttgtatctgttaaccactctaccacagctttcactctgcttcatagtgattgaacaaggtcaaaggaggcagattctatgcctgtttctttgggagttgttaatattaattagccccttggcatcaagaaggctggaaaaaaaaatcccaatatcaggcatgaatcaggaaggacactagagttacatggtcca

SEQ ID NO: 105019 - DNA, 1042 bp, Homo sapiens
agcagagagaaaccatttcattatttaaggcgactcaatttttttttttgaagatagagttttgctcttgttgctcaactggagtgcagtggcgcaatctcagctcactgcgacctcccgggttcaagcgattgtcctgcctcagcctcccaagtagctgggattacaggcatctgccaccacacctggctaatttttttatttttagtagagatggggttttaccgtattggccaggctggtcttgaactgctgacctcaggtgatccaccccgccttggcctcccagagtgctggcattacaggtgtgagccaccacgcccagccaggcaactcagtttctaatcagctataagaaattccatttatataggactctcttcagtttggtttgttggtaagtatattgacctgtgaaatggaaatttgcttactaggaaaaccgtcttcagatacagtccctaagcccaagagagccccaaaacagaagaaagtagtagaggctgtaaactctgactcggattcagaatttggcattccaaagaagactacaacaccaaaaggtgaggattatcttcttataaccctttaaacatatgctgtgtggaaaagattgaattttttctacctcattgaatttagagaggctaggtatctattttgttttaaattgctttactcctcagtaagcagtgtgtctaggaatcagtgctgaatatagtccaaaggaggcatagcaatttagttcagtcactttgttttacaaattaaaaaattgaggctcaaagaggttaaataagaatccctaagaatggtccaaattctcccctgcagccaactcactgaaagttgttattaaaaagtcagatcagtactccacactaactgtgacacttatagtaatgggctagatccaggactcttaggctagaactttttttctcacctaagaaataactgtattcagggccacacaaggaacagcaccagttctccatggcatcccctctttaactccagaatctggaaagcccttgaagat

SEQ ID NO: 105020 - DNA, 1016 bp, Homo sapiens
tcaaaaaaacaagaaagtttagcacttttaaaataactgtaaaatttgttgtttgtgattgcaaatatgggaaacattgtatttgttgtcatttgtataatggctgtatgagacaaggccatattgactactttcctcagtgtttttgattaattattaagtatatcaataagtacattagtttatgctctcctaacatgcacagtattatgtggtagcctcctggaaagtgtaagacagacattaacactaccagataactaaggccaaagttgttggcttttattctgtaaatgcttgcttttatttcttatggtatttttagagatggttggaatatacttcaaatgctttatcagtaataataattcatgtatacaaagctaggatttgagtttaacattcatttttatttttcctcctagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagagtaagtaatgctatttagtgatgtggtatagttaattgttgtaaacatttgccaaagatattatagtgagctcttctaagaaattgttatcattctaggcaagttcttcttcatgaaggaatcaatcttgttaatattgcagctgttcccatcacagttgctgtagtttaaaggaaggattggcaaactttttccataaagggctcaatagtaaatgttttaggcttcgtgggccatattgtttctatcacaactacttaatgctgccattctagtaaaaaagcagccacaaatgatatgtaaataaatcagtgtagccatgttccagtaaaatattgtttacaaaaataggcagcaggtccatgggatatagttggacaacccct

SEQ ID NO: 105021 - DNA, 1020 bp, Homo sapiens
tctataaatatggatacataccttattgctattcttttgctttaggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcaggtattgtaacacatttaatattactgtatattatagtttaacctatacgttggtattgttagtattatcagtgttgtttaagtactaagccattagtatttcagaagttaaagttaggaagaaggaaaaaattgccttatagaacagtctttctagcaaagttggacataaatttctctaaagtgaatcatgtttctttcctgatttttattataaagtttggtttatattccttccacagttttaagatgtttgggaaaaaatgtaccttgccacaataccagcaatgatagatctattaatattagaagtgctttgtggttttgtttttgtttggttttctaccccttatatcatgaaaaatttcctcccgctttaaaagtctgagtacatagctctcttttagataatgatagttgtgcgggtgaactgcagaatcccattttgctgttataataatatagtacttataagaatataatttgatcctttctgaattttcattaaggagaagtgttgaagttattaacatctagtgagttttctattttgtacattcttctgaaattttgttatttgaaaatttgtcctaatttattaaaatgaatgatacaacattgtgggtgtttacctctgggaagtacatttttaattatatatcagaccttaaattctttggttctgcaatcaccaagtgattgaatttctttccctagtgtacataggtagcataatataggtgaatctttaatatgagtaagttatatgaaaatggtttattacattaaatgctttaaaattgtatttacatac

SEQ ID NO: 105022 - DNA, 1077 bp, Homo sapiens
gcctgagttcaatctaattatattggcacttttaacttctcatactttctgactttaatttacatttaggaggttttttttcatattttctattacgactaaagcaatagaaaaaaataacttcatacttattagcagaactgcctttgtatatgatttgctaggattttgatgatactaggttatcagaggtcttgattccataatatatcacgggatccaagaattggcagagacttctcaggtcatttagtcactattgccccctcgtattacaaatgggaaactagttagatgaattgggattacaatccaggtcttctgatttagaattctttattttttttccattatttaatcttgaattagataagttaaaaggaaagctttattctttactgagtgaataacatttgtttcagtattttatgaagtagtgattatcttttctaagaagttgtttatgttccttctgccttatgattatactttagaaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaaggtatgacatacctcttgtcattgatagactcatttctataatgaaatatatgtataatttaaaaaattttaatgcgtgtttaaatcatgctttgttttattcaaaatatatttcaatggtaataggaaatccttctatgacagcagttgatctatagaaggaaaacatattggtaaaggatcacatattgtaaagagctacttaattcagcttttaaaatgagaaatagaaacactccactcagctgccttctaagttaaaatcttggaagccggccgggcacggtggctcacgcctgtaatcccagcactttgggaggctgaggcgggcggatcatgaggtcaggaggtcaagaccatcctggcaaacatggtgaaaccccgtctct

SEQ ID NO: 105023 - DNA, 1041 bp, Homo sapiens
atgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactataggtaagatacaacctttaaaaatttgaacattagttaaaatggaaaaaaaactttattaatagaagacatttttatcagtagaatataagcaaatacaaattgaatctcttatcttgatcctaactttatttttccctcacatagagaataggtcaaagaaagatttgattcaaatgttagtccagagaggttatgaatctgacccagtgaaagcctggaaagaagcacaagaaaaggtaatcatttgcagaaaaagacattcagagaagcttttaaaagcaacttccaaaacaaacaaaaattcaacccctaaattttaaatttagtactactaaaggtgctgagttgtctatttagagactaaagtcttctgtttatccacagaacagataaagtacaggaatttatagtacacacccaccacaaagcacttggccagtgtgactcaaccagagcctggagaaatgactccaggtgtgagaaggtagctcagtctccttgaccttttttcctgagtctgccattaaaaggtgttgtggtggtggtttttgtgaggtacatgtatattacctgggaatcagactggttgcacccagaatcagcctatgttcacagtatggcatccagtcaccactcacttgatctggttttggttaatactgggaagacaagagacaaaatgttaattattatagacagtatttatcaaacaccaagctctgcctcatgcttagatttttagccagagatttaaaccctggaacttcagattaaaagtctgatgttttattaagtaagttgcccattgcagatcacaaaatagtaataatagttaaatgaatgggatattgaagctttgagagtcccctcaattagctt

SEQ ID NO: 105024 - DNA, 1795 bp, Homo sapiens
agatgaatgatgaatggaatggggttgggcctgaatatgtgtcaggacttgtggatagagtgaaagtgagaatattcaaaatagtcaaacaaaatatgggagaagagtagtggttttgtaagacaaatcattagagaaaaaattgaaagccagattgggtccagactatgaaatgctttcaatgtaaggcccaaggagtttgaatttaaaggatattgatctaggagagaagtaggtgtaggggaagtaggctgaaagaaagtactgttctaggaagactaggaaagatgatactaacattttgagattggaggatgttcaggttgtatgaacagaagctatgaattcaagcttaattgatcagttggaaagggacaattgaggatgagaaattctgtttcagttgtgttaatctgtcaatgttagaccatagactcatggtactggtactcaagagagaagtcaatgctatttacctttttctctacagcttccaaactacaaaaactttaaaggcacgattcaagaacttggtcaaaaccagtatgcagtcagtggtgaaatatttgtagtggacagaaacacagtagaaattacagagcttccagttagaacttggacacaggtcagtgtaaatatgtgatctgcctgagggaagggcagtgtattaagcaattttttctggtaaggatgattccaccgttgttggtcctaagcgtgcgtagtgttaaaaaattcctgtaccttcttttacccttcagttgaatttgtgctttgaatatttaaatagtatttatatctaagtagcgtagtatgacttatgttaggtaaggcttttatagactattatctttgtatttatttaaaataaaaggagtagaatatgacagtgtttttaattcttgtaaatatggtcagtaaattcatgtcagcatcagctttacaaatctaaaagtatgcatgtcacctcttgacagttccagttgatgtcatccttttcatactcagcctttatcttgccctttagagtatgagtgggtcagcaccattacttcttatgtcttttcccaccaccgagatccctgtgtattgccttctatactgattggataggagatgatagagattgaggtttcctttttaattccccatgagagttgagaattttcaagactgtatgacttgtagtatgagaacatgagagtgtgtcatgaaaagaatcactaatttttaaatctttataggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtaatttattagatttactgttaatttaatctttcttgcatggtataagtcggattattataattggtttcatgatgggagtggctatagtaagcctgaaggcatttttttttttttttttttcccatcctgcagatttgctgaagattctaggggcacatttctttcttctagtattgtccactacccttattctcaactctgtgtttatgcatctgggcttgaaaacacaggatacacacatcttcacacacattgactaaaagttatgagagtggttattgcagggcctttgtgtactttatggccatctctattagcattttaactgtagagtactcataactcta

SEQ ID NO: 105025 - DNA, 2503 bp, Homo sapiens
tttcctgatgtgggatacttagaatagatttcaggctccttgatggcatgctggcaatttagttagctacaaatggcgttttggttgtttgagtgtttggaaactactgttaaaggagtttggtaccactaggtgattctttaaggccagaatgttgtctttcaattggcagttcacttttggagtagatggagatggcataaaaacatcttagtatatacctgcagatggctttctaggaaaaaacaaacaaacaaaacaaacgtgttagtatgtactcactttgttacagaatctcaagtaacaattttactggtgttcttgaaaagcaaattgtatctttgctttattcccctgaattgttacaactatatcttgaagtaacattttaaaagagctcttttaaaaataggctttaaacctggccagcggaaagttttatttacctgtttcaagaggaatgataaacgtgaagtaaaagttgcccagttggctggctctgttgctgagatgtcggcttatcatcatggagaagtaagcattaagattggaatcaattgagaactgtaattattgtcttgaagaatgataattacacatagtatttttcctttagtaaagtctttggaaatgtaaaagaattaagagaatatacagattagtgagattctaaagcctttattcttcacttggattttaattcaagttggggagtaattatagaaaatttagaatattaatgttatgttctgccttcttctgttgtatagcaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaaggtaaatatttgctgatataatggtataaagtttgatttgatttggaaccaactaactaaatgttcgatggaattatagctgtggagagatgtgattatctggttattctacttagaaggtgaatgttccaaattatttgaccacaaatagaatgaagtctgttgaccttaatttttatgaattgttggtgaaatcagtcctagtgaattaaggatgtttttctcaccaactttactctttaggctgaagatgggttatgtactttatttagagtaataggaaattctttaaaagttatcaatattaaatcaggtaggtaagtacataagtaaaataggactattttattctgggcttgtaactgagagaaagatgcatttgaataatacagttaggcaaattttattattaagcggatgtaatcaaaattattaaaaatgcattctcttcaaaagatttgtttttgcagtgtgaagtttttaattatgtataaagttttctttcccaaagccatgacattttttcatttgcttctttttgttttcattagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatggtaattatttggaacttattatttatttaacaaatgataatgtgtaaactacaaattcccgtcattttagaaaagtaatggaacatttttattttagaacatattgtagaccgtaaagacctaattagggtataatttgatatgtgcctacagtaaaaagtataaactttggaatgagttttggaggtaagtttcatggggagaaactgtttatttaaatttagaaacacctcatattccaggttttcaaacctctaaaccctatattattagaaaacaatccttttctgataaaattatgtgtaaccttgtttctgttctcaaactaccgcttaatagtttgtaaggatgcttaaaaacacattgtattcattagtgtaccatttgtaaaaagacagaaaacaaactaccttgtatatattttaatatatccccaaggctgggcgtggtggctcacacctgtaattccagcactttgggaggccaaggcatatggatcacctgaggtcaggagttcgagaccagactgaccaacatggggaaactccatctctactaaatatacaaaaaaaattaggtgttgctcaggctcacgcctgtaatcccagcactttggaggccgaggtgggtggatcacctgaggtcaggagttctaggccagcctgaccaaaccaggtagaaccctgtctctactaaaaatacaaaaattagccgggtgtgctggagggcacctgtaatcccagctacttgggaggcagaggcaggagaatcgcttgaacccaggaggtggaggttgcggtga

SEQ ID NO: 105026 - DNA, 2108 bp, Homo sapiens
ctgaggagtgggtcataggttcgttagaagtacaggaggcctaggacttgtaactggcatctgaagtgtggggagtcctgtgggattgagcccttaaccaaccctaaatacttgtgctaactccaggtagttagtatcaaaattgaattacattgttgaacatccatttggtgtctggagaatcagagaattggttgctggtgttgaaagcacctgagaattggtgttagaattgaagtgaggaaagcaaacaaacaaacaaacaaaaaaaacacagcggttggtttattggctctgtagccaaaatgtcttatttttttaaaatctcaactctcgttctgagactctattactcttttagaaaatagggtttataatacagataaagtattttgctactttaacaatacaggatttcagatttcatatatttttttttctttagggtggacggcacgtggattatgtggtagatcaagttgttggtaaactgattgaagtagttaagaaaaagaacaaagctggtgtatcagtgaaaccatttcaagtaagggatgtgttatatattgtacatgatgcatacatatgcattatatatatactgaattactaaatatcagctctgatattgacttttttgggtatgttttcaacaggtaaaaaaccatatatgggtttttattaattgccttattgaaaatccaacttttgattctcagactaaggaaaacatgactctgcagcccaaaagttttgggtctaaatgccagctgtcagaaaaattttttaaagcagtgagtaaaacttgtattttttttattgttgttattaagagttgattaggtagttttcttgatttactttatttgtgattagtttctttcatcgtattaactgtgggtataagcatgcttgcactacaaactaatatgcttaatttgataactttaaagggtagactttaatgtttcctaaaacaattgttttgccaagaactaaagtagggaattatgtaactaattgcatttttagctttgtattgaccattgtaaaggtcagatttcccctaacagatgtccagatccttatgcaactctttcatcttttctactctcatttcaacttgatctactgattcttatctttatacatgtttaaaaattgtggtaacatgtataacaaaatgtactattttctacatgttcttaaattgctttgctttgcacataatttttttaggctaccttaacttctctaaaataaggtgagagcacaaataaataatggagatgaatcaatcacagcctctcctctttggaattttggtggggaaatgctctataactgccctagaactaatgtatttctcaaattccaaaaagtagattatcagaaacaaaaacaaaagttgttttttaggttctaacttaaggcctgtagaaatagtacttttggatctaatcttaatgaattctgagtacaaattatgctatattaatgctttcccaaatttctgtcctcataacaattgtttccttgatgaagtgatttgattttaaattttatactttttcattttaggtgcactaagtttaaatttgacaacacagttcacctcttttgtttatgtcttaaacattccagaaaactgttttatacacctaacatcaaatcaccgaggatgataaaaaaacttttaggacttagagttggagatgcttaactttcttttcctttttctgtctgggttaacatcttgccacagattgattcactgcagagtacaaacaatatgtaatgttgaaatctttattaccaagctatttaaagaataaaagtctattcataagttaccaaggttatcctaatgttccttttaggttaatactttttgtcatagtgaattaaagactcacgttttgtattgaaggatatcagaaatgtcaacgtctggaatttgccggctagtaggttcatgtgtggatctgttttcactgtgttaattttaataaaattaatttgtaacaagagcaatgcatattcctcatggagtttattataatagaatgtttctcatatgtaaaagttatcctttttcatgtatttat

SEQ ID NO: 105027 - DNA, 1040 bp, Homo sapiens
ctcctacagacacttatgtctctccagacttcaggatggccagctctcctgtgatctcagttcttcagtgggttcatgaaaaacccattaatttgttgtctgatcacccgttttcttacaaggatggaagctttttttcctgctagttcattatctgtctgaactgaaactggaagtctaccttatcattttaaaaatagaaatttctgaaatattttataacaatttacctgtcccttcacatcctctttttgtcaagtacacatagaaatgaatttcttttttaaaggtcaagggttaaggaatagatctgggaaatgccactaaggtttggatcggtgcacttagaactgttgtaagtgagaggaaatgaaagtatacgtactgaaggtgattcacctatttgagctgccagtgtaagatttttaattgtttttgttttttaaattaataggtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaagtaagtaagcaaattatttgtttccaagtcagtggtagaacagtacttcaataaaaactacaaaacaaataacaatatccacaacccccaaaaaacccaaatctgtttttgttaaataagaattgacttatgaaaacaaaaacctattttctatgaaattgctgtattaaaatttatttaaacaattattgagaaataaatttatatgactagtgtttgtagttgaacatatttatattttatgaaatttagaataacaaattcctttttctgtaacttttagccccaccttccccaacctctggggagaggagagggggctggtgactgagttaaaaatcaattatggctatgtgataaagctctgtaaaaactcctgaacaatggagttcacagaactcctaggttggtg

SEQ ID NO: 105028 - DNA, 1117 bp, Homo sapiens
ttttaacatgagattattatcacagtaatacagttgcctcaggaggattggttctgggatgccctttctataccaaaaatcagaggaggatcaagtcccttatataaaatggggtagtatttgcatataacctatacacatcctcccatgtactttaaatcaactctagattacttataatatgtaatacagtataaatgccatgtgaacagttatgctgtattttaaaaatttgtattttttcccaaatatttttaagctgcagttggtcgaatctgcaaatgtagaacctgtggctacccaagggctgactgtatttactatttttttttgtctgtaatattatcaaggatttgtttggtttgttgtgaagttgtaaaattgatatagtttgataaatgaatgaatttaatgagtgtagtctttatatattatgagatatggaagcattatagaaatatttgaatttttttcttttaaagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaagtgtcctgtaaaatagttttaatactatgttattttatagagagaatattgttgggtcttccttttttaaagctcatctggtagtctcttttactggtgtgttcagatgattcacatttaaagtgattattgatacatttggccattatttcttcaaataatgcttctgtcttgttctttcctttccttcttggttatatatatgttacattatttgatactgtctgcagttcttgcatgctttgtctattttattcactctacttccactttttgtattggtttaatttctatcccctctcttcaagtttagtcatttgcagtctctgcatcaagtttcctgaagagcctgtcaaagacattcctcatgccttctatgttttttgtttttaacatttccatttgattatttcttata

SEQ ID NO: 105029 - DNA, 1020 bp, Homo sapiens
ttcagaggtcatgtattttgatttttaaacatacttaatgatacagtttttaaaaataaaaactttaaagcggaattgaaattgcatactgcttgtttaaatgcacaaaatctctgtatctcctattatctgtattctgtttctttaatttctactaaaatttgaaggcctctgaagatattttaattctcattgtgtcttttgagttattttttgattctgaaaagataggccatcacaatatctttttagtgggatgtcatatttgtcagcattaaggaatcccagaaggagagaagtatattctctgctgctcttaagaagacaaggaaatttgtagaccttggaaatttgatttgacatcctcatctgctgtaggaatgtttagaattaagatcaccaacctgtgcctccttgaaactggtagagaaactgggatcagtattgggacacccagagctgatatgtgaggaattattggcatgatctacaaatgtgtgaaatttgaggattttataagccatttcagtcatatcagtgtttattaactacataggttaatattttgtgtaggtcatttttgtttatactgtagtcttcagtagcttaatggtgggaagcttacatctggaagcttttggggctcctgcacctagccaggttcagtcattgtgattctgtaacttcaccagaactcaaatttcttgggaggttttgaggaccacaaaaattaacttgagtccaggtgtggtggctcacacctgtaatgctagcactttgggaggccaaggcaggctgatcacctgaggtcagaagttcgagaccagcctggccaacatggtgaaaccttgtctctactaaaaatacaaaaaaaaaaaaaaaattacctgggcatagtggtgcgcacctgtagtcccagctactcaggaggctgaggcaggagaatcacttgaaactgggaggtggaggctgcagtgagccaagatcacaccattgcactctagcctgggtgacagagca

SEQ ID NO: 105030 - DNA, 1032 bp, Homo sapiens
tggctcactgcagcctcgaccttctgggctcaggcaatcctcccgtctcagcctcccaagtagctgggactacaagtgtgcactaccacacctggctaatttttttttgttttgttttgctagagataagatttggccatgttgcacagactggttttgagctctgggctcaagggatctgcctgcctcagcctcccaaagtgctgggattacaggtgtgagccactgcgcctggctgcaatttagttttttacattgaatcggctgtatttccctgtttctttgtattgttattttctgttagggctttggcatttgaaggcttagctaactctctggtctttgcggtctggtttcatactgggaagactttcttcatccagttagtctagctagagaatcctgagacctcacaaatcttttatggggatgcatcctctttgggtttgtaatttcttaattgaagaggtttgcctctgtccatctgtctgctccctctggtgtgtctttgtctgctttacttgtggcgtctcgtgctgtagtaaactacagtactggagctccaccttgtgtctgtttctgatactgcagggtctgatgctaaaccaaagcactttgcttttgttttcaatggccctcaacctggcaccctgttcaatgtcagtacttagattcagtcaagaagtttctagggtagcactgccctcagctgttccattggaggtatattccttttctgctcctccccagggagaaggtggaagttgttgttgtcttgtttgtttttctcaatcttgccttgctggggcagataggagggaggacatgagctttgatgctattttatgctcacctggggtgctggaacttatcacaaaggcagttggattgtttgttattgttgaatccttgtcttcatggggaaagaaaggcctggggtttcttgttttgccatctggctgaccacactcaaatgttacctgttttttttagacattatcttagcaagaatggtaagtctttgaacttgat

SEQ ID NO: 105031 - DNA, 1028 bp, Homo sapiens
tgccagagcgtaatgtgtacttgaaactttggggggacaaaaccgcgaacgtaacatacagcccccgcttcctctcttttctttttaaccagactcttccggggcagccgaacctgaaatggtggggatggcgataatgcaagtgtgtctgtgtggggcagcattttctccaaatgtagttcaagaaaaccctgggaaaaggggtgtgtgtgtgtgtgtattctaaatgcagctctttctggggctttaatctcaaagaagaatgcattgggatttctacagcaacttgcacttcaatttggaaagcctcattcaatgcgctcaattgagagcgcattggggatgactttcacagcagttaatactgtaggtcgtccctctgtcagggtgagattattaaaagaagtgcttgtctacgtcagcatcgcaggtgtaacggggtgagggctgaatggatgtcctggagaggtgactgaagtgcttagtcctgaagttaaaggatttcgacgctcagttcttgctgggaagtagaagtaactgcagcggaaggaggaagggagactggattcccacgacagatcgataattcgccggcatttcacttgctcagcgtagagttcagaccagggtcatttcctatacagaaaacctaggtatttcggagaaaagtaaaaagtgttacatttttctggacttttgacggtctgttcccccgtccctgttttaaatacctcaagggagctttcatataggcatttttgttacttagttcgttttctctttgtttgggtgaggtttgggtgagttgaatagcaatttgtgctatattgacaactgcttcttataaaaagggtgctactgacagcagcaaaacattttaatcacttatgtttgcgtgccagggtacattgcaaaataacttgccatgctcttattgttgaaattctttgaatgttgtatattactccgattatgtagaatgaaagtatgaagggactagggccaggagagaaaatgtcagatactaa

SEQ ID NO: 105032 - DNA, 1123 bp, Homo sapiens
ccccatcctcatccttagaggccccaggcaaacgcttcggattcccggttaggtctcagagtaaacagcacgcttggaggattacaatcgacccgaggccaattcgaccctttccctttgccgccctcaattgacccttgaagcagcccctgctctcccttcaaatggaaaacccacagacacacacacaaacaaaaaccccaagtcttcctttcggttgctacccgcaatgacgtttcccccctcgggtcccgcccctccagggggcttggaattttgggattggccgagaggctgtggcgacaaggcccggattggacagcatggcgctgactgacagcgggggcggccgccgcgccctccctctctccccggtgtgcaaatgtgtgtgtgcggtgttatgccggacaagagggaggtgaccgtggcggcggcggcggcggctctgtttattgtccctctcggtgtgtgtgtgtgaggaaatcggggctgcagcgaggctaaggctgcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtggtaagtggctggtccccgggacgggcggctgcattgttccgggcccgcggcgggggcg

SEQ ID NO: 105033 - DNA, 1070 bp, Homo sapiens
aaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaacctttcttccatatgtgactataatttggagtaaagtcttgttgactcaatatgggattttaatctaaaactgtaagtatggttttaaaagttaaataatgatattcatgattaaatgctattcatgattatgataaaatcttgggcttatgatagtaatttgacattttctgatcagccattcatttcttcagaagtggttaaattagagtctcctaatatttttaattaatgtgaaagtacagtagctcataaattatataatgcatgaaaatttatatgattataaatattcaggcatttaagaaataaaatgaagtattttgccttacatctttttagtggttattttggctaaataaaaatcttttttctaaacattgaaaaatacttgaatagatatgagttatgaaaacatttaacattgacaacataaactaggatacattttaaattccataatacgtggacattttgaaaatgccttacctttgagttatatttttatctacctcattgaataaaatattcttgattttgaaactatgtaactatattatacagtatctatatgttgtatcaagaggttttgtgtatattctgtataacctctcaaatttagtgaacatttattaagcatttatgtacaaagcattgtgatagcactgtggaggaagcagtggtgaaaaagacatagccccaagcctccagattcctttgtgatattctgcaaagtgagttctcaactctttatacaagaaaaagacacactcaagagtctcaccctgtgccactcaatagaacgtgacatgtattataaaatatataat

SEQ ID NO: 105034 - DNA, 1066 bp, Homo sapiens
taatttactaaactgagtatacatattcttggtaactttctaccacctctaaaaatgagtctttgacagaatatattgtgcaaaaaaagatgataggaattttctgtataaatagggtgttttatctccatatactgttctttaacataagagaccttttttattttgctcatagtatgtttgaatgtttaaacatttaagtattaaatcatgaactctatcttattctttaactttctagagtcttaaaagctgatgatgcctttaggactgaaaattttaaggctttaataaatgctgtcagacatgttcaacagctactataaaccttctcttaaacagttaaaaccacagttctgacccagacccacacaatataattaaggcagttattggagtaagctagatttgaagttaacgtaatttcagcctatcatattttatacccacacttttgagggacatttgaatctagtgagctctgaaaatatacaagatatagaagtgcatattgagagataaatttgagtatatctgttaatgtttatgtcttaagattactttccttaagtcttttagttcttttaattcacctttcttccagtaacctctctgtttggctcttctttcccagatatccccctttgctagccattcctttaaaggagcagttaacctgtgtgtaacccagatgcctaatagtttaggatgggtgaaactaatgactcccggggaacactggtggagtcctgagtcccacatcctccttacaagcggctgtaagaggagcatgcagtaggaacatatatgaacaccagaggatgttatagtggcgttgtccaaacttgagtggagcaattgacagttccacatctaggtttgtcaacaacaaataacagttggctatacatatctactctgagtagtttaagaacattttctttggagagtgattgttcagttgttacataatctctaactcactgattctaaaaattttcagattaaattaatgggcatacctggaagaaaaatagctataggttggttgtcaaatagatggtga

SEQ ID NO: 105035 - DNA, 1052 bp, Homo sapiens
aggtaggtcagataaattatttatggtcagctccaagaaagcaagttgtggggagattagagtatatttttagtttccatagcctgccttagaaataataaaggctatgggagttatgagccaggaaccatgaatgaaaatctggaggtatatatacacatatcataatatcacactgagtcagagaaggccttgcagaagaagtaatatctgagttggcttttggagaggaggaagagggaaagtttcttagtatgaggacaggatatggaaggggaggttgtttggggacatgagaaatagtgtcttcaaaagcactgaggtgagagacatctggtatattcaggaaaaagtgagaagtagagaatatggaggagaatagtgagaaatgagactagagaggtaaataattgtcaggtcccagagactttgattaccttgcaattatgtaataggcaaccatgaaagtttcctattacaaatggagtaaattggaagtatacatggaaatcttaaaaattcttatccaaattctacaaatggaataaattggaagtatacacagaaatatttacagtgggaactacaagtggattcatgtttgattttcaacataaaatggaataaccaaaaacaagactcattgcaagtaccggtttaccagcaacaatttgagattccttgaaatacagctgctttgctgggtatctgtgggaatgacggacttcagggtgcttgctgtatggtgaactgaacttgagtgaatcttagcagcctcagtagaacaataattttaagagtgtattaaagaagagcttcaaacaatatagtccaaactgaacctctagggagccatagcagcctgacatgtagtaatcaaaaaatctttgagcaaaatcttctgtagaatattagttacataaagccaacatgcaaattgttctcagtcctgaaaatagtggttacagccacaacctaaagacaagttctatttttatatattgtgaatagtatggcttatgcctaaaccgtagacacacaggtcttgttct

SEQ ID NO: 105036 - DNA, 1054 bp, Homo sapiens
ttaccacttggcccaagcctcactccctcaggtcccagcaaattgaatccatttccctctttatagattcattgtaccatatacctctctttcatgacatgtattcaacaaatagaaatgaaaataaattatttgtctctctctaataatgtttacattagattgtaaacaattcttagggagagaccttgtctttttctactcacttttgtactctcagtattcatatatctggcatagtacccgatacatagtaagtgtttagtaaagattggtgaatgtaaaaatgtacgtggcataaattctgcatcaccctagggctatgtagagcactgtaagaacctcactttgttgagtgtcctttggatggtcttagatactttttggttttgatgagttttatccctctctttgtcactacagtcattttagcattttggcggggtgagggggcgggtgcatggcattatgtcaagaattcattcagcactcagcaaatatgcacattgtcaaatattgtgcttggcagtctgatgtaatggtgaattaagaggcaagcctcaaggtgcgtatcagctggtaaagtgaaagacatgtgggtcaactgtttagattaatgggggtaaatggtagaagagtatgtgtttgtttatgatactgagagaaagaagacagaaacaagagccactaacaccctgaatctgagtgaaaaaaacctcatactccaagtattttgttttgttttgttcactctacaagtatttttttttttctgttctctctacaacaatcaactcagacctctgaccaaatatgtggaggggtgggttcccccaaataagcaagcaagcaattctgcagcagaaccagctgagtgacctctaatccaatcaattctaacatgatcttcctggagataacattagataccaaatgttgagggtttagtccccaagactctcccctccccacttcagatgccaatcacaagctccagtttgttttacctgtgcttctgaccaactggctataaatcaggttcctatgactctct

SEQ ID NO: 105037 - DNA, 1030 bp, Homo sapiens
aacccatgtatccagacgctcagtctagggctcttggccctgggtagcgttttgaaaaggctggttatccttaagtactgaagattgataaagcccacttacttacttaaaagaatatgccctgaaatgtgttttctgtgccactgacaccagaaatgctatttagaagaagttatcagtaatcctgacaaaggatgcttcctgcagctcaaatcaggctggaggtgcctttatatttttcattgaattactgttttggtgactcgaatgaatcatcaattcatttatttgtcttcaaatgtctgacggcacttaaggtctaaaaaagaaggtaagtttaaacagatagtttgatgttaaggtataaattgaaagtatgtaacattttccctgtgttcattagcagctcatatcaagcacccaaaggaacaccttggatgtttttccttaggcccttaagctatttaaaagaatacctcctaggtgtgttgtggtcttttacaggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatatcaagtccatgtcttctcccaccatcatggccattggggctgcagaattagccatgaaggattctggctggcatcctcagtcagaagctgatcaagtggctactggtgttgcaattggcatgggaatgattcctcttgaagttgtttctgaaactgctttg

SEQ ID NO: 105038 - DNA, 1136 bp, Homo sapiens
tgccagatgtacatcttcttagaatagatgtctgcagaaaacatatagacatgctagcagtaactgctagattttaaattgagctgcctaatttgacttattttatgcaggaaaaacgaaatatgtggaaaagatggcagaaaattcaaacaaaatatataatggtttaaaaaaagcgtttgataaagtgaatgagatttactgcctatattcaacaaattcaatggataattgctcaacttgaccactgttttgcctagacagcctaaacttgaatctctaagaaattcctcttggattaatctgattgtagcttggctgccagacccataattctaagagacaggaagattccatctttatttatggagaagttgagaatttaaggctttaattcatagggaaagtgactgtgagaaataccaaggactttgtttttcagtctggattctgagttgcaaatagcagaaactgactctgagctgaaaggagatttattagaaggatatgtgtattctcacagaatcagtgggaagggaggagaactaggctctaaaattactgagaaactgcggaaacaatttgtgaggatgccttgttactgtataatgctgcaaatctaaatctagaaatagtgattattccagtgaaaaaaaatcagtgtcctcgccttgatggaaagaggccaatgcaatcagtctgttacaggatagctacctggttgccctcaacccagataaatagttttatatattaggacttagggctgcttggtgttgctggcagtttgagcactcatcagtggtagtgcctggttgacttttatgggggagattcttctgtctctgttgccatagccactggttcatgagttaactggctgaagacagagattgaccgacatgcactagatacattgtctgattgagtttgctccatagtgaaaccttccggtgaggattcatatagaacataaataccctccactctgggtccattctgagaaatctacatacatacttctccctcgtgatttcttgcacttgttctccagtcttgatccagctacactatcagtcactccctatgaattgggcttgcaccatacactgaacagtatttctggaaaaagtgaa

SEQ ID NO: 105039 - DNA, 1115 bp, Homo sapiens
gtttttattttcctgctgctatgtgttgtgtggttttttattggggtggctagtttgttattttaactgtggctcagaaacagtgtctgttagtaaactgaaaatgattcccaaagggaagatgtactgtggactgttgatacccaatgtttctgctacaaaacctgtgaaaggggtatggtgtgtggccagccaagtcaggagggccaagcaattggcagcagacaacagcagagaaaggtgggaaaggtgggggcaggagagaaagaggtgtaagagaagcatggcaaaaaaaaaaaaaaaaaaaatctatccaaaggaagagaacccaatacttagcacagtaagactaagagatatctgatagtaaacctaaaccaaaggataaggggaaaaaaaaatcccataagaataagagaagacaaaaaaaagagaatgggagtaataaagactgaaagaagagggcttataaggaagaggaatgtactaaataatacctcatagcatagatcagttcaaaggcagcctagctccccagccagagggcaaggtctctttctcacatatcagagtgccacattaatgtggctttatcaatctccaggccaaggtcttctactctgatttactccatagtgccctttgacagtctgacaaagcctgcgggccctggaatggtgtttaaatgcataaaatataatacataagattatagcacaaaccaattttattgaaatatctgtttatcgacttataaaagaaaccactgttactaatatatgtgcctcttacataataatgcctctataacaagatcttgtagtgggactagtggctactattgtttcgaagtaggaatgggcataaatgctactatgagataactgtggcagctgtattgtgatatgaaaatatttatattggtgacataatcactagtatggctactattgaggtttatggcctgtgttcaaatgggaatgagatggtacattgccatttaagcttcacaaacaaagttgcgacttttttttccatgcaagttcatggatgccttgaattctattggtggatgccttgaattctattggtagatgccttggaggtctctaacc

SEQ ID NO: 105040 - DNA, 1056 bp, Homo sapiens
agctcccagtggcccccttggctaggttcactgtagccttggccaatatcacctgaaatgagggtgaattatcagactacattgcatttcagccaaaagtttcaacttcccctccaacaatttctcttaagtagacttgccaaaatagtttttaaagattcacttcgtttcccttcccacttcccagttatcaggaaatggctttggcacaggcaggtagatggagaaccatgggaaaaggtcaggatctgaagaatttttaaagtagataataaggccctaagtgataaagagggaactgtggtcatggagtgtttcctaaacagatggctcatgttatccagtgttgggagaagataacagaatgtccctgtcttggaaattagcatgtttttgtttgttctatttgatgaaatagaacctgcttagtagaagaagaaaactcttctaagaaaggctttgaccttgtaggggtggcaacatctcagaaaatgccctctttttgtgcacatagactatttgggaaccaggcaacctagttctagttccagctttgactctaaccatctctgtggcactgggctggttacatcaaatgttctgggctctacttcccccgtaagagggaaattaggagttaaatggtttctaaaatccctttcagttatatgggtttataatgtcaaggatgtgtctgacattgttttatttttactccatatgatgtcttctctgtttaagttgactcagactcatttctttgcttagggcttccagcccttatatgttacagatccaacaatgatagatggacactctgcagtcctgagggtctgttacatctggagcacttctgggagcctacaataaaaggatgagggggagtgacacaaaaagagcaatagctgactggtaaagggacaaggtacaaaggggtgaaacaattaataacttttcttgcagcaataattgccatgcgggcaagatgttggaagatgaagaaggttcctaagattttgactatgtgcccatcttgtgtccaactctttataacca

SEQ ID NO: 105041 - DNA, 1013 bp, Homo sapiens
gagcccttatagactctcagacactccatctccctaagggttgaaaatgatgtcttttcttctaagttggagacaaagtagaggaaaagagagaaatgctggtacatttaaagtgaaaaatttacttagtacacattcagtctctccctgactctcactctttgtaaatattttaccctcatgttttgattaggtgtttctcaaacttgtaggccaggctagcatcacaggttcagtaacagtgcatctgggacaccaggaccagtcctgacaggttaaacaatggtgacctcctcacagaatctgacctccttctgacagtggccatccctgggtggctttcccggagaacagaggtgtcatcctcttcatctttccagattttagttttcatgaattaaatactgttgtttccatttccccaatgtgagaagcttcctccttttgttttgaacctgattgtgcaaggaggagccggtaattagtggctcaccctctctcctgctctttctccatttccatatggacttccataaagaggtggcaaaatctgcattgttaagggtagagtggcccacccccaggacttttaggttcttgagaggctcccatcatcttttagccatccagatcttcattgagcaaacatattctgagcacagactatattatttgctccaaggcagctctgcggatgcccacagctgtaacagtcagatggtccgcaggccccccaacacatgggtgtcttgctctgctctgtccagtcctcccatctgtgacttttggtgttggtgaattggaaagacgaagaggaggaaatgctcagggtggattgtgcctctgcttagactgaatgttactaaatcagggaattgaggagaccccacctggttccccaccaccttcttcctcttacatgctgtgactctgcacaaagcaaaagccataggcatggtaaaaatgtaaaacatgggtgtacctgaccaaaaacaggtttgttgagctgaata

SEQ ID NO: 105042 - DNA, 1128 bp, Homo sapiens
ttgtgaaaaatacggtgctgtggcaccttattctcattgcctgtggcttgagtaactgaagacgttttcatgccatatgaaaggtatttagcatgctgcattgattccttatcagattaaatctttgcttttaaagagaattgatttttagcccatagcaattcttgaaagtaaacactccaagatgaagctgccctttcccatcaaaggttagacaccctaaatccagaaaaatcttcaacgtgtaggagacctgttcacaggtagctctaggttccggtgaagtggctgcagcacagccttcagcatcacttgctgcctcttctgcttgcaagcttggtggtggatctagcgcgtctctggttgctacggcgattccccggcaggcgtcatccgtcgctatggcgttctgcactgcgcagcatggctgctcccgattggctgaggcgccccaggtggcggaggaagaattgtcggcattggcctggccagcgctggttggtggcctggaggaggatttgattggaaaaccaacggtgcagctggccgcggtgtccctgaggttgaggggaccgggaataggctggggggaggacgggacgggctgagactggacgggacccccggtctgcagcagcaggtgacagcagcagggacaatgataaggagattggcctgaaggagggaccgtccctcccgcgcggtgagtaggcgggagccggtgctcggctgtgccggcgagcagcttgagtcagggtctccggggagacgtcctcaggtccctgtggagcggccccgaagcctcgggagccagcttcactagacaagaggcagaggtagagaatgcggctgtggtgggtaagtgagtcactgcgtgaggcagtcttttcaaagcaggtgggtttgtgttggacggatggatggtgggaaagcgccatcaacgatgcttcttggcgcttccattttgataacggaattattctggttaaatggagcctgaatgtgtctcttccaatctgctccgacgcctctggaggttcattcttcatctctatgagcgtcgcttttctgccttctccttacaggatgctgctttgactttgcccctctgcttttctgccctacttc

SEQ ID NO: 105043 - DNA, 4576 bp, Homo sapiens
ttctgaccatatactgccctattttaaggaccccctctttagttgtaagaaaaacatgaatttaaattgcaaagaggatttttaatatttgcaatttttaaaaaacaatttttaatatttgcttttccagttatgtttattgatttagaaaagctaaaattagcaagtcataagtttgtagtgttaatagtaatctcagaaggtttagtatactcattgttagccatgtttagaattgaatatttatattttaaaattatttattttaattctttgttttaaatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaattagttgttggctattgtctttactttgtactctgattattagaagagccacatctctctctcagcttgagatgggataggagaggaaggaaaatgagtgatgtctgtttccggcctcctaatattcctaggcttcagtaggagagagaaaagaggaaacactgagaaaa

SEQ ID NO: 105044 - DNA, 1050 bp, Homo sapiens
taggtagaattctgaggtgctgtgaaatactctatatacacaggacttctactacaaaagataaatattataccctaaatgtcagtattgctggggttgagaaaccctgccttatccaaatgacattctgcccatattgtattgtgataaggtttcacagaatgttatctctcattataaacctacataataattgataatcacatttatgtagttaaattgtagttaaatcttaaatagtataagtgacagtgatttacataaagaaatgaaagttaaattagtcatgttttacaagtggttgtttttattttatgttacaagtatgtgttcatgattataaaatttttcagtaatggcagttatatttaaataatgtcagtttgggtttctaagtctgtaaaatgttataaattagtcaattctcttggaaaatattctgggaaaagtaacctcttcacacatgtgttataaaggaagctgaacggatgcttcaagatgatgatgatactgtgcaccttccatttgaagggggaagtctcttgcaaattccagtcaaggccctaaaatataggtgagatatgactttatgctctaaaacttttatatgcatgtcaaatgtattaataagtcatataatgcttctttaaagtgatgatttctattttataaaagatgatacaatctgcatatggtgtatcaactaaaggagggcttcacacaatttgaaaaggaagtcccttgctcctttcccacccaagctggacttggactaacccaagctggacttaaactaacttccatgccaagccaataaaatttgcttgtcttctatcactccatctatcttagtgaagtttaaaatcagtacatgagtctgagaatatttccattttcccagtagtgtggctttttcctttgtgcccttcattagggctggggtcggtgggtgctggaaaataaacgttttcagtaatctttgtcagtgtccattcaaataccagtaattcattttctgatagccttccaatatgtaactatgtttagagg

SEQ ID NO: 105045 - DNA, 1476 bp, Homo sapiens
ggttcaaagcaggttagagaagaagctgcaaggttctttaaggttaagacttagaaatcacatagtgtcactttggccttattctgtgggttaaagtaagtcacagggtcatcctggtttcaggggggaaggaggcagactccacctctaggtggaaagattgactgagtcaaatgacaggaggtatagttatagggataggaagaattactgtggccatctttgaaaataattcaccatgtagttcaagatttaagttatttcccattcgttgggtatttcttggaacagatcaagtctatgttatggaaatttagtgcaatacagcaaggagactttttgaaaattatatttaattttttaacagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaaggtaattttagaattttgccttaagcattgtgattcttcaagggtttgagctgtttttgtaatgattagaacattaaaagatgtaagatgaaaattagcttcttccctctttataattcgtgtagaattttaaattgagggaaccatttagacttacagatatttatgttcatttcacttttcagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaaggtaaaatttctttattgccgtgttttacaatcttattataacatttatacttagttatgtgaacatgaaacattaaaatatacttaaaatacctaaaattaggtttgttttccacagtttacttgggaaataatttcattaggtttttagtatagcaagcatttcagtggtaagctgtatatatttttaaaataatgtataccaggtgtagtggcttacgcctgtaatcccagcaatttgggaggccaaggaaggaggattgcttgaggccaggtgttcaagaccagcctgggcaacataatgagaccctgtctctataaaaataaaaataattagccaggtatggtggcatgctcccgtggtgccagctgctcaggaggctgaggtgggaggatcgcttgaacctgggaggtcaaggctgcagtgagccgtgattgggccactgcactccaacctgggtgacaaagtgagatcctgtctcaaaaaacaaaaaaaattataatatggcaaa

SEQ ID NO: 105046 - DNA, 1041 bp, Homo sapiens
ttttttatttatttctttaagaatgagccttaagatcaacaaagggtgactgtgagtaggtagggcttgtcagttataaagaattaatggtagtataacttattgggaatctatatgtgctatgggggagtggagggagacagcagtaactgctatggaggttgagtagataagctttagtggagactaatcttgctaaacatggtggaatcatcttagatttttaagtaaaatagtgccctcaccaaggacataactagcttcattaactaaacgttttgatatttgtattggttttattttatttctataacccaaactttattccattctgttgtttctgatgtattttccactttctagtctccatgcttctcaatgtgggaaaaaaagaagttaaaatctaccacattgtataattgatttagtaaaatgtaagcatgaaattcaggatccttaaaaatgtatcctactctaatttctcagatgtgtatgtactgaacctccaaaccccagcaatgaaactctagcacaatggaagaaagataatataacagcacacaatatttcctggagaaatcttactgtttctgtgagtatattttgaaataaagggttttgtaatagatattgatctggttcttttagctttttctaatcagacatccattttctcttgattgatggatcggtagtatgttttcagaatgtagtgttattttgaccagatagcagttgctacttttttatgtatcatgcgctcgaaagtgtaggctgaaaagaatgaaactggcacgagagataaaggtggattatatttgacttccaagatatgaacagtataaagatgtgaatatacttctgttttctaattctacttagattgatacgttcaaaggaagtgtttactgggactgtggctacatatactgtcctttacaatattttatatccacttgtcctgcctttttatctgttcatctgctccatcgacagctaatttagatcatgaagtgctgtgttaatgtcctaatgtctaag

SEQ ID NO: 105047 - DNA, 1038 bp, Homo sapiens
ataatggtgggagaggagggtagtggtagtgatggtaatgatgttggagctggttactgtattgatacatatgatgtctggatctttagagggagtaagatgcaattgttttttcatatagacaccatacctgtcatttactcataactgatttataaagtgagctgtaatgattttgaaatatttatcgcctggtagattttcactgtaaatcttttatataagtgtaataaactattaataattaatactaattaatttattaataataaatctactaataagctagtcttcagccgaagcagaaaaagatatagagttatttctagatgttattttgtcattctgtaattcattctcttttaggaatcgtgttttcttgctgttcccattgcttgcaatgaaaaattttaggtacaaatactattccacatatgtttatcatattcatatttttctttctaaacagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcgtaagtatttctcttttctcctaatattaaaatgtgtttttacagagatgtcagagcctcagaaaatgaattttttttgcagtgtgatagtgtaactagctataactacttaactagccatgtgatagtgacatggttgtttcagatgagattttgtcacagcattcaatgaacaaaaatatagttgatcaaattcagtattttttgttcactgagatagcttattcacatgtgtatgttttggtcttctgtttgaattggattggccagtttaaatttgattggcaactgatccactatatatttgaatcaggcaattatta

SEQ ID NO: 105048 - DNA, 1141 bp, Homo sapiens
agaaagcattttttcttgtgtatttaaaatgtatttgtaattttttatattttaaattaaaaactcaaagtggtgttggttttataactgcttgatgggtatttttattttccagatgtcttacatgtattatagtacgttagagaaatgtttatgatgtattgcttttattcatttcttttttccttaaacagagtgcaatagagtctctttttggagcatcattaactgggattgcctattcattgtttgctgggcaacctctaacaatattggggagcacaggtccagttctagtgtttgaaaaaattttatataaattctgcaggtaagtaatagccctctctacttatcacatgtgttatatatgaaattgtttattaacttagaagggaattatttaattgcttaaaagtaatttggtcaatatatgcattctcattatttttgagctactgtatgattgaccatcctctggccccttccattcttaatccagtaacttggagatgaagaaagtaagattgtccttgagtataaaatcagtggatttgaatgctgataagcagatcacttgagggctaaatacaaatcctttgtgctaacaaatttaaaccagtaagaaggtgttaatctgaattgggttgaagcaatcagagtgaagtgtcagtttccatcggtgaggttgttcacactgtagaaatgaatatagggtactgtagctgttagactttgaattcagcatggctaatactgttccttattttatttatttatgtattcatttatttgagactgaatctcactctgttgcccaggctggagtgcagtggtgcgatcttggctcactgcaacctctgcctcccaggttcaagtgattctcctgcctcagcctcccaagtggctgggattactggcgccgcaaccacacctggctaattgttttattttcagtagagatggagtttaaccatgctggccaggctggtctcgaactgacctcaagtgttccacctgcctcggcctccccaagtttgggattacaggcgtgagccactgctcccagcctctagtactcttccttttgtgacataaatgaagtttgtatattttagtttgaaacaacttgatgctattacat

SEQ ID NO: 105049 - DNA, 2181 bp, Homo sapiens
ttttttttttttgaggcggagtctcgctccgtcaccaggctggagtgcagtggcgcgatctcagctcactgcaacctccgcttctcgggttcaagcaattctcctgcctcagtctcctgagtagctgggactacaggggcccaccaccacggcgggctcatttttgtatttttagtagagacagggtttcatcatgttggtcaggctggtctcgataatgtgacctcgtgatctgcccacctcagcctcccaaagtgctgggattacaggcgtgagccaccgtgcctagccaggctgtgatttctttaggggaaaagacaggtaacagtatggcagtgaacatagaaacagttcaaaaattagaaaaaaaaaaaaaaaaaggtcttcatatggcaatatctgcttttcagcccaagattaggagaggggaaccttaattttataccgatttgcctgtgttaatgtcttttttgacatctccttgcttcatgtctcaatgttttgctttttttctctgtatgtataccatttagacatttttttcctttgtttctgctttttgtttttttgagacagggtctcactgtgtcactcaggctagagtgcagtggcatgatctcagctctctgtagttttgacctcactggacttccctcataacctccggagtagctgggactataggtgtgtaccaccacgcctagctaattttttgtatttttttgtagagaccagcttttgccatgttgcccaggttgttcttgaactcctgggctcaaaacaatccacccacctcggcttcccaaagtgcttgtgttataggcgtgagccatggtgcccggcccatttttttcctttgacttaagctctgcataaattcattcctaaatatgcttattgtaattgaactaaggattttatgatggcttagcagtgtcttttaagaacatttttctccacagacaagaaaacaaatttagcccatataattaacaaatgtgtcattaacacggacacttctcctttatgctgccaaaagataaatttgtttatctttgagtttgatcctgtttttattctaatagttgaattatactttcattgcatactgtcattttgtgatttttgattttggaagatgctgttctagctgatgatgagaattgctacctattcattgactatattctgtgtgccagacaccatgcttgctaggtgtttttgcaaataatatttatgttctagttatcatcaccgccatttcaaagtgagaaagcttaggcttagaaaggttaagatatggccatggctgaacacctagtagcagtcagtcttcccactggaaatctagtttcggaagccctcctctttgcctgttgctgcgctgcctctcatttcagcaggattgtttcttacgagcttcttttctccttccctttaccaattaatgggctggcttttctggatagtacgttccagttgaccttgatgtttgtatatggtaaactattctttccttactttctgattctttccccctttttctagtggcatagctaatcatctgatagcctaattagttagaatgtaatggtggtggttgtacaaaattagtatactaacgttgatttaaattctcttagtctttcattttctctatcttttcttgccaaactttagtgatactttgtcatttatggttgctataaatttttttgaggagatttttctcatttattttgttaaatatttcagttttgataattgattaagcctatcatattagattaatttctttaaaatatgtggaaagttttgctctttagaaatcagtttgagaaagatagtcacatgttgatttatcacctattcgaaagatctttttatagcagttcttttttgtagcaccatattatttactattttttatttttaaaatgaactatttcagccatataaaagtattcaaaataatacatatccttctgtactcacagacttaagaaataaaacatatatagataaagttgaagccctagtatgtgtctctcccatttactctttgctcctttcatcccacagcacaggttgagtatcccttatctgaaatgcttcgaaccaggagtagttcagattttggattttttttaggattatacttctggttgaacatccttaatc

SEQ ID NO: 105050 - DNA, 1505 bp, Homo sapiens
aacgtgacccaaagcagactttccccaaaggtaattgctgtggaaaacatggggaagccatttgaacagaagatgcacagttgaggtaaaaaaaaattaaaaaaaagtttactttggcttgctggatgaatggttttataaattgagtaaaaggcttggattgtcttttgaggtggggtggactgggagaagacaacagttgaactgattctgggtgggtcatgggggtttttatcagtggggctacttcatatcctgtaaggtatcataggattagttagagccacaggatgaatattaactcctcagtcctggctggtaagcctatactcgactggaagaatagaacataattatggaaactgtggctttttgaagtggcatttaattttgctgttattaagtctatgtgaaaatagctaaaacttttatttggaaaatataattgaaagcttcatccattctttgatatgactaaaatgaaagtttttatgttttcctgttcctggttatactgtattcagagctatggtgctttgtaaaatcttgaaaggcatttctttgttgttgttgatatgcattttaatggcatttaaatgagacgatttgtaattcttaagtgcattttacttaattgtatttattcttgggagaacattcatttttttatagatcaaaggttaaaaaataaccaaagctaaggcatgataattatcgaattaaaatatttcatgatctaaacatgaaataaacctaacaactgaaattttctttcaactctgaatttattttggattatgtaaaatctttttaccttagtctttaatcattgtatcaaaggtccatatttttagtaagttgctttatgtgctgtcacaaattgtgcatgtcactctgctagtccccatggaaatgtgttttatctgttaccatcatggaattgctgcctctttgtccgtggactgtcattcattacctgcccatctaatcttgctatttgatatcttgtacatgtgacaatgtgtttggcattggaggaatatagataagtgtaagaagagccagtatctcctgtcctcaaggattctaagtgaaaaaagtgaaaaagacaaaagtgattaagtgaaaaagacaaaatagtatatacatagtgctttgccacacgtgagtgagataaaggaagagctgtaggatttgaagtaatagaaatagaggaagcagaaatattatagaagaaagtgaaaaggatatgtattagttatcaggtgctttattagaacttcaggtggaaatggagatattaggagatacggtcccagagtgtgtagagtggtgaggaggaaatgtaaagattgggaatcgtttatataggagtgaaggttgaaatagaatagaggaagttaacaagaaagataatttacagggagagaaggagaggggaaaagtgtgaaattacccagatttatggaatgaaggagggatgggatggaggaggaaaatgattt

SEQ ID NO: 105051 - DNA, 1071 bp, Homo sapiens
tttttgtgggaacatgtttatcaaacagctcttattttttaagggaaatactttagtagaagaaaaatgacatttgcttttctcttaatgtaaagcgtaattttcaatagttaataggagcagtatttttaaagttttggtgggagagatgcttttttggaggttacttacgtttgtagctattggtgaataggaatttgaaatggtatgtatgaatatattttatagtatattgataattagaacataagatgcaaaaagctaattgcaaatttaaaatattaatagaaactgacattagcttctatttttaaagagcaatctatttcagaagagagtttattttaggaaccattcttttctaggagaactgattagatacataatcaatataaaatctgatattcactctaattgaagatgccatctcaagttttcttaaaatagaattctgaaaataatgttttttgtgaaattcaggaaaagagaaagattcctgtgtttcacaatggatctacccccacactgggtgagactcctaaagaggccgctcatcatgctgggcctgagctacagaggactggacggtgggtgcaaatactgatattttgaagggtttgggggatgatttgatgaaaacataaatattatattttttccaagtgtttggaacctaatcttgtacagtattttttcatatgtataaaaatgtgcattattatatataaggaaaatttatatgtataaatatataagaatttataaataattttaatagtatgtatcaagctttaaaaggaaaataatggactgtatattcagaatattgcagttatatagtgtgtaggttaatttccattgcttatacagaaggttcttgaagaaggtgtagagtcttattataattcttcatattgagttagagaattatgggaacagagagtaattacaactaataatttctttgtatatgtgcacagatttaaaactcttaaatgagcattatatcatgaggtaatcttccatggacaagcatgattaaaccattgtattgctctctggaaacctagc

SEQ ID NO: 105052 - DNA, 1049 bp, Homo sapiens
cttacctgtcaccattgcattatccacaatgcttagaattgtattttagcagttagtaggtagccagtaaatattggtcattaaataaattatttaagtaaagttgtttgcatatccatgattattttcttaggataaatgacatttaaatgtcatagaagtagaatgacacgctacagtgttttattttctaatcaattactatttcccaggcaaaattttatttttaaaaaattgttctgtcttaacatgtaactgttctctttcattgtttgttattgttaattcatctgataatactgagtggattaccttttatagttgttacccaggctgggctgaatacctgcctgagataagagtttaggggttatctttattgtgaagctatttatgatatccagagtggatttactatgtgtagaaatttttttcaactttaaaatcttttactcaatatttttttcacttagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggtaagaatccagagctattcttctgtgacttactttattttaataaaattttttttgattaggtgtgattcaaaaaccaaaacagagaagttttatccccacctcgtcctgtttaccttcttacccccatacttacctcctgtgggtggaccattttttactagttttttgtttatccttttcatttttcattcagtacttgaaactatgaacatgtagtcttgtttctgtcaccaaaagttagtgtattgcatataccgttctgtaccttgcttttttcatataaaagttgtatctaggagatctgacataagaaatcatgaaaatattccttattctctttttcacagctttgttgtattctatgcatggatgtaccataatttattctattcctgggttctgatgttaccagtcttttgctatttc

SEQ ID NO: 105053 - DNA, 3364 bp, Homo sapiens
cctttgaaatccaaacaagtatcatttctaatccaaataagctatttttatgagtttgtctgactcttagagatggagtgagtttcttacagtcacatagatacaaagtggcagagagtgcataatttaaacacagatccctttggttataaaactcttactctgccaatttcattgcaaaaaacttgcttgttatattttaaagttggatttcttaggagtaatgacaataggtattatagacataaatgttaacaaagaaaaatgaaaagtctttaggaaacttctgattatgggagattatgttaattcaatctgcatttagttagtgtagcttttttctgagttacacttagggtttgtcagagaatttattgttgaaagcatgctaagtacagctaggcttcattaagttccatgcatttcacatgtttatgataattaaaagtatattccctaagtatttttaatgataatcagactcaggtcttccatcttttgtggttcacaccaactcacgttttatttctttttgcaaaaggccacaatttttgtaaattctaattgtattattttaaatattaaaatgtatagctttggtattgcttaaaatgttgttctagttttgctggtatgttactaacaccgggcacttattttttttaaccttgcacatttgcttttataatattcataaatcatcactttcagaatgtgagcagaatcaggttgcaaagtgaattttctccttactaatttggaatttgtctttaaacataggtattttggcctctccccagtctgctcctggaaacttggacaatagtaaaagtggagaaattaaaggtaatggaagtggtggaagcagagaaaatagtactgttgacttcagcaaggtaattctatcattaactgaaaattctcataattattcttactgaggaaataagtagtaatttgtggctaatattattaacattgatgatagtaattttttagtagactggtgcttacaaacctgcatgtgatgtctgtgatatgttaatttaaggtaaaaactgtgagaagggttacagttaacctgtgagtacttgaataactttacaccattactagtgttagaaattctgaaaaagaatatgtgaataatacgatatttccatccatacctacccatagatatcgtgaaacgtcagtactttttgaactacagtcatttgttctggagctaccaccactagaacgttaattctgggagtgatgttacagcactaatgattcagtctttcctgggctgtaatgcgatcccagaattactgtcttatggtgtcagtacttttggaatgtcactgagaaatatattggtgcttccccatgggtaggttaaaggcatggattacaaaaaaatacctatgtgaactatgatttttttattttggtaaatgagtattttgttgaaatagataaaccttaatttaaaagaacagggcaaaagactactaagttcaaattgtaactgaatgtaaaatgtactttatgagtatttcttatgaacaattgattctatctagccactaattttttagtagtattaatttgctatagtaaaataccagatgctcatggtattttaatatttttgtatccagtataagactttttaataaatgtaattatgtcaagctgatttcatttcttaagccttttagtctttgatgaaaagtctacaagatatattttacagaaaaggagtttaaatggtttgcattatagctttgttgagtgttgtagtctaaaactataggaagcctagcattacggacattggctgtgcagaaaggctgttgtattttaaatttttctgatctatcctgatcacattttactggtgctcatgttatttcagatagtgcaaagtacttagtaacaaaattgcaatttatttcttgttaaatgaataaattaatataatttacattatagagttcctctaggcatggcagttgccgtttatttttgttcctctgtcacagtcttacttttttttacttggcctatctttgtgtatacttccttgtctcctgttgggcaggagtctgcctcctggcactgtagttgtggcacactgggtgtgggactcaagaggcccgctgtaagtgctggttttacttttcatagatagccctgtaagtggttgtttagtgacttgtgtgaaactgcatataaatgaagttcacataatttggtatcatgtgtaaccttttccttgtaattatacacagaaagctaaattttactattatagcattatcatatatctgtgccaataagggctatagatttttgttttaaataaaaacaaggggccaggcatagtaattcatgcctgtaatccctgtgttttgggaggctgaggcaagagaatcacttggccaggagttcaagaccagcctgggcaatatagcaagccccccacctctacaaaaaaacaacaaaaattagccaggcgtggtagcgcatgcctgtagtctcagctactcgggaggccaaggtgcaaggattgcttaagtccaggattttgaggtttacagtgagctatgttcctgccactgcactccagcctgggcaatagagtaagaccttgtctcaaaaatactactaatgaaataaaagtaatgattttttttccagttaatgaaaagactgggaaatgcccagagtaattttttggtttgtttttagggggactttacataaaatgtaaaggttttctaaggttaagtaatataaaaccatgaatattttttagcactgtgtataatttcatgaaccattgttagtttgtgaactacatatttgtccttaatagtttttaatgaatagtgcagtattcattgaaaaatttctcaagttcatgtttgataaagattgtgacagttaaaacagtagcattgattcaaataagtttgcttgcttttttgtatgtctactccattctttatatttgtgaaaattttgacattttaaacattcattagatcacaagttttgattagcaaatagtagtcttataaagcagtttttctttcctgtttctctctagtcttacaaataccacggaaactttatttttaattatttatttgtcaataggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtaaagagttagttccaagtaacattctctaagcattttcaaaatctacaagt

SEQ ID NO: 105054 - DNA, 1584 bp, Homo sapiens
aggaagacttagaagcagcgctgaaaggcgaggagcagaagaatgaggaaaatgttgacttaactccaggcaactatccaaaatcctccatgtgtggtgctttctgcctctgagtcacttgcacttggaatgccttttagcacatagcttaagcagcatatgtagataatgcttataatttattttgacttctgcatgtttttttttctttatgatagattgtgttaggttggtgcaaaagtaattgcggttttcgccgttgaaagtttgctttactttcaatggcaaaaattactttcagtggcaagaactcaattgcttttacaccaacctaataaaaaagagtaagattattaaaaatttgagttacaaaaagactacaaagaagactacacataatttaagcccttttaaaaagtttcacttagatttaaaggtcaagacatttgaacacttcagtaaaacatagtcattttttataatgttttaatttgccatgaacttattttatatttatttatgtatttatttttattagaccgagtctcactctgttgcccaggctggagtgcagtggtgtgatctcagctcactgcagcctctgctccctgggttcaagtgattctcatggcctcagcctcctgagtagctgggactacaggactgagccaccacgtctggctaattttttgtatttttttgtggagacatgttttcaccatgctggccaggctgggtgaactttttttttttttttttttggagacggggtcttgctttggaggctggcatgatctcagctcactgtaacctccacctcctggactcaagcaatcctcctgcctcagcttcccagttaactgggactcaggggcgtgtcaccatgcctggttaattttcgtgttttgtagagaccaggtctcaccatgttgcccaggctggtcttgaactcctgggcttaagtgatccacccaccttggcctaccagagtgctgagattacaggtgtgggccattgattgcgtcttgccttggtagcttggttttgtgtgtgtgtgtgtgtgtgcatgcagttcactcataaggtgaatgaacacatacaaataaattatagtgaagtgatgtgccttaaatagggatagagtcatactctgtcacccaggctggagtgcagtgccacaatcatagctcactgcagtgccacaatcatagctcactgcagccttgaactcctgggatcaagcaatcctcctgactcagcattctgagtagctgagactacaggcacatgccacaacatctggctaagttttttgtagagacggtatcttgctgtgttgcccaggctggtcttgaactcctggcctcaagcaatcctcctgccgtagcctcccaaaatgctgggattataggtgtgagtcaccaggcccagccatacctttttttctatttaatgcttttctccaaagaatgtagtacattttaggctttttttttttgcttgggcgggtggggtggagagacaggttcttactctgttgcctagactggagcgcagtggcgccatcttggttcactgcagcct

SEQ ID NO: 105055 - DNA, 1044 bp, Homo sapiens
tagtatgacttttaagtgttctaccaacaagcaagcataggtgatagggtctagtttttctaaagttgaaaataatcatcttttttatcttccacttggccatgaaaaccctttttaatccatttaaaattatgccatgttgtatttaagcaatcttaagagtaaaagaatacctcttatggaccaaaatgcaatgtaaaaacaagccaatgtatagcgcattttaactctcttttttgtcttttatttgttgtttatattctctcctttggtgaaataagttcatttatccagagggaccctattcagtctttactcttcgtatgcagttgttcctcactattgtccaattgtaatttgctcatcagaagacattgactgttttcttttaaatgccattttagcatgttcttttgttgaaatatagttataatttgagtttttcctgcatgtagcttattgtttaaatggtgtttcctaatggattatagtttaactatttctgaaacctcttgagcatgtaactttgattaggccatatggaattgaatattgtatttgcatgtttttcataaagaatgttattcttttaagatacacttagtacaaatatgaggggtttaattaaaagtatgcatgaccttttgaaatattttagacctactgctatattgctgttgttggtgagaagtactttattcttagctagtgaaataaaaaattatatgtatttgttttaatgtatctgctacatatcagaaatgaaaagcatactttaggacatttattaatatttttagagagctcaagaatatgtatcctttaaaattgacattgtgtttctctttttaaaaaatttctgttatttgtctttttttaaaacttcagagcagcaccacctgtagatggtgtcttactgacttaatattgtaaatatttaataccagttttaagttagaaattattacttaatgttaacatgaactttttctctaagagataattgtctgtagctgtttggtaaaatgtaggaaaaatacgcta

SEQ ID NO: 105056 - DNA, 1424 bp, Homo sapiens
tctgtgtgaatatacagatttcttcagtagtgttaggaggtatgttgggaaacccagttagagatgagattgtgactagccttgaattattggattttttttttaagggggggatcacagggtctctcactgtcatccaggctggatggagtgcagtggcacgatcttggcttactgcagtctccgtctcctgggctcaagtgatctcccacctcaacctactgagtagctgggaccacaggtgtatacaccaccacgcctggctaatttttgaattttttgtagagacgggttttcgccatgtagcccatgctgttcttgaactcctgaactcaaacaacctgcccactttggcttgccagagttttgggtttacaggtgtgagccacggtgcctagccaagaaataggattttatttggtaggcattttggtggtcttgatggtttttaagttgaggaatagtgtgatatgagatacacattcaggaagatcattctggcaacagaatgtagggtggctttggattaggaagagtttagaagcaagtaggccagttattggctaggaacagtctaagcaaagaaagagctctggtaggttgagcaatgaaaatgaaagggggagatttgaaggataatgtggaggtagaaagtagaaaaaggcagctgtaatcagctttttgtccactaactaaaattaataaaaaccaaaattaactttggtagtaatgaatttgatggtgggactaccattgtagattgctcccatggaaaaacaaaaaatctgtagtatttaatcttcaagagaaccatgaacttaatacaatttctcaggctagaaatacttcaattttagcctactgttagatttaactgtgtgctgcaaatatttgaattgtccttactttcttgtctcacatgaataactgaaaaattaaggttgggaatattgaatttgtataatacatatgggtttcagactttggtttgcaattatcacataataccatgtagtacttttagtatatgttgtataatctagtgttcatttgtttgctaaactgtagctgttgtgttaaggttaacagtttacctattaggctggtccttccagggttttttttagagtaaccatgtagttttgaaaatttgaccctcttcttccaagttagtaccactatttaaaactattaatatatattttataaattaaaaagtttaatcacctcagtaatgtataaaatggcattgccatcagtttccccattccccacatccctttcacaacctgattttactcctcttcctagaacttatgacctcatgacgttttatctgtttgtatgttggtttctctacctctcgaagagagcagaaacttggctctgttttgttatttttaaattgctgtattcccaacaca

SEQ ID NO: 105057 - DNA, 1044 bp, Homo sapiens
agatatctttttaggccaggtgcggtggctcatacctgtaatcccagcactttgggaggctgaggtgggcggatcaggaggtcaggagttcaagaccagcctgaccaacatggtgaaaccccatctctactaaaaatacaaaaacaaaaacaaaacaaaaaaaaagatatctttttagatgtgcaaatacttacataagtgatttgtagatttagtgtaatcatctgtcagtgatattagccctgggcacaatattctgtgtagtgctttataaaataagagaagtaactggagactaccattgttaattacgtgaacttatattctttatcagagtagattttggagtacttttgtatatatcacttttttctcttttggaaagctagtaatatgtttctgaaccttttaataggtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatggtaagagaaaacagttcttctttagcagtttaaagttcctattttcctggaaagtattttcttttaattgaatatttcttttaaaaattgtatgtatgcattaatgtagtcacattgtatggggaatgtattgtattggggaatatcaattgaagtaataattttttttttataatttttataagaaaaatctttataggtcaagatctctttcatgtaagtgaaaaaataaagggctttgttttcttcattgtatcccatccttgaaattgtaaaagttatgcctagtcacttaggctcaaatttagtagtgtttcatttcctgtactaaatttttaattacttacatatgcaatggatagacattgggaatgctaaggctgtcatggaagtgattaaagtttttttccttcttcttttttttttttttttttgagatggagtcttactctgtcaccccggctgggctggagtgcagtggt

SEQ ID NO: 105058 - DNA, 1201 bp, Homo sapiens
ctatattgagttattgtttattttaataaaaaagagatggacagagaaacaaagtttgatttatgttgtaaatgttttcatttatattctaagacttttttttaaactctaaacgatttttttttttaactctaaaaattggctttaagagcctaggcttgttagggtttccaaaaagaacctcagttatctagaagcttatggttagatcctgtgaattataggagctagggaggttaaaatttttagcggtaattttactaattcaaatgtacagtcatacatttaatgtttaatgtcaaccctcacctatacataacctggatattccttcgattcctttggttatcacaggccctaagctctgcatactttgtacacatcttcaagtttggtatcaagtttgagggagagattaagtttaagagagtttgagtaaataggcttttgatagaataaagtaagggcagaagaaaaaggaaagaaaaagaaaaagattaaaacagaggacactagaggcaatagtaaaagaagaaaacacaataagcttaatctaccaatctttggattctagcgtgtttttatttattttatctatccctttctttctaaactgcacactcatagcatttatttttatcttggtgcattggggcttctgtgccaagacccattagtactaattggaggaacaactttgtaattcccagtgcagtgatgggaatttgactctttaatttccacttttctttatgttttgaaggaaatagtttcattaaaataaaattgagtttttttatatttatttcttattactttttaaatgagattcacataacataaaattaaccatttaaattacacacttttttaaatgtattcactatattatgcaaccaacaccactgtctaattctcgaaacatatctataattccaaaaataaaccctgtataattagcttttacatttggaatttttgttttctagtagttgagatttaattccatagacatttatcgagtacttaccatgtgctaggctgagtactgggagaagtttaaacaaatagttcagtatgttttgttaagttgtccctcttttaatttaaaaggtgattatttatgaggttaatatattggcagctgaaataagatgtcagagtatcacatttttaagccttacctgggaacatgagtgtc

SEQ ID NO: 105059 - DNA, 1044 bp, Homo sapiens
ggctggtctcgaactccgacctcaggtgatctgcccaccttggcctcccaaagtgatccaattataggcgtgagcaaccaggcccggcttcaaagactttttgagggaagggtatttgttctctctctagcagtggcatagaatcttgtgtataataagttaataataagtagttaatgatgattagaatgtccttttgaaagttattacaagttgagaagggaagttaaagctaaaattttatcctcttaaaaatagcctatacaacattttctaataaatatgtttagtctttttgttgaactgaaaagagaacaaaattatgaaggtgggattttcacaactgcagctagaatttccctagaggttaaattttggcatgaattttactttgggggaaaagaaaaagttcttttaacttttgttagctcttgattaatcagttaaagtggtactgcatgttgagtctgcttatttttgacaattttatgtttgaccataattcagtccagtatagctgtttcctgttatttaggagacttaagagcaaagatcaagaaagaaagcattacatgttgacatctaaggattcctctcacatcacattttctttaatctctgaccctagaaggtctgtcttttgaggatgaaatgaatatattaccagttatttggtaatttgcatggaaaaccatttaaaaatctttgccatttcacttctcactctgggatttttgaatggtcttctgtggatttaaaaagcttgtaaacataattttaaaagaatgcaattagctgtaatgagttcagttatttgagagaaagcagtctgttttatattttgttgccatttcaaaggatgcatataataggtcctcaatagattgtgatctcatgagtcaatgagaataatttgtttttagggtcctgatgaagaagctgttgtggatcttggcaaaactagctcaactgtgaacaccaagtttgaaaaagaagaactagaaagtaagttggtttaaaataacttacttcgcttagtaggat

SEQ ID NO: 105060 - DNA, 1169 bp, Homo sapiens
ttggcggttttaagcagattttcagatttcttccaaagaggatgttttaaaatgttttaatttttcttaagccattttagtgagcgtacttaagcagttttcagtatcaaggggttaaagcatagtccactgttaattgtgaaatagggaggatgctttaatgttgttgggtttttttttttttttttttgaggcagtctcgctcttttgcccaggagtgcagtggtacgatcttgggtcacggcaacctccgtcccccgggttcaagcgattctcctgcctcagcctcccaggtagatggaattacaggcgcacgccaccacgcccggctaatttttgtatttttagtagagacagggtttcaccatgttggccaggctggtctcgaactcctgacctcaggtcatccgcccacctcagcctcccaaagtgctgggattacaggtgtgagccaccgcaccctgcccgctttaatgttttaaatgacctttttttttttcctcatttttcagagaattttatgtgaactagtatcatttggttctgattctgttcactcacattttaggcagtagagaagttgtgttctccctctctctggattccaggactgtattgcttcttttcagtcagatttcccaatttggaaaagctgtcgaattgtgtatcatctctgattaggaacatgagaaatggttatacttttgacagtagattcacacttggaagatgcctcttttatttcgttacagaaaggagtgtggaatggttttcaaaagagcatgaaagccgggcgcggtggctcatgcctgtaatcccagcaatttgggaggctgaggcaggtggattgcctgagctcaggagttcgagaccagtctgggcaacacggtgaaaccccgtctctactaaaatacaaaaaattaccagggcgtggtgctgtgcgcctgtaatcccagctacttgggaggctgaggcaggatgaggcgggagaatcgctcgaacccaggaggtggaggttgcagtgagccaagatcgcgccactgcattcctgggcaacagagcaagactccatctccaaaaaaaaaggctctgagaaaccttataatacataaagacattaaactttgatggggagagaatgcagcttaatattacgtggtattgccaaa

SEQ ID NO: 105061 - DNA, 1070 bp, Homo sapiens
tcttgaaaaaatgtaacttgtcttttgcttttgctataaagcctcataattgtaagcctcacttggaattgatttgtgagtctttttttgttgttgttgtcagtcttattttccagtataggttaaatccttttataaatagcatggtttagaaggtttctaagttttagcaggtaatctactttcttttaagcagtgcatgatataacacaattctgataccactgacattttgggaccatgatatttttccatgattttgttatgattttattcattttgcacatatttattaaatatcctataggtgccaggtaatggggatatagtcaaacaaggtagacagcatactgccttcgctgagtttattttggcgtatggtgtgaacacagtgatggcatttacatttctgctttccatttgtgagtgccagttaaaacatttcatcagtctgtaagaaattaaaaaaaaatagtcattagaataaatgacagacccggacaacccagtatgaattcggtagtgattggcaaatggaagtttttttttgtgggtctgtaagtaggcattctgtttggggaatcacagttacgtattgatactaggtattgatgtggcaccctaggaatagtatcagggtttcagttacccttttgccttattctaagtatctctgggccgcaatccatggagttgtaataaagggagagagcaaatctgaaactgtaggacaaggctaggtgctgtggcttatgcctgtaacccctgtactttgggaggctgaagtgggaggatcacttgagcctagggggtttgagaccagcctgggcaacataatgggaccctgtctctacaaaacataattacccatatgtgttggtgctagcctgtagtcccagctacttgggaggccgaggcaggaggatcacttgagcctgggaggttgaggctgcagtgagctgtgattatgccattgcactgcagcctgggtgacagagtgaagccctgcctcaatacaagatgaaacaaagctgtaggacatttgagttagattgatgaattgttttgcc

SEQ ID NO: 105062 - DNA, 1434 bp, Homo sapiens
ctgtaatcccaacactttgggaggacaggacagatcacttgaggtcaggagttccagaccagcccagccaacaggacagatcacttgaggtcaggagttcgagaccagcccagccaacatggcgaaaccatgcctctactaaaaatacaaaaattatggtgacgcctgcctgtagtcccagctactcgggaggctgaggcaggaggatcgcttgaacccaggaagtggagattgcagtgagcggagatcgcaccactgcactccagcctggtcgacagagtgagactcaatctcaaggaaaattaaaataaagttgttctctgaagagcaaatgtctcattccagtaatgacccactcaccaggaatatggtggagttcagtccaattcagatcagccatatccaaaagactacaagtcattactaagttgagcaaaagagtttttatctattagcagaaagggcctctctggcagcagagattaaaaattggcccgacttcatttccatacttcagggaatagcaaattgaagatttacttatctaggacttgaattccttctttgggaccaagttaataaaagaccaagaaactcctgattaaactgggtaatgaaggattctgtagacagggctgcacgtatcggctttgtttgacttctcttttctcagttaacatctcagagctggaacattccacattccccagcagcgtgtgggggccgactaaagtttgcaattccgactaaaaatcaccctgcttctggcttatctgaatcccttacccaccccacctcaccaccccactcctatttattcagcaccacactacccaggaaatacactagcaaattgtgcaatggaataaaatccacactttactttagattcttgcaactgtatcatatgtaatagtatcactttttctacattttggtcaaataaatttttacataaactacaaaaaaaaaaaaagaaaatgatactaggctttggggttggagtgtattgccttcagatcagatacttggctctgattcccataatgtctttaagaatttctatcactactctctctttttcccctcctttctgtgctaagtataaccaagaaaaggggcttttgaccatttccagatgagggttttaaagtggcagcagagagagaatcccttgggactggtatcatattggcagcacagatcatgactaaaaaaagactgcacagagaatggggaatttgggagaaggtttgccaggtttgcttttttggtagaccttttccagcagagtcaactagtcaatgcttccctactaaacccttggagtgccttgagcctgtgtgcctctaagtggacatggatccattctaaaacaatcagaagagtacttagaaaacatttatcttgtggccaggcatggtggctcacacc

SEQ ID NO: 105063 - DNA, 1112 bp, Homo sapiens
tttagtagggaagcattgactagttgactctgctggaaaaggtctaccaaaaaagcaaacctggcaaaccttctcccaaattccccattctctgtgcagtctttttttagtcatgatctgtgctgccaatatgataccagtcccaagggattctctctctgctgccactttaaaaccctcatctggaaatggtcaaaagccccttttcttggttatacttagcacagaaaggaggggaaaaagagagagtagtgatagaaattcttaaagacattatgggaatcagagccaagtatctgatctgaaggcaatacactccaaccccaaagcctagtatcattttctttttttttttttgtagtttatgtaaaaatttatttgaccaaaatgtagaaaaagtgatactattacatatgatacagttgcaagaatctaaagtaaagtgtggattttattccattgcacaatttgctagtgtatttcctgggtagtgtggtgctgaataaataggagtggggtggtgaggtggggtgggtaagggattcagataagccagaagcagggtgatttttagtcggaattgcaaactttagtcggcccccacacgctgctggggaatgtggaatgttccagctctgagatgttaactgagaaaagagaagtcaaacaaagccgatacgtgcagccctgtctacagaatccttcattacccagtttaatcaggagtttcttggtcttttattaacttggtcccaaagaaggaattcaagtcctagataagtaaatcttcaatttgctattccctgaagtatggaaatgaagtcgggccaatttttaatctctgctgccagagaggccctttctgctaatagataaaaactcttttgctcaacttagtaatgacttgtagtcttttggatatggctgatctgaattggactgaactccaccatattcctggtgagtgggtcattactggaatgagacatttgctcttcagagaacaactttattttaattttccttgagattgagtctcactctgtcgaccaggctggagtgcagtggtgcgatctccgctcactgcaatctccacttcctgggttcaagcg

SEQ ID NO: 105064 - DNA, 1007 bp, Homo sapiens
tctactgagtttgaatgttctgctgccattagtacactggtccttacgagctcgaagttgcagaatactcggctgtgaattggaggagtggcagtggtaggattgaggcttccatcttagatgttacacaaagagaacaacttggagaaaactccaatgacatggatttttttcttttatttgtttatttatttattttgagaaaaggtgttgctctgtcacccaggctggagtacagtggcacaatctggctcactgcagcctccacctcgccagctcaagtgatcctcccagctcagcctcccgagacttgacatggatttttttaaattactaggttcccactgagacacagctaaagtaaagacacaacactagacgctggatgatcttctccccgaaaattacgatcacatggatccttcccaggggcactaaacaaaaacctggactcatcaaagaggtcaggacagcataaggaaaactaactccaggcttccagtttattatttgtatgcctaaggcttcattcctcctctttcatttctataaagcaaagtcttgtattttcctctccattgtacatgctttgtaaagatagaactaaatctacacctgttctagtaaacaaaacatgacagacgaccaaaagtgtgaaagccaaaaccatgtgaaaaactgcctcaaaagatgagcagcccatttggagggaaaatatgtgggttgctagtgggaggttctcactattcatttttttatataggcttttaaaaaggggaaaaagttaagaggaggtgaagtggggagatctagctaagatttctttaaaactttttaaaagtcagattgttattaatctatggaaatatcacttgcaaatattaaaaatcccctcagaaataacctccaagtcaatcttaccggaaaacatgatatgcaagagcaaaccagtcacatagaaggaaagatggatgacccctgtgacctggagggtgacaaggaaggaa

SEQ ID NO: 105065 - DNA, 1024 bp, Homo sapiens
aaaatattaatggatacctatgacaagttctggggcttcctagactcctcctctaaaccatctgatataccaggtcactgggattctaatagagtgctctctattaattaattaatactgcattaatacactgtgcaatgcctaagagtaagatgagcacctcacaccatcctctgcattcctaatgtagacccatctcaacccagcagctgctcttggatgctatcaccaaagcattaagtaagtccttctcactctggatttcctaaaagggaatcagactccagtacacagtctgctttcactttttaaagtgtaagccaagcaccagtccccagtatgtcacagttcaaggatttccaaggagtccttctgaagacccattattatgcctggggtttaacagaaacaactctcctctaatttccccccaaagcagcatggtgggggcaggggactcagaactacaagccttctatccaaacaatcctcttaaccagtgttctggttacactgttccaccgaagtgcccctcactggacttgaggtgaataggtacaggcctgccccctcctccccaaataggctcttggcagagaggtgcacacagggctcacagcagaattttccagtggtagccactttcctcttatctgtgctggtaaattctaaagtgagactctaaagtaagaaattgtgccgtgctgccctaaccaaaacatagttaaggacaggcagacactgaccagagattactggccttgcatgctccatagctaaactctcgaggttttccggagaaaccctaaacagctaaaattgtgtcttttgatacttccgtggggcttattctaatacaaaatgtccattctaacctctcagctagctgtcagctcattagtttacccaaatatgttcaaacaagatgacctgtttttatactctactggctcttctttcctctcttttctttctctaaaatcacgtttttgcctttgatctttgactgcatcttttattcaac

SEQ ID NO: 105066 - DNA, 1085 bp, Homo sapiens
atgtttctgttgaaaatcttattcacacatttgtgtgcttgtcttgattatagaaaatttcatttttaatgcctccctgtctttgctttacttcaagcccacagactcaatcatcaggtcacacacatgcatcatgcaaaaaacaatcttgaatgacaggaagcaaaagtgaaagctttaataccatgtggaaatcaaggcaaaagccaactttttggataagcagacccatcttaaaagcatagggtgtgtggttgtggcaggtggtgacgatgatagggaaactttaactcccacattagggaattaataggaaatggctaaaaggaaaattcaagttggactatattatttaactatttgaaagcaatgacaaaggagacagcgaaagcagctaagtggttgattctgaggagtaggaaggagtgggaaaaagaatatggcccccaaggggctaactttcataataaatcttgttgaactataatatacaattatgtgcataacttgataaaatagaaataaaatgaaaggagccctaaatctgagccaaggctcttcaattctggcctgccttagctgattgctcagattttctctttccttctcttatgagttgtctttcccgtatttattcttctcttggtttaatctcttaattttttaatttttttttattttttgagacagagtgtctctctgttgcccatgctggagtgcagtggtgcgatctcggcttactgcaacccctgcctcctgggttcaagcgtttcttctgcctcagcctcccaagtagctgggactataggtgcgcgccactaccgcctggctaaattttgcatttttagtagagaaagggtttcaccatgttggccaggctggtctcgaacccctgacctcaaatgatacacacgccttggcctcccaaaatgttgggattacaggcatgagccaccgcgcccagccctaatctctcatttcgatggtgtgtcctataattgtttcctgagaaaggatataggagattaaaatgttaagctcttacatatctaaaagtgtctttaatccacgctgacattttactc

SEQ ID NO: 105067 - DNA, 1050 bp, Homo sapiens
ttttactggttgagaacagcactgtattcactggctgctgacaatgtctctcgttgtgctctgctatgttttaattatgtttgacattcatctcacactattatccagtggcaggcaattgaagaaatgcagcttcatttgaagtcaaacaaaagtgaggacacacgtaattatatagtaatatatagttacttggaagctagaagatttttaggtttaatatacctgtggcttcctacatatcactccattcccatgccttgttttgattcaattgtaagaagcatcagccgacaatttaattataaacatctaccctaaaccaggaatagtccaaaaagaacaaagaatctaaaaaccagattagaaatcagaaaaaggtggttccttttaattatggattttttcaaatatatacgtatgaaagtaggaagactagtataaaaactccatgaacccatcactaagtttctataattattatcacatgacataacttgtttcatttataaccacacctactttttacccttgatactcaacctagattattttaaagcaaatctcaggcatcctattatttcacatataaatacttcaatatttatctttaaaagagaacttttaaaaaacagatagattgccattatgatatgtaaaataaaagtaacaataattcatcaattcactaaatatctagttattgttcaaatttctccagttgtcttataatttttatttgatggcagttttcctttgttgttgttcaaatgaagatgcaataagaatcacacatgaaataggttgatatacttcttaagtctcatttaatttatagattcttcactgtttttattttttttgcttgctatttattttgtgaagaaccagggcatttgttatgtataaatttccactttctggatttactgattaattgttatgtaacatgttatcctagcccctgagtttccaacaaaccaataattagacttagaggcttgattagattagatttttttcttcaagaatagttcatgagtggggctg

SEQ ID NO: 105068 - DNA, 1119 bp, Homo sapiens
agaatctgcctagatgtttgaggagcacagattatactgaacaatccacccttaataattaaatagaatgttataatcataaatagctctgccttgcagtcatttctgtaattttgtctgacattcatattgtcatttgattagttaatcatccattttcaaaggtgtgaatgtgttttcacacttctgctaagacagtgttaactatgaaactatagatagcaatagagattaattatctattgcaccagttcccacaccttgtgcttaccagatagaggaaaagagtgcatgccttaacacaggtgtgatttcaaaaaatgggaaaaaaactgcttggtcaaatgagcttaaggagtactttcaattgatctttaaaacattaacagcatttacacttttaatttcatttcataaaacaattgatctctcatgtatagcaaggcttgtttcctgagtgaattggtgcatatcttcagttacaaatgtggaggcattttacaaatgagtcagtctttcatggaattagaaaatggaacagaaactctttttcaggttttaacaattgctataacttcaatagggcaaagtcagaaattatagacttgtcctctgaaaggttaattaaatacagcgaaacttctaagcagtcaagtaactcaaaataataatgaaaatataataatggagaacttattattataagcacaataataataatgagctctccaactgacttttgatttgctgctgctcccttaccctaatgatgaagtctgttaatttagaatctgcctcatcacttctttggagatctgatttttctatttcagtgaattagctttgatgtgaagggtgtcgtgactgaaatgagacactaagggatagaagttgacctttaaccacattcatttttgaagtaaaaataagctcagattttaatccaccatgaaagataacaatttctagattagtattagcttcggtcctacacttgatcattaatgttgttagtcttctttaaaacgtaaaccaagcactgaaaatgaactaaaatttgcttctctcattcagaaaaatgactctttcatctcatatgctttcttgcttctttagata

SEQ ID NO: 105069 - DNA, 1047 bp, Homo sapiens
taaatgtgaaacttgttcatttaagaaattatggccacaatggcggttgtaacacagttctaaaattggcatgtcttattgcataagttaatttcctgctttggtatacttttaaatatgttgtccctttctggcctcctcttggttaaagcagtgtgggtggaagaggaacttttcacacctagcaatctgcagaatctgaggtccaagaaataggtgctattgggaaatgggcacatctagtgtgaacaaggtggttaattaacagtgaaagctgataggacagagaagctcagatgaagcatactattgtgggatatgggtgttacttgacccagaagctaagcagaaataggcacatctacctcactgatgtactttccgtattttgtaagcgtttgagcttatacaaaattagattgttagtggctgacctaatatttgatgtttattctctttgaatgtgtttttcagccagctgacaaattgctccccttgcttttaaaaatatttttttcccgtggtaggaagcagaatcagaattccctttgattttactttctgataaaaaattgagaactgaattttcaaattttgctggttcaaatggtgcttctgaaacacaaacttactgtctaaaggttgtttccctgcttcagcataactgtggaagctcatttagccttgtttgcttaagtctcctaaggcccccactccatgtgcatggtggtgtcattgaaggtttagagcctgggttacatgatcttggcattggcactttattagaagcttgggtcatttcacctctgtgagcctccacttctttatctgcaaaatgaaatcaaaatacttacctgagagaactgttatgaagactgtatgtattcattgccctcatcttcaggtttcacagacaggcaggctggagcattgcggggaagaaaacatctctcctactcttgatttccctttttgtttttgttttgtcagttctagtatggcttgaaggaaagaaggtgaattttcctattttaagatgtctcttcg

SEQ ID NO: 105070 - DNA, 1478 bp, Homo sapiens
tgtgtttaaaatgcagagaaatcacacacgctttgttttcatatggacttgtagttccaccttttcttctgttagttcttttttaggctactcttactactaggtagaaaaactacttgtgtgtctcttaatcttgtatctcttcatctattcttggatctcagtatcggtgaaaatcctcttttgtggattatattaataagggaatgatttagatgccaactttgacaagattgcatggaatatgttataaagtaaagatgttgtagtatagtttgcagaaattttaagaaacatgttgcttgtattcctcacatttttgttgttgtatataaaaaaacattgcaaataggatgagttttaatgactaaaataatcacaatttcataaggttgtaagttttgagtatatttgcataggcttttattttaagtaaaccagagtcttatttttcctttaatctggtgatttgcttgagactttattaaagaaagatcttttttttttcagaccagcatctcagacatgtcgaaaaagatgttttgatccctaaaataatgagagaaaaggccaaagagaggtgttctgaacaagttcaaggtaacattcaaatattcatgtaaagatcaaatttatttttaataatatgatctgaatttaatccttagccccagaatcaagtagtcaatgaattaatatgtatgaattgcttctcaccctttcgctgaaataccagtatttcagctttcagaacttccagtgatgttcaattcatttacagtttaaaaatatttccctaaattactagtaaaaaacattttttgtttttttaccctcagaggtacagttatatacatggaaaaacttggtatgagtaatttggagaaacaagttactcttacgatttttataggggaggaagaaacatcaaatctaacatatacctgtttcccatctgtcaccatattcgcatacatatatatattctaaggtgattttctttggtgtcattgtctattactgaattgttaatagaatcctgataggacttacagtgagtctggggtttttgttttgttttatgtttctaagtggaagatatttatgtaaatacatacactagacagctacaagtgtatgttttctttggaaaatgttttaacatgaaatactcctatagatctagagacatcagtgattaatatgtaatattctagtgaaacatgtaaagaaagcagtgaaaggtgaatagtgaggccataatacatttgtaaatgatgagttattagaaaagcacatggcaatattactttagaaatatctttaaaaaattctgtctcttggaagggccatcaaaaagaagtaataaacttttatgggcataggctattttcctggctttacttcttcactttccctgtggtcatctttattgagggaccacaataatttttagtgaggatgatgggctgcacttc

SEQ ID NO: 105071 - DNA, 1046 bp, Homo sapiens
tgtcaactctaatttcaggactgggtcaataacatttggatactaggaacgcttttgttcccttccctgtcctctgcccttagagaggacctttgcaattgatgaatggaggcaataaaataaagagtagttctttggaatcaacaatgtgtgatggtaatttttgtttcttcaataacttattatgacctattccattttaaaactcatataaataaccatccaatggttttactcttgattcttgtgagttagtttaatcagagtacctttctttaacacctacccccagatgtcttgagacgtcaacctattgacacctgcaggtagtgcatgtatggcattggtaggtgtcatgtttatggtcacaagaggtacatcctgcacattcctcatacaacttaaaaaatatatatcctgattcaggtgaggggagataaaacttaaaaaccctataataaagttgtagggctttttactgctaggaaaatttacttattactgatatatcagtctaaagttacacatataagttgtatgtgtgctgtcatgtagcatattgtctttatacctagaatgaaagaaagctagctaactcaattacagatttaatttttactgacataattccaaggaaaatgcagaatgattgtatgactttgagttttatttttggtttttgaaatgaaagcgtagagtataactttaaaatatttatttgtgttacaaaactagtgttttataatggtacagaaaataaagtgtttaattttcacttcatcaaaagttaagttgtttaggatgttgacgtagttaagtttttgctgttttaatatacttacggtttctgaagactgaaagcatcttaaaatctgtgactcatttggattatttaaatgtattcatctatattagaatgtaataatataatttgaatatcttatagataattatgtattgattttttaggccatgtgattcaaaacaatattttagaatctaaaattgataagagaataagaagtctttagtattttctaaccata

SEQ ID NO: 105072 - DNA, 1048 bp, Homo sapiens
attctcttactgactcctttcatcccttgggccctcttttcccttattttaatgtttcttttgtatttatgttgcagtctttatgatctgttgtccaataagtgggatatagctctgaaagaattacataaagtacaaggaagcatgggttatttgtttgtttgaaacatcacagagctgtaggtaaataacaaagaagcttgataaaatgcgctcttctgtcaatcacacagaactgaagtatgttgtattttgtgaaattccaaagataagtgaatgaacaaaaaacaatcaagtcaagaatgcttagaatgttctttaggaagtttacaggcaggtaattatcagaacagcattgaaataggttgcagggctgcagactatatacatggtcaaagtaatcactcttctgtccaactgtgttacttgaagctgccaaaaatctgcctttttatttgttgtttgaggtgtaccactcttattacatgtatttttgtcattaaccagtgcaccagtattaactaatgctgaagtggatatgcaacacatcttgagactggttttgatatactaaaaggaaaataatcaccgcatatgatgaatagctgttatatatgagtatattatacagtctaagaaatacaagtagatataaggcacagtttctgcactttggacttacactgaactatctcatgggttcccaatcaccattggattggttgattcactaggaagactgacaggactcagcatataatcctattcatagctaaaggttattacagcaaaaagatacaaagcaaaatcaacaaagggaaaaggcatatgggaaagttcagaagaaaccgtggcacaagctccatgagtcttctcctggtagagtcactcagggtgtgcttaatttctccagcactgtattgtgacaacacatgtgaaatgttgtctaccagggaggctcattagagactcagtccccagaatttttattgagaatttgttctcaataaaacatttgggaaccctctgcctaacatgtaccaaaatt

SEQ ID NO: 105073 - DNA, 1083 bp, Homo sapiens
ctggtttaatcaaattaaattctagaaacacaggaaaggcttgcctaaattaactaattccgtaaatttatgaatacttaccatgtatccagccctgcacgtaagctgtctacataaatgtgactgaaacagattcagtctgcattcttattgagtttaagtatggcaggggagatagttatcaaataaatattcaaattaaaattgattctataaaggaagagtgcagtgaggaaatgttaacaggtattatttctaagtgttggtaatattggcaattttaaaacttgattccttttctgagttttttctaggatttaaatatatttcattggaaaaaggtaacaaagattgagtagataactagacattgcttcagtaatttttaaaacttctgatattgctctgaatgcacagaattaagtttaatttacagaattaagtttaatatcatgtctgttaaatattattggttgcctatcacatgttcaatactgtgagaagtgctgtagatacagagttgaagtctgagacttgcttttgagtaccttattgtgtggttgataagagacaaaccaggcacagaaaatagaattacaccatattaaacaatttataataaaatacctacatgttactttagaaaaaaataagccagtgaattctgatataggcaggtgagacttaatgaagtatgtgggttatcaactggaccttgaagtacggctaattatttggctaagtatagggaaactggaaaaacatttcagaccagagacccaggatttaaggcacagaggtgagaatgggcatgtttgttgatacagcagcaaagagattgaccttaggaaaccagtggtgcattaggggattaatgatgtagataaagactgagagtcaaggctgattttggagtgtcttaacagtctgaaacagaagtttagatttgatttctggttaaaaaaaatcagaagaatttgaaatctgttctttctacctccctttattcatttttttcctctttctcttctgtgtatttcccttcctaggaaaatacttcatacaaataaaacggaaagatta

SEQ ID NO: 105074 - DNA, 1014 bp, Homo sapiens
ctcgtggcatattgaagatgcatgcattttattttctattgtaatttaaaagtaaaatcagaaatactgatttctacttgactggagagatgatttagtttgaatatcagcctgatcttaatcaggtgagaattaattgagttggaggtattagatattcagtgatgttaactgaaccatgatccatctagagagaagctttcttttgtactgtgttagaattatcaaatagctcatgcactacaatgtaaaataatcttttcatgttcatccttctaccttcttgtctcattaaatgcaccactaaattcattctatacacagactaatctttaaagtagcaagctaataaatcacaagttaatagaaaattaaaagcataataattttgtcataagatgctgctgtcacaattttataatgatatattttctagttactaattttaaaaccaagtgattaaacctctgcttttcaagtatacctgggacattaaaaaaaactcttagtttacttttttttatgttcaacattgcaagaagaaagtgagcaattcagaagtattttaatgtttatcttcagaaataaaaatagagtctgtaacattatagtggtctgaaatgtggcatgggcttttcatttattttaagagtgtgacagcaatatcataagtgttgtgaaaatataaatggtgagataacacctccatgggacttgctcttaagtagtaaaattgtaaattctttaaataaactgcagctagaactgaaagcatcgatttgccttgttaactatggatactatacttattaagtgtctaattaaatttagtataacatgtctgttatttcctcctttttttcccttaaaactgaaaatttggacttatttattagcaaagtatcacgttatcattgtcagatttcttcgattttggcagttggtgtgacagtgttaaattaaaagaaagccagtagtgtgacttttgatagtgtcgttttacactggaatact

SEQ ID NO: 105075 - DNA, 1041 bp, Homo sapiens
ttattcatctttaaataagaaggtgttctgctttgttaattactattgacatttccatgaaatgaacgtaactgctatcctctctcattttgaaacattgtttttgctcctttatttctacctcttactttcatttttttccttaatacactatgatctgatttctgtcctcacatcactgaacctgctctttttaaagactctgatgggctgatggtagacaaatccaacaaattgttccttttcttttactggacctgtctctggcaatcccttcttaaaagtctcctctgtcttccctgataatattttttcccattttcccaaaatctctttgtacttctccatgtttttaatctactccttaatgttggtgattccccaagttctcttctcattcttaaatctgaggaagtttagtttgcacccatgaattcaattacttactatagaaagtaacatttgtttctttgttcaagtccaaaaatgaactgggctccttttgctcgtcctacaacgtgtctttgtgaattatacagtagtctagtatctacagtcttgtctcctaactctaattggttatttcctattgatttctgaaatttcctgcacatcatctcttccttttcattcctacagctcctcctttggcctgcgccttccatcatttttgcctggattattttaacagtttattggctatcttgcctctaaccttgcttgcctccttttgtcctatctgccacatgttgtcagattcatccaagacacaaaactgatcttacaggtgaggtgctctattaattgtgccccattttcttcaggattgattttaatttctgagtatagcataaatggcacatcatgatttgacttttgcccattccatcttcatttcaggccttttctcctatgtgcataatctgctatagtggtacctatctacttggcaggttttcctgcattaatttttcctcatccatgtgtcttcccacacttgccttctatatggatttctgttggtctttcaaaatacaacgc

SEQ ID NO: 105076 - DNA, 1860 bp, Homo sapiens
tcttaggttataccatctttatatgctattgcgtttcaatatttaagatttaaagtgattttttggtcacagtgttttgttgataaaatttttttagaattgaagtttgaattctaagacttgaaacaacctgatcactgaagccaactttgtcccagcacattccttaagtcctaattgggaaaaaaaaaaaaaaaaatgaaatagttgaaaaactctggggtgtaaacaaatgattgtaaccctacacactattcaataagtagtagaaggagcatcacacagatttcagtctaatctgcccttctgtgggccataatataaacataaatgtgtgtaatgataaaaagtcattttcttcaaagagactacagctagctgcacattgtgtagagcagcttctaaattgttagactttgtgttgaaatgtaatattctatttattgagaaagtgatttaaaattattatttttaatcatagaaatcagggtttgggctgtattgatattgtcgatcatgaaatgtccacacttattctaagtggccaattatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattgaagtggatgtgaaatattgtccttgcctatagatctcaaaatctagtactaattgttggttgttaatatgattcatacaatagacatttgttaaaccagcttttgagtggagaaaattattttccatttaaacagtacagtgatgatagctatcaaacaggtatactaaaaagtcagtgactgtgacagtttaaagtgttagacaaatgatgtataaggttctttagtaaggaaagattagccaaaaattttttacccagctagaagcttttaaatctacacttgatatctctgttctaggtaaaattcaaacaaccaaaaaacagtggcccatctgtagcttatgaatctatttaaaattgaatattttatgttgacttctttcatactagctgaaacttgctctaaagagcttcctttggaatctttagatttctttttataaggttcaattcagtacatccataaatcgacagaatgaagaaaacataacaaaaagccacctattccttcctcttgctcccttattagctaaagtaaaatttacatctgtaagacttactgagttgctgccaaaatggaactgaattcttaaaagcaggaacatgcctatgtgaaacattagaaaaccaaaataaatgggaaaattcagacttgaagag

SEQ ID NO: 105077 - DNA, 1015 bp, Homo sapiens
atttatctcctagtcacagtgcctcaatgatcacactaacttggaaatcttaatttcatcaccagttctagaattcaaattggtgaagtgttatcgaattttatgatcacaaatgtaatgaaaactgacatttagtctgtgttttctttttagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaaaactttgcctttacccaaccttccaccactgcattacttggatcaacataatcagaactgcctttataagaattaatttggaagagattcacgatttcaccatgaggacacttatctctttcagtggtcctcccaagaaattatttaacaaactgaaaggagattttgattaaaattttgcagaggtcttcagtatctatatttgaacacactgtacaatagtacaaaaaccaacatagttggttttctagtatgaaagagcaccctctagctccatattctaagaatctgaaatatgctactatactaattaataagtaaacttaaggtgtttaaaaaactctgccttctatattaattgtaaaattttgcctctcagaagaatggaattggagattgtagacgtggttttacaaaatgtgaaatgtctaaatatctgttcataaaaataaaaggaaaacatgtttcttcaaattgcataatggaacaaatggcaatgtgagtaggttacatttctgttgttat

SEQ ID NO: 105078 - DNA, 1044 bp, Homo sapiens
aaaaagaagtaatgcccctagtgaaagcactttcaagagcattttggagattattatctagattgcagtttaaacaaaagtttctctatttgtacaatgtttctcaatactcagaacttaccatatttgttactttccttcccttagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccaggtaaaattctttctttgtatgtaatcgttctttcctcattgttccttttaaattccattccttttttagtactagagcccaaagcaatagaatatgcaaaaaaaaaaaaaaaattaaaagtagcttatcaaatctgtcatccctctgtgtctttgcttggagctaaataatttcaatgtaattataaataaactgtgcttgttcaaatgtacgtagaatgtgtttatgtgtcttgagtcataataacatacatactcagttcccagtcctctctgtgcctgtggatcaacaaaatcagatgctgccaatacctgacagagacaataaatgcccagtaccccaaagcaaaagagcccatgtggtgaacaaagcatctaagtgtttttgcattgatttccaaaaaagggtgctagcatttctcagtaaagagaaaataaaagaaaggaaacatttagagaaacaggaattactgagaagacccagcaaactcagaaatacaagggaggtcaagaagccatttgcatttaagaggccctggctatgtttttgatattttaggcagaacaggggaaaaaaaaatattcctttcattgtaagaaaaggaagagtaattttcattttaactttgaaggaatgtttacaaaagaggatttcagccaggaatggagtttaaatagttgtacctgctgtgctttcatgaaaaacaaagctaaagagaccacagagtaaaagaaactgc

SEQ ID NO: 105079 - DNA, 1046 bp, Homo sapiens
ctttgtggatgactacctgtcacgcccaaatcctgcaaacttttctacatagggaaatgaaattgggcttatttcccctgtagcttttctcaagagacttcatggactaatttcccaataatcatagtagctaccacttattgaggtcttgctactgcacggatcatgctgagtacttcaggtgtattaaccctcaaaacaactttagaaggtaggttatattatgcttattataaatcctccagagtcaataaatttgcctaagtccacctagttagaaaatgattaggctggggttggaaccaagatggtctggtttggggatctagattcctaattgttatactgtactgagactagtctgccttaattgacataaactacttgtccattatagcatgggtgttggaagactagaggttaagagaaataataatatccaacatttttctagtgttttagcattcttcatatattatcccattgcattttcttagtgtaataaaataacactcggtttatacaccaggtagtcaaacatcatgcctgtcttgtgatctcaatggaaaaatgaagtgtatacctcaagtgatacagtcttggctgaatcatggaacaattatgccatcaggaagtttaggtattctgagtaaaacaggcactttatttgaaaggactgggagacttcacagatgcatcaaatatgttgaggatataaatgccaggctcaggtggatttactgtgaagtgcttgaacttaaccttcaaggctacctataccctggtataggtccatctcctggctctaggagaggccctggcaatgtggttaacaagtgtcatcaagtcaaatactacgaaatcttgcagtgccctgaatcttacagctcacatataaaagaaacctgataaaagttttccaaatttgaagtcaatccaaaaaatttatatgacattacctgtaatgaattatgaagctgaaaggaacttttccaaattattcaagaataaattacaaattctgatctacatttctaaagggaaga

SEQ ID NO: 105080 - DNA, 1043 bp, Homo sapiens
accaaaaaatataggagaattatttcagaggtatggcaatcagttaataaaaatatttgttttttaaacacttcatatttgtagtatttatagcttttaaaaatttgttgtttgtatgatactatttaaaattttttttccagagatgagatctcattctgtcactcagtctggaaagcagttgcataatcataactcactgcagccttggagtcctaggttcaagcagtcctctagagtagctcggactaaaggcatgcaccaccaagaccggccagttttttgttttttgttgttttttaatttttgtagagatggtgtcttactatgtaccaagtctggtcttgaacactggggctcagaggaacctgtccacctctgcctcccaaagtgttaggattacaggtgtaagccactgcacccggcctgtatgccattttaattctaaataaatattcactttattcttaattttatattcactttattcttaattttgtattcttcttcttaaagagtgcccctgaaatttacaagcttcagattccaaagacctgagtctttgactaatggtaggatttgtttgttggtttagaaaataaatgttaaaaaatgcctcttcctccttccccccattgcaaacagagactgaaatctgcattgttatttcacaaaaccaaaatatttttcctccaggtttagctaaacccttcatcattttcctactttagagccccatgccaagtagaaaagaagttgcaaagatgtaattatcacaaaccttcatcttggatgaaagataacctagctctgacccttagtttgagattagaaggactctacctaggagacagctggtaaagactaaggtatgttgtaccaggaatctaggtgtctgggtgaccaggctgtctttcttcccactggggctcattttccttctatacagtgacaagaattggactaaataagatttccagtattttctcttctgaaacatttcattctttgttatccctgtactattttgttagtagaataaa

SEQ ID NO: 105081 - DNA, 1015 bp, Homo sapiens
gtcttgaggaacttatttgtctgatgctcagtgaagacccaataaatttctcttgaattgctcaacatttgttttagacttttctgagagtgccactgtaggctttttcattgatttgctcctttattttaatatcataaggcagctttttgtgacttagttacttttgtcttccagaattatgggtccctgtcagttattaatgctcttaattaacagtagccacaataaccagtccttacaagcagtttctgatgtttccaaataattttattttctgacttttttttctttgcctttgacatctgaactatacttggcaagaaaaaaaaacataaaaactttccattgcaactcatatctcatggtgattcctgttgcatcaaatcttaagttatccatcagaaaagttacgcaaaatctataaccatttggttttatttttgcccttgaattatgctaccgtaacacaaacctgaactcttatatttgtcatctgtaaaaatcacctaattggtctctgcttatggacaccctttgttctttctctgtcaataacacaggcattgccctcagttaaatctccccccagatggcattttgaatagctggcctctgttagaaagccttccatggattttatgaatcctagatcatcacatggccttccctttctctttgagcatgggggctgcctcagtgtcccttggctcctaagagagtgccttgtgctgatgggacacaggaccagtttgatgactacgtgcacagatgaagccaaacctcttgcccatcatctattccacccttcacatccctcatgccctggttccacttgaacccagctgcctcacacatcctttttgcttacaaatttcctagcttgtgaccattctccaccacctccccccaagttttaccattctctatttgtgccctacaacggctccaccctttgaaataacgcctggtctaaatgttactttttctagtgggccttccttgattatccatc

SEQ ID NO: 105082 - DNA, 1029 bp, Homo sapiens
ttctgatcccaacattttcctcctctgatgttggtcatgtcctcctctgtcacttctgaccatgagtatagggattgttgttgatagtcagaggagaaagaactctctgaaatgcttggtagaaaggaaaaagcatgaaagctttctagaaaggtaaaggagtttcatcagagtaacggtaatacaatgtgagattcagaatgttcttcctggtttagtaatttcaccttcacaagaaggggctacatcaaggcttccccagggtagctttgcagctacagtcagattgtgcagattcactgagacaaaggcctagggagagaggagaaagcacttccttggcggctgtgttgggccagctttactagaagtggagtctgacacacttttgtgcaatgatttattgaggataagctctcatgagaaggaagtaagagaagcaggaagaggcatggaaggagttaagtgaacttgtatttcaagagaggtctaacctcagcttgatctcactggaagctctggagagtgtgaattgcaccatagttacccaccaagagccaagagaattggactgttaaacttcaacattaatttgtcatcggctatacgctgcctctgagagtaaggcggtcatgtccacgaatctctaggataggcaactcccattggccaaggacaatcccccagaaaagggtgaaggtgtgagcccttatgagccaacacctgtggcagctgtaggctgctggccctagcttggtcaaggggaccttggcaggcaccaactgcagctgctacataagccaaaacaattgaagatggaaggtctgtggactgtaccttatctaaggaacaatttatatcatatacaaatcctatcctttactattatatggtagtacatatatctcaaggtatggtaccaagggggcatcatatttgattagattggattacaagataaatctgaagaggaacatggaggtagctcagttcagtatattcattttatagaagagaagaagtacatga

SEQ ID NO: 105083 - DNA, 1532 bp, Homo sapiens
taaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaatccatttgcctcatttggttattttgcaatttatgcagaaaacgtcaccaagtaaataatctccaactttttcatactgtctttctcaactgacagtctcacagtccttaaaaaaaaaaaaaaaaaaaaaaaaaagtcacagaagctcagtaatatgagatgaagcagatgctgctcatggcctgcctgccatgct

SEQ ID NO: 105084 - DNA, 1113 bp, Homo sapiens
ccaacagtttaatagccgacatttattgaacgtacacattttaatgagaattaggataaaatattaactgcctctgttatacagagaaagatgacatgcttttcctcatagcccaaacggtacatgctgaaatgacagcagaggatttttgtctgtgttccctgaaccaaagttttatcagtctaaaataaaatttgtgtttttattttaatttgtttggatatttctattttattgtctttgtgtatctattccctagtaagttctacgttatcttcttttgcttcctgttttggctgtttaatggccataggcctgatctgaaaagtgacaaagtgaaatagtcccaaattgttgcttactagtcatgtagcattggacaagtcacctgcatgggttgccctttctgctcttaaagtcagttgttaatattaaaaaagcttatctgaaagcattttaggaaattgttaaggaacgtgcaaatacagggtagtggtaaaggtgaaaagccctacgaaaaccccttgatttttgaccttcatttattcactcattcattcagcaagtatatattgaactcctttatgccgaccactgtgagtgaactgggatgcatggggattcagctaggaacaggaaagacagggctcctactctcagagagttcaccagccagccctaggaagggaggtattaaccaaatcatcagatggttcaggaccaaaatgcagggtgacaaacactgtggaggacaggcacatggggaatttgatctacaccagaaggatgagaaacattaccctgaggaagcagcactggaagtgatgatgaacggacgaggagaaggagaatggaacgcgttacatagagaagcacgtgcaaaggcactgcagtggggcaggggaggcatacgagtaacccagaaaagtggctgcaatgcagacagtgggacaaggtgcagtaggagtcaaaggaatggccgggtagtgtaggtccttttaagaggtgttttttgcttcatgttaacttcagaatattgagaagccataaagggttttaagcagcatgtagtgtatttgagatagagggagagagttgatcagatgtgtgttt

SEQ ID NO: 105085 - DNA, 1623 bp, Homo sapiens
tcctgctggtcggtgcggcgctttccgcgtcctttaagacgagtttgaccgaggccgctccgcagttcccgcccctcggcccagctcagctccatgaacctagcggagccgcctagtaccctttctcgccgaccgcacaggcgcgcgaaaccgcgtctttcaactgacaatgaagccgtagccgcgcagctcggccactccgggcgaatcggcgcgaggccgggatggtgggggggagggggagacggttgggtcaagctccgccccagctcgcgcccctattggtgggcgcagcggttctgggcccgccccctaacggacctgtcgctttgtgacaggcggaggggccagttcctgtcgggccggaggcggagtcagaggttgcttgagctccgcccggactccagggggctcctccccctgctcctttcggctgggcgggcggcgggctagagagggaatgtcattgcttctcagagccgtggtgccgcctccgtctgctgcttctttcctggcgccctcgtcccgtcggctttcgccgccgccgccgcagctgcactggggatacggatggctagtggggcgccggggccatctgggttgagagagcggcgattgcggccgctgctgaggcggagactccccgccgccgcttcctccacccccagtccgccggcctcgcggcgctgagggcgggagcgcgcagagctcttccctcctcctttttcttcctcctcctcctcctcctccgggtccccgcccagcacccctcgcaccaggcggcggcggcggaggaggagagctagacccgccgccggggcacaacatggcggagccctcggccccggagagcaagcacaagtcgtccctcaactcgtccccgtggagtggcctcatggccctgggaaacagccggcacggccaccacgggcccggggcccagtgcgcgcacaaggcggcgggcggcgcggcgccgccgaagccggccccggcggggctgtccggggggctgtcgcagccggctgggtggcagtcgcttctctccttcaccatcctcttcctggcctggcttgccggcttcagctcgcgcctcttcgccgtcatccgcttcgaaagcatcatccacgagttcgacccgtggtaagtgcctcgccgcccctcccccgcccgtggcccgcggggaaccgggacccgctcctccgcccgccgcagctctcctcgacttggccccgcgccgccgcggagccccgctcgcgtcctggctgaggccggcgcggatcccggagctccgggcgcgccccctgcccgtgggcgaagtttgccccgtgcagcctgaggcggggcgtcggggtccaggagcgaaaccttgattctcggccgggctagtgtgaagactgccaggagtgtggatgcagccgccgggagtgtgggtgcagccgccgggagtgtgggtgcagtccctcgcagcccgctttggtcgctgagtccggacccgccacgccaggaggcggcaggtagctcctccgcggactgtcggtcgattccccgccctcctcgcccgctgctttcgcgttctttcatatttgcgggcgcgtttttgctagttcagacggaatcggccag

SEQ ID NO: 105086 - DNA, 1908 bp, Homo sapiens
tagtagtaaggagatttgtataataatggactgtctcctgtgccttaccgtgaatggagatttgtcagtatgaatctaatataatgtctaattcaggtgacttaatgagagaatcaggtttcagacaaaaaaaataccttgttcttgtttttttttcatgtcttttgaagatctcacgtagttaggcatctcattcattcttatctgattcttacagtcattctttttgaaaaggttaaaaggagggggatgtgtagattgcctgccattattactttgggcttttaaagcttttcggggcttttaaatctagttttcttctatagctactaatagtcgcaacactttaactggtctgtagctgaacactctagtgtttctagtttgggagttgctcagatcaccatcatatcatatagcaatggcacagacctttaataatatttaaatgttactctcaggctgtgcatccacaaaccgatttattctggcctgctcataccttccctgacctctttttccatatctctatcaatggtttcatttctgcaagtcgttttagtgaagggtttactttctctgtgagctatttctttaaattttacagtagttcttaaattgtgtaaaagactcaagttagctgctgaaagtgacgtcacagagttatacttgttttttaaatttgtcacccaagttatttatcttaccagttgtcataaggggtgatgtgtgatttatttattgaagtacactgcacttttttaacatttagcaacatttttggtaacaatttgacttcactttagtaattcctcccttatcagctgagttgaacagataggaggaagcagtttgaaaatatattgtctgtacttgccaaacgtttggttaatcagccactttaacagcacttaactatacctttttatctggaacaaaatgtgttttctacatatttttattgtaagagataatacttttactttatattagccagataccttctccatatccattatcttgttcaattgtggtagcctttcccatagaagcaatgaagttccctatgtgagagctcttttttccctgccttagcaggttataaagtgggttctccctagagagaattctctgagccttaggttttggctgtagttagcaaaaatgcagcagacgcctttttgctgggcagaaagttgcaagttagagttggaacttagaatgcaatttttccgaagaaactatggtataaattggttaattagtacagatgtgttttcaaaggaatgataaacctttggaacataagctgttagaagttggggactacttcctgtactttgaggtctccatgttttccttcactttgcagatgacaaaaagaggctgttgacctcagttctgaagaagacaaattggtagccaaaccagttttagaacacaaacgtccccaaatcttaaaaagtcactttgtgggatcattagcatcagcagtccagctgcacttcagaccaggtatcactgttactgattgcattgacaattaaattgtatgaatttatgataagattggtgctactcccatttcggttgagtgtgatggcttccataagtagtaatcatagatttcatgatgtataggccctacggtagttagggtctgtcatgaatgcccttgggacttttccttccccctttatggttttcatatcgtaaaggttaacttgggtaggactgcatgccccttactgccatgagtagtttgcataaagacaacattggttataaacattagaagctcaatataaggatttacatcataatctctgacccagttgttaatgaatatgggctaacttaactagcccttctgtacctaatcaatttttatactctctataagttttg

SEQ ID NO: 105087 - DNA, 1030 bp, Homo sapiens
caccatgataaagaggatttatttctacatagtgtttgttttctatattatttgaacatatgtatatacatgctgtttcagtatcctcagagtgaagttaggatcagattccatcattccaggttttggttagcaacttacctgagtgcattgtaaatcagtgcattagccccacatctgttaaatgacttgagtttgctgaatctggtgtctcagaagaaactctaaagtggttagatggatattgatgttgatgttggttttgttaggtgtaatttatgtgaaactcctaaattccttgaattattagaaggcttttataggtcagcctgttgtctctgccatctttcatccagaggtaatggtttagctttagtgtgattgcaacagtgacttctgtaaatccctgcaataaataggaaaaaagaaaaacatttccaaatagtataggacccactgatatactatatgggccaaattaatactgttgaaaggggaaaacctgtaaatggttaacctgctactctgtcttcaaccgtctatctacctgattctggtggatgctttttgtatttaaaccagtaactcttctgagaaggcttctgttgtcctcttcttacctacttctgaccatgagtaatttctgggaatttagaaattgatagaaagtggaatactgtagggttttttgtttgtttttaaagtcgaatatattaggaggtgaggattagcgttgggggagataggatcagttgcccagaggctcccatatttaggtaaatgtatgttaatctgcatttgtaggcttgccaggaaatctaaccattatttagaattttatgtctttggaaaaatacttccatagtttcagatgaaaaacatctaaacatgttttggaatataatgtgtacataaattagtgaatgcctctttatgttgttcaaggttgtactatttgtagacaaacaaatctctaaacaattgtgactgttggcactaattgaccactctcaaccatgtctatttcttt

SEQ ID NO: 105088 - DNA, 2024 bp, Homo sapiens
taaaaaaattatctcaaggctgaacccttgaggtggagtcatccttgactagagtaactttgacaactttgttttaaggtactaattgtccagagatttaatttttctacagaaaccaaaaatacaagaaagtgggtgggagagaagagagagacatcgtctttaaggagacaaatgataatcagataaatgcaaaatgactggttttaaactatggctttttgtcaactattaaagtattgtatattaaaattggcataaagaaggcattggttgcttgatacttcttgaaagcaggaaagagaatactggaactggaggtctgagctgaggaatttaggaaaaccctgggcatggactgtttgctgtattgatatatttgtagagattgtcaatcctggttttgaggtattttgttgtttatttgtgtagatgtagcaattttgcatatattgcatttctgtcatagttaattctttgttgaagaaaaatttaaatctaggactgtctttcttcaaactctgtttagtcagccagtatttctacagaattcaaacttaatatttaaaccaagtgtcttagggtgggtatacgtactgtatcccatcttcacaaaatcccatgtgtacctgccagagagtaatataaatggctcaaattaggctctatttggatgatggtccaactgagtgatttaagctatttttaacgcctctagtgtatttcttgtagaattcctcaaatggagattcttttctgagatatattgactgttaagaaaaattccaggctggctgggtgtggtggctcacgcctgtaaccccagcactttgggttacacgagggtggatcatgaggtcaggagttcaagactagcctggccaacatggtgaaaccctgtctctactaaactacaaaaattagctgggcatggtggtaggcacctgtaatcccagctgctcgagaggctggggcaggagaattgtttgagcccgggtggcagaggttgcagtgagccgagattgcgccactgcactccagactgggcaacagagtgagactccatctcacaaaaaaaaaaaaaaaaagagaaagaaataaattccaggcctacttctctcagaaatcacaattgatcatctgtgtcttacgtgagaggtctaggtacaggttttattaatacaaaacaaactaaattttacttaggactgtttatttggctaactaggccagagccattttgaagattttaacacctgtgcatgtaaaaacactcaaggagacttaagttatttgttctttgccaaagttggtaaggtactgttatgattatttaaattttggtgctcatttttcctctaatgaatataataataacttactactattattgtagggaggcaaaagattctttaaggcaagaacatttttctaatctttctagaatatcctacacagtattaggaacatagtgagtgcacagtgaatattaagacagatcctttatctttaatggtaaccacattttatgttttggtcataatagtaatagtacagtaagtctctgttgtgcaatactttgaaattttggatttgactgtgatgtcagtaagatcacatgtgcagtgaacatcataatcccagtttcaatacacatgtcatattattctttatagaagaagggaagagttgatgaagaaaagggataatgcttatggaagaaatggtatatgtgagcatcatgacagccatcaacaattgggagatgaatggctggatggataacttaggaagaactttgaggaagattttagtttcttgagtatttcttccaagtacaagtaactcttacagaggtctgtctccagtgttaactcactagttagggaacattgaataagagaagacagaccagttaatatacaaaaaccatatgagttatgaaagttttattatttttcaaatgagaaatgaaaaaagacagatgacagcaatagaagtaaaattcacaagatgccatttta

SEQ ID NO: 105089 - DNA, 1916 bp, Homo sapiens
tggttttttttttttttttttaagctcatcagctatcgttagtgtattttatgtgtggcctaaggcaattcttcttccactgtggcccagggaagccgaaagattggacacccctgctgtgaaaacaatatattgctaatttttgctttgtttggagcttaaaaaatggtattagcttatttatcctcctctttgactttcatttatacatctgttagttgacagacatttgaatatccagttttttttctattgtgaaacatgctactatgaacattaaaactgttttctgatgcatatgtgtggatgtttgctggggtatatacctgggagtgggattttgtcaaaatatgcttcagttatttatgaaaatataccactccaaaacttagtgacaaaacagcattttattatttcacaattttgtgggttgagtggggagtccttcagcttcatgtgtcagctgaggtgctgagatgattgtagtcacctggaggctcaataggctgtagtcagctgggactagaatgtttgggatgcctggacagctgagagtcatctggaatcttgttccattgggacctcagctggggcttttggctcctccatgtgactgcttagtctgcctcagcattgcagcggggttctgagaaagaacatttcaaagggggagaaagctgccaggtcaactaagggttaagcttggaatagacacaagtaacttcagctatattttgttgttctcaaaatacacacagacctagctcaatgttgagaggagatgcatatacaggtaggggcagaattgtttaaggtcatctttggaaacacttaccacaatgtgtttatcatttttatctcccgtaaaatatctgttcatgtctctcccaaagttttagactgggttgtttagtctcactaatttagtaggaggttatatgtatatgtattttgcatcctaagtctgggttaaatttgttgcagatatcttattccagtttgtgcctaattggtccttaaagcaatcctattagatattttattgcccccattttacagatgagagagtactgcttagtatgttaaaaggaaaggccttgaagtcagcctccagggtgacatttttgttacaaagaatagcatttgcaaaggtgtacaattatgaatcagcatgatgctttgctcaacctacctgttgtaccccttcccctccaaataattgaggcttggaagaatttacaagtatttttatttacttataaatttttatgtaactgtgacttttgctatgagtggactgaggacgtttgatgtgagaggacttgcctggagtgacagagtaggcagtaagttcagccccaagttctttctagtcttatctgccctccttattcctcaattttttttccctaaattattcgtttggatcaaccaggttctgccagcatattcaaaatccatcttaaatgtagtggcgaaatattttgcaaaattataatagaagccagagatttataattaatattcaaatgtttgcattatatactttaaaaagaacattgcaggtcgggtgcggtggctcacacctgtcatttccacactttgggaggatcacttgaggtcaggagttcgagaccagtctggccaatatggtgaaaccccgtctctactaaaaatacaaaaaatcagccgggcatggtggtgcatgcctgtaatcccagctactcgagaggctgagtcacaataattgcatgaaccctggaggcggaagttgcagtgagctgagatcgtgccactgcactccaacctgcatgacagaacgagagtccatctcagaagaacgctgtaggcacgcatcaagtacaactcagttggtttaaactgaaatgccacagaacaattctgaattccaaaat

SEQ ID NO: 105090 - DNA, 1135 bp, Homo sapiens
gaaaccagggcccctcagtcctataacctcaaggaagtgaattctgctagaagcctgagtgagcttggaagcagattatttccctaatttagcctccacataagaacccaaccctggtgacatcctgatgtcaaccttgtgcgaccctaaacagaagatccagctaaactgtgcctagattcctgacccatgaagctatgatagaattagtatatgttggtttaagccactgagtttgtttaaaattgctgtataagcaataggaaactaatacaaatacccttcgtaaacctttctttccatctctgaatgttactacctaacttctctctgatctcatgtaatcaaaaaatattgattgaatacctcttacttgccagggactatggctacagtagtgtgaacccaaatagacatgattctagtttagtgagggagttagacttgaaccagtaagaatgaccaatgctgtcaaggaacatgatacaatgagagcttataatagggagataaactaaacacattgtctttttaggaatccttatttgacttttaaaaacttatacttactacattgctttcttacctttttttttaaagcatatttctgccatcacaaaacttgttctatctttattttctgttagcattatgaaaactacctatgtgtattttttaacccttacgagtgttctttcctctctcaagaacacttctcctcttttcctgcctttttgctcaataattcatccaggtttaagttagatgtcagttgtagaagccatccacgagtcctttggacagtaagctttgtgaggacaggtccgtcctgtttgctagtatctttagcacccagtgtgatacataagataggctcttaaaaccaaataaggccgggcacggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacgggaggctgaggcaggagaatggcgtgaacccgggaggcggagcttgcagtgagtcgagatcgcgccactg

SEQ ID NO: 105091 - DNA, 1205 bp, Homo sapiens
acctttttaaaaagtagaattacgattattccatttatctgaaatccgagaacaaacataatgaatctatggtgaaagaagtcaaagtatgcttggaaagaagtgcctaaaggtgcatgtgggaactttcatcatgagggtgatgttatgcatacagttgtcaaacctcatctaatgaaacatgtcaattggtgtattttaaagcatctaaattatactttagattttaaaaatgaaaaaaaatgagcgaagaaggtatcctttagtaccccctgggttctctgcttaattatattttcttgttgcctcttcctcctgtgagattgtcagctctgtgaggtcagggaccaagtttgcctgtggttcttagaattgtgtacttgtatgcagaatgcccaagtttattggccctgaagtgaatagttatttgagatctataatctattcatagattatatccatattttatggctgcatttttaagaaaaatatttgcattattacagaatcttacattcagtgtttttctttatgtagcttctagctttttctgttctaggattcacaaaagacatctgtttaagtgttggtagagtagtcttgctccaactacaattttgccaaccacagtttgagatagcacagtgctatatttgtaaaccaaagtttaaaaatcagattttaagaaacaaattgtggtttattttattctccttaaaaaaatgaaaactcaatattaatcttgttttcttgtgaatcccttcctgccagttcttaactttttgagccaatggaaaaaatgagccttggtcatttaatctttttgatcaaaagcccttaaacaccagagtaatttgaaaaagaaccaggtggttacatagctttttgtctaactagtactatctctcgttgttgttgtttgtttttgttttgctgttttgttttccctgatgaaaataatactaaattttaaatgatttaatggccgtgtcaaaaacttgaaagataagtgtgtagatagtctgaatttcccaaaaccgcgtcagcagctccaaggtgtaatttctctgaaactttaagaaggtaactcagagcagatttttcagtgctggtgagttttaatttattcatcaagtagatggctttttattgtgatttatgttggaggtcttctaaaaaataattttgaaattctgcaaaacttt

SEQ ID NO: 105092 - DNA, 1074 bp, Homo sapiens
ggaagagattccgaaccaattgttaaactttaaatcccataaataatttattcaaatcaaaataccaatatataataattatggtgataataatggaagttctgtatctcttggaagatgttgcaaataatggacaatagaaacaataggcttaaccttttaacatgcctgcctgtcttctttccttccttgcattctctcattctttctttttcatgagaaattggtactttgctttctctcagattagttgttgatccatgtataacgtgtattacaaagatgaactggcctttttagaccaaatagaaattcctgtttcttgtttttatatctcagagttgtaaaagcaggaaggaaaaattatgtgagaacaaatgcttttccatttcttcattctttttgttacacttactattcaaatgatagcaggcagacattatatttctcattggacaatctcccaagtagttgtgtaacattatgtgacaaacttggctgtgatcagaggagggattgagataaaataagcatttgttggttgaaagaggaaggagttgttgtacatttttttgataatgaagtgtacacatacttactcataaccttgtaagaactaaacttcggagaagtaaagatgacaaattatagcttactgagaagagttcagttatctgaagattgacagtggttgaattggttaatataagaagtatgagaaaggtgccaaaaaggagagaaatgtgagctagagatagggactacttggctttgtttctttgtgatagtcacacttattggaggatttgtttggtaaaaccaacaattatgtatgacccttgtaaggtggtgagtgaggatggttgttactggtcaagcagtacttaataaaggtttctggccatgattttttaagacatacctataccaaagaattgaaatctgaaatggtacagtcagacatatattagacttctctgtccttttatttccaaagtaactttagaaagggcataagctttaaggttcaaagttgcatcttaacagatcttaagagaactacaccagtggttt

SEQ ID NO: 105093 - DNA, 4521 bp, Homo sapiens
gacacaaaggcaaatatttttaggatttgggacataaggagaaatgaaggtgaaagacaaagcaacattgtcttgtatcggagaaatatatgtttgatttttttaaatcaattttgccaggcttattcattttattagggtttttcttaacccaaagaaacttctgactctgttgattacttctagcataggtttgttttgcattttttaaattttaatttattttcttcttcttttgtgagtttattttcatgttctttttctgacttcttgagatggtttctcagtaattttcaacttttcttcattattaagagatgcattttaagcctagaaactacacactagccactgtactagctgcatttcataagttctgatgtgtagtattttcattatcatttaaaacaaaatgtatctttattttcattataatttccctgactcatggattatttagaattgtatttaatttcaaacataaggggattacccagttatgtttttttgctttgtacttcaaatatattgtggttagagaacaccttctatgtaatttcaatcctttaaaatttattgagacttgacttgtggcttaggatatatccaaatttttataaatgttccctttgtgtttagaaagaacatgttctccatgatagtaaggtgttgtgtttctagtctggggcatcttcttatccttgatgtaaatagagagaaagacataaagagatgaaggcacaatagtcgttatcatgttctgcattgtgaattggagaagtattaaatgggtagtacatacggcagatagctattatctgcagttcttgtggtgctaatcttatcatatacctaaattgtattacatttgataactatagtttttcttgtgcagtttataactttatcttaaattaatcctcagtggaagcctgttttctctaagagtcctgatgtcctgagatttgggatcatccctgtaataatctttcttatttgcctttgctggagaattttaggggtttcactggttttaggacagttttacttagtttgaggtttcttatacttaaggttattataaatgtagaacccacattgacacatttgaatgagtttcatattctcctttaggactttgtttctgctctgagcattggaaggcttgatggatgaatagaatttgtctagtttcataagcaggtcctgactttttgctggtaattaggtcttcactctgatccctgtgttgggtgaaaccccctcattttcattccttaaggcctgtatcaggcctggttatgtttggcttttttcttctctcctgtgggctcccatgacatcagcacctactttgaatttcctcttcatttttggcatctggagaataccctatcttgagcttgattatgctttttttgttgttggggttttatttgttgatttatttttggttctttcatttagtacttctatgaatcttggctgtttttgtgtgtgtcagttcagtctaccgtattatatggatatattgtcttatcttgaaaaatattttaaattcactttgtttttttttcccccccagtattgctgacaaaattacacactggtacctagtattgaatctgaagtagaacagaatttttatgtgttgagaatgtggatgaattatcatgcttttttttcctccccctccccctttctccttccatgcatgcagtaggtattgagcatccactttgtgccagttatttttctggatgctggggaaaaatttcctgctattctggagcttatattcttgtgagcgtaggcagttaataaatagaaagtaaataaataaaataaatagtacgtcaaatgatgataagtattatggagaaaaagcaagagagttaaagacgggagtgtgggggagagaggttgcagttgcaaattgtatagccaggaaaggaaatgtataacctttgtagtttctgttatggagtaaaaaaagagtcttttaggacttacctaagggagcagatgtaaatgcatgttttagtcactgaataataactcaggaagaatgtcctgttcactgttcttgaatccttttaatatttgatgttcctcttttagagtgagggtacgtataactgttaactggcctcttctagtttattatttcccttttatccctaagtactttatgtggtataaaaaatttaatttttcaggagtcccaaaacattatctctggattcaccaactgactcttccctcttttcctagctagactgttccctcttttccttgcttactttccaaatctagggcttgaaaggagggaacatttttttataaatatgacttaaataattttgtgtgtaatttttctttatcttccttttctcattttcttatgtacacacaagtatgggcaaaattggagtatgttagaactccaaactcaaggataagctagactaagaccctgttttgataaaaaaaaaaaaaaaaaaaaaaaaaaagttagtgggatcagtaaaaaagttacctacagttaacattgttaaacattttgaattttaatcattcttgtttcatattctccctgatctttttatgtattcctccagatatgagctagttctttgtatgcaacacaaaaaggtgtgggtttttttttgtagtttataaagaaggcaaattgttttgagatgttgctttcaaacttatgtaaggtaaacaaaatgtaatgatgaagagtacatacattaatatttttgtgtctcattttatatgtaattaaattttccatttttttcttcctaggtttacccagggttgatgataaccgctggccttattcattggattttaaatacattgaacataactgttcacataagagacgtatgtgtgttccttgcaccaacttttagcggccttacatctatatctactttcctgcttacaagagaactttggaaccaaggagcaggacttttagctgcttgttttattgctattgtaccaggctacatatctcggtcagtagctggatcctttgataatgaaggcattgctatttttgcacttcagttcacatactatttatgggtaagtgacatttaatgttttgctgccattattactcgtgacctttctcctgaaacactttaggctgtacgcagatttgtcttttacaaattatgtagttgcgtacagagatctgtattactgttcataatcaatttaataatggataacattttaaaatatgttaggcatctctcaagttatgtgtaaatatcctttttaaataagtcagaactccaaaagaagagctatcataaaacaatctgttgatatttttgtttctttgttttggggagataggtaagaaatagttacccaggaaagttgaagcatggtttgatggctaagaattttaaattgtttctgaaactagcattatttattttgctgctgccaggctatttaaacttaatgattttttcccctgtgtatgaaatatgatgctacttgggttcactttagagcttgcatttatttatgtatttattattttagctttagcttgtaattttccagtgatagaaattaccaaaatttgtgtgtgtcaatatgtttttgtatattttattaagtatatttttaggtagctaggtgaatggcagcataaattttctctttaataattattttatattgttcaaaactacttggctaatgagtatttttgctctagcatggaattctggaggagaaggttgcaatgtgatcagtatagacagtgtcttaatcttgagtttaaaagagaagaaagaaaaatacccattcaagtgaagatgataccaagcagtaggatgttgccagtgctgctgtacttatcaaaaagtgtttttaaaaactctttgtttattgtgtgcagctgaggagaaaaaaaaaaaaacaccttaaaatcgagaacctctgttgaatgccttttaataaactatataatattttaaatcataaaaataatacatgcgtatgtggctagatcctgataatataatgcttagtggaaaaataagttgtgataaaatatgtgcagtatgagaaatccttgatgtaagtttttaagcagtacaaatcatactatgtctgttaatagcagtttataaagaaagtataaaaatgtgatagataagctgcatgtacgccagctttgtgataatgggttttcctgagggtgggtgggtgatactgaggtgggcaatattaagggagcttcacctagctcagctaaaaaaattttaaatcaaatattctgaagcaaatgtataatttttgaatttgaaagtctgaatagctaggttcataactattttaatattctctacacttgtgtatgtttcaaatactttataataaatttaaaaaataaaatattctattttgtggacatttatgcaacagaaaaatacaaagaaaaaaatcacccacagtgaactaccatttgcatttttt

SEQ ID NO: 105094 - DNA, 1130 bp, Homo sapiens
taacaataacttaaaagtgtaaagagcactgtcaatgtaagctgcaatgccttatcagagagaaggtacttaaagattgctttggggaacagcaaacttcttcaatacttaaaatttcatttgaatttgagtcagacttttcagtgccttttcttttctagaataattcacttgagcacattaagtcaaggactatggtatatttcttctctatatctgtctcgtcccacccttggatataaaatatttccaagaatgtagacatctttaggttctgttgagattattacttatctgtcccagatgagagattttctttggttaagaataaacagaataataatatatgtgtgtgtatatgtatatacatatctttctaatggtaattttttgtggaatttttctcacacattggaattatcatctccagtaatgaatgccagtaactgtgcatccacaggatggcagtgtggtaacattttcatgatgtaataaatgatttacaacactattggtatcatgtatttccttagagctcaccactttgatggaatgctttattcttctaacttaaagggtaagaaaagtaggtttacatggatggatagaaaattgtaatagatgggtatagtagtttagttagggttcttaaagagttcattggaaggagaattggtagagaatgatggctatgggtttgtcttgttgaggtcttctgaaaacactagagaacagtaccagacattaattacctcttcgaagtccatgtcaagaaaagaagagatcttaagttttatagagcctttcccccaccaaatgtcacatgacctttcttcctaatattatggttatttgtttacatctctgatttttagcaatttatctgactcttagagggtaggattgatcttaatgggattttctgtttttagaatatattgaccatactcaagttaatgtttaaatgcataaattgaagaggtaatttctaaacatatattagatgctgtagtacaaagtctggcaaaaagcgtatgttttcattttgcagtggagattgtgtttctttatttattttgagatggagtttcgcttttgttgcccaggctggagtgcagtgcgatttcagc

SEQ ID NO: 105095 - DNA, 1050 bp, Homo sapiens
ctgggaagaacttaaggcctatttgttcatattcttcttggtgtctctgtgtcttcatcttttcctctgggtgttagaaggacccctctggaatgaggatcttataacctacttacaggaaggtcagagaattattttatgacctgcctcaggggagaacaaacagaaaagatgagagagacttcccagtttctgctggtttctcaaatgccaagatgccataatttggcatgagccctgatacaaatttagaatcttgtctaaatgtgtaattaaggtcacatcttattactcagttataaatagtaactatatatcaagattatcctgatcctaagtctttgtatccttcagcaaaacaaatcggagaattgtttttcagtgattttgaaaaattacttccctccaccccagaaaacccccctaaaatatagaggaaagggaggaacttaatgtgttaaataggcttgttattcaaatgggattttttttcccctttggtctggtacatgtgtaaggagtctgatcatttaggaaaaaaaaaaaaagtcacagaattttttggatgtattaattaggcaactgtcatttgacaaaggaaatgttggctagatgaaataagtagtctttgatatgaatggtgcaggacattctaagaagctctttcaaatgaaagtttttaaatgaccttggaaaactgctttgttgattatgtgacccttttctttaattaggtgtctttgcattgctgcaagcttatgctttcttgcagtatctgagagaccgattaacaaaacaagagttccagacccttttctttttgggtgtatcactagctgcaggtgctgtgttccttagtgtcatctatttgacttatacaggtacgtgttatcacctgtagggtgtgaatattgtctatacaaacaatataagaaaaatagccaaagtttctaaaatctgaataacagcatgactacaaagtgatttttttctttttttttttttttgaatagtatatcttaattttgtggcatcaagctctgataaatc

SEQ ID NO: 105096 - DNA, 1065 bp, Homo sapiens
tgctgacttaaactacagaacaaattgccagttgaacagagatttctgtattggaattcagagccaacattctcatgtctggatctagataattctctgaattttacagagggcatattagttttagttttaccagtgtagaccaaacagaaactatccagtataactggttaccttggaaggtatatttaaataagaaggggtagggagtaggtaccatttctacaaccaaacaagatttcttcatctaaaaggaactcctgttttatcacttaattgtaaacaatattaacttttttaataccaggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagagtatttggtaagagaggtttttaatgaatactttgatatggaatagttatttttctttttgagattatttactttaaatttttgtttttctatgtttgactctatatattcaagataaattttctcctttattttgcataggtgcttaaccaagaaaaattcactgagaggctgggcatggtggcacacgcctgtaatcccagcactttgggaggccgaggcgggcggatcacctgaggtcaggagttcgagaccagcctggccaacatggtgaaaccttgtctctactaaaaatacaaaaattagccgaacatggtggtgcatgcctgtaatcccagctactcaggaggctgaggcaggataattgcttgaacctgggaggcggaggttgcagtgagtcaagatcaagccactgcactccaccctgggaatcagagcgggactctgtctcaaaaaaaaaaaaaaaaagaaaaaaattcattgaatttgtattaagtattttgattgttttaatttaggactagtatattatggtttctgagaggttaatgttgtagtttgtgtttgagaattgaaaattttaactttgttgacaatagccttgactttg

SEQ ID NO: 105097 - DNA, 2475 bp, Homo sapiens
tagccttcagccagaaatagttagagtcttttcctgtggttagcacattatccagaaagctctggctattggaaatttgtttcaaaaattttttttaagtttcttggcagtaactttgcaggttcctcctttgattaataacttacgttcttctcatcccgtttttgttttaaagcaggttttatgccagatattggcactggctttttatagattttaaatctataaatttattttgcctggagatgtcatgcacaaatatgtttttatctgccagctatgggttttttatgatgttattgacaaatagtgaattaagtctaattcttcataactaattaaatttgaatcatatacatttttctaaactgtggatgtgtaggttttatttagtgaacactagttataatttctaaatgtggctaattaatcagttgttcagtagtatcaatttagaaacaattagatcgtttgtgagacatttatataattccaggttggttttatagttttaagtatctagttcagtttcctgggaactttttccctccaacatattgtaagagaatttgtctttgcagttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggtggggaatctaaagtaaggcctttaaattgtctatgtcctttcttaatttttccaccacagtaagaactatacatatcaagaaatgttattaaatgatgatttggacaaactgtgacttttctagttggtctccactgtttgcctcaaaatatgaatcctggtcagtcctttagctcagagttagaaaatagaatgtaatcagagaaggaattcctctttttggtaatttgttatctaaatacttaagatatatacccttgttaatatacccttccatttttgagagcaaaaactttatgctgtactaaattacataacatttggcactgtaaacccctctgaaaccatgtggacagacaggtgcttatccttgaggtccatactcagtgcatactttcaaaatattttggaagtgacatttgattggttgaacagtaaaatgaagggagcaaaatgccttttttaaaaccctccagttcgttagcaataggtaactggccaatacaggtaatttatttttaatctatagtttctcagttggtgcaagtgtgaaaaggacttgtaagaattagagcacttgtcttggatgacatattaaactttgctatttgaatattgcctggattttaaaatactaataaattaaacttcccagtatcagtaataactttgaaattctttccttctataagatgaatgtaattcataaagatgtgtgttaataaacccacattcctgatttttgtgtttgttgttattgttggggtttttttgttgctttgtggtttcttaaccagccttgaaatttagaagttgtgactttttctattctctcttcccttttctgttggggaaggtgattttttaaggtaatcgtagttttaacaagtctgttggttttagggtttcgaaatcggaagactgattctgttaatgcagttttttcctatactaaagtggtacatggtcaaaattatagctgagcattgccattttcaggatgtggaattcagattttataagaatttacatattaagatttcaccagaatggggtcatttggttaatctcctttgtatttaattaaagtataaggacaactgggtttgaaagcagcttcttactggagataattattttgctctgtgaccagtttctggattggtatattcccaggaaaccttattcacgtttgacttagaaaacactccatcacccacataagaatatctgatggttatacattttctgagtcatagaattaaattgatagataaacagtctctcaactttttccattgagtatcttaatgaagcaagtcaaataatgaatttgtctaaccaatttttttaatatctttaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatgggtaagaaaataactcggatacaaaaacattttatacttacacttctttttcgttgtctcaaaggatataattaaaaaatagaatgttgtttgtgagattctgcatttgcttgtttttaattttttattt

SEQ ID NO: 105098 - DNA, 3609 bp, Homo sapiens
ttagaaatgcaaattcttgacctcaccctaatgttacagaattagaaacctggggctggggcctagcagtctgtggtttaatagacctaggtgattcagatgcagctaaaatgtaagaacagctgatttatgtattgccatggctttcaactactctttcacttgggagcttattaggcttgtacactattaggccctaccccagaactactgaatcagaatcggctttttttttttttttttaaatacaagatatgcaggtggtttgtgcacacacacattagtttgaataacaccagtctagctcttcattgtttcacttttttttttctcattggtagaggcttttacttaataactaccatccttaaaatctgaaagtattcagtggtttaatacctcaagattttaagttagcctcttcacatttgtgacatctcatttaaaagagtattgtgattcttttcagcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtaaggatttactaaatacaaggttaaaaaatctttattcactccttagcaatcaggcttcacttgtgactaaataggaaaaatgtgggtgaaaagtactctgctgaattctcaaaatacttttttacacatatgttcaataaagtgagttcaaggtgtgcttattttgtttttaagaatgatactaagtatcattcagaattgcaggctgatttctggtagattttatgataaatttagcttactgaagaattagacaaaatctgaaacttaaaatgtttggcttgtatttttcgtgttataaactaaaaattatttgcaaatatgtaaagtaaatgcactgtattttatggataggcaaactgttcctctagctattaaacaactaatctgcatagattaatgtaatcccctctttgtacttcaaagatttttaaatacaaagagtagtcttaaccaaatgaattctatttgtattactgttgtagctaattatcagatgcatgctagactggggagaagaaatgtatgtgctagcaagatcactggccagccctggcctgcggttgtgagaagttgttttttctaagcttgcctgctttcatcataaaatgttaatgttatagaacttaattattagcaaaatattagagcatgtattctgatttttgactgtaaattagttatagtagttgagaggttcataaattccaatgcatttgttgaattcatagtaaatcatttctgcaaaaaaattccatgtaaaacaaactcttgatgaattccatgttgtagtaaaaaatatacattgatttttatgaatgtgggaataatcaaaaacattctcatttttttttaaattctgcaggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggtaagaaactagataattccaggtatgtgaaagatagctcactgtgtcctcgtaattctctcatcttgctaattgcattgtatttgtttcatcatcctatccctcagattagttccttaccctggctttactatttattaaagatagtagaggcatttcctatattaaaactttttgaagtcaaaatggaactaatataccattcttccctatgaagcagtcccttgccaagacttcttacttttacgtctcttcacagcctctcatgtcatccctttctttccatttccattgcttccactctagtacttacccttatgcttgtaaacctgaaataggatagtaaccttgaaattgctatctttgccttgtttcctccctcccagtgtaagataaaattgatcgtgttacttttaggctcaaaagacttcaatagattaagggaaagggtcttaaaaccatatagacatgagttaaaactaaaactgtcaacttgggcaagttattttagcaagtcaacataatatgctttgagcactaggtctagttctaggatctggaattaaaatggtgaccgaggccgactaggttatcttttgccaaaaataactaatttatagtgccgtttaatgagaatttatagtaaagtagttgaagccccagcctagggactggtacaaaatagataacctctgataaaacattagtataaagtgtaaactctttagcttggaatgtaagcctctttatgttttgccttcctttgctggtgtcttgttcttctgccacctttgtctactctgccagtatgttctagcccctgaaacttgcttgtgctttctttccttgactcacctgacacgtgtgtttttactgttctctttcctggaataccttccctaccacagacttgccccctctccaaaagcccttttctggtatactcacatctgtactcatcaccaaattatttatacctgttttgcaggagtccccagaccccaggcagcggaccagcactggtccgtggcctgttaggaaccaggccacatagcaggaggtaaggggcaggtgagcgatcattgccgcctgagctccgcctcctatcagaccagcggcagcattagattttcataggagtacaaaccctatcgtgaactgcgcatgcaggggatctaggttgcatgttccttatgagaatctaactaatgcctgttgatctgagggggaacagtttcatctagaaaccagcagccctccgccatccgtggaaaaattgtcttccacgaaactggtctctggtgccaaaaaggttgggaaccactgcttttttgtattagattgtgtcttacctctttcactaaattgtgagcttttagaagatggacatccagcattgtgcttttacatgatgaaggcacaaaagataagagtaattgccactgatccagaataaaggaatcttttgggaaaaatgtatgcaggtgtcgtgtgatgcagatgaagtaaagcctcagatttcctggtcaaatgtcaatgctgtaatgtttcccttaactgtgattagtaaacattatttttttgtattaatcttctgaaatttaattctcccagtatggtttttatttgtggatttgctttagcagtcagtgttaaaactgtgacatgtgatagatcactgtttctaaatgtatgctttgaacattaatattacagaagtcctaaatttctgtgcatcttaaattatttttaaactttgtgaatagataatacactcatatggttcaaaagtaaagtataagaggatatacaataaatgtctacccccttcacgtgattcaaaaataaagtataagaggatatacaaaaaagtctaccccccctaaaaaaaaaaaagttcctctataggtaataacaatgtattgt

SEQ ID NO: 105099 - DNA, 2556 bp, Homo sapiens
tcctacctaaaggattatttttagagaatgtgccaagtgattatatctctcatttttgtagatggttacagtcatcctcattttacagaaaacagggactctaagagttactaagttaacgtgtttttctggcacacacctaatttcctggaggctaaatcaggagcagcattaccatttctgattccttagtctagtgttacatattctgtcttgcctggaaattttaataattacagctcagcactttgtggttgagaagagggctgaagattcattcacttgatggtgaggatgtctaggaacctagtcctttcactttgaatgtgttagtgtactcaggtaagaaacaccactaacagtttagtggtgttcactgaactattcaaggaatccagtcacaagaagagcagagagcttactaagtcatcatagttcagtaaaccatgtgtgtgtttatagattttttaatcagtaagaaacctgcattaatactatgtgttttgtttttttatagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacagttgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttgtgttaagtgttgttttttacaaatcttttggttttgaaaggaattggtactgaacacatacctccttcttccttgttgactttcacaaaggttttaaagaaaatgtgtggaaaaaaatacgttagattatttcatcttagaccaagctattttatttggccttcttttaccctggaatgaaaatctcaggtttttttgtttttgtttttgtttttgttttttgttttttgttttgtttttggaagggatttggggagggggaacacctagccaactaggaattttatctctgtttaataaggatagggacctaacaaaaccatccatgaagttctggtaatgaaatgtcaagtctcagtatagaattttctcattagaaaaatcccaaaggaaagacccctcacct

SEQ ID NO: 105100 - DNA, 1049 bp, Homo sapiens
tcttccttcccctgttcattttcttaaggaaaccttcccttaccaggtcagtctctcctgttggaggcctccattgtgctggccaccttgccctcctacctttatcactgttacaattttgtgttcatttggtgactaatgaccacctttctcttctgctttctgagggcagaaagtgggtctgtcttgttcactgctgtattctcagtgccttgcacacagtagagcccacagtgaacgagcagctcacctctgcagaggtgggagatgtgacatctgtgcaggaggctctttggtttcccatcttcatttcttctgatccccagtgccctcttcacatgtttgcatgcctaactctccctcctctctccctggaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacaggtaggagctggccggagagactctggctttgtcttaacaagatgccctgagtttcctttcaccattagaagactgagtttcagtaatgggatgagttgaaaatcaagataaacttgttaaggtcttttccaaaagagatgccttttccctaccttacatggcagttttttggagtcctccccaccctaaacttaaggttaaatcttcggtgatgcatttgcagagcacacgccagaaaataaaagcacttctgtttgttggaataaactctcccttctgaagccacagtttgttgctttgctctaaagtgattgaatctatgaacccagacatagccagacagttccccatttcacattagctggctacactatcctcaattctgtgtcatgcatccatgaggtcaagatcatttccttcttttgaaaaactggggaagcccaagcctaagtaattgaaggagaggtctgctctttgaggaagca

SEQ ID NO: 105101 - DNA, 1020 bp, Homo sapiens
tgggaggctgaggaagacagatcacgaggtcaggagagcgagaccatcctggctaacacagtgaaaccctgtctctactaaaaatacaaaaaattagctgggtgtggtgccacgtacctgtagtcccagctacttgagaggctgaggcaggagaatcgcttgaacctgggaggcagaggttgcagtgagccgagatcgcgccactgcactccagcctggacagcagagtgagactttgtctcaaaagaaaaaaaaaaaagaagaagaagaaatggaaattctgtgcaacagagtgatacaaacaaaaactagaatatttagtattgaaaggattgtaggtcctacctgagcacagttgtatcttaaaattcaccttctttttgtgcttaatataagaatcccaccgttctgattattaacagtgctactacataccgtttgcattaccccaggatgattacagctgtctcacaaatttcccctggaagttttcactgaatgaagcatttgagagcaggacaaagcagagcatgataatgtgacagtttttaaagcagaggacatagtgagcctcatttggggtttatggcagcggaataatgtgaaaaaaatatgaattgctgcaattaccctcttacatcctgagtatcatttcacatttgagtaaaagtacagggaaaccttcttttaatatcctgtgtcactgtggctagaaaaatggacacacataatgcaaattaaagagaatagaaaatgcctgctgtttggaccaaaaggtattgagtgggatttagagattgcagctttataatggggcattattggtgcctcctcattgtggaattaagggctgtggtagtttcgctcttggtttatttcttttttttctacaaaatgctagagcctgttttctgccagatgctttcttcttggtttgttaatatttacagaaatcaggacggaataggcgtataccagagttgtctttaagaaaaataaaaagaataagacctgagcttt

SEQ ID NO: 105102 - DNA, 1111 bp, Homo sapiens
cccaaacagctagtagagcttggacactatttttcttcttaggccattgtgctttgccacattttttgtcttaatagttaaaaaaactagcgacatccacacaatagtttttctgtcagaaaaaaaaatgttgctgttgcctcctttctgtacattgtggaggaataacttctatatagaatgaagtgaaattcctaaaggttaagaatgccttatgagcaggtccttaatgcttttgatctagaggatatagttacttatgtgagtgatcattgggaaactaactttcagaattgtggttattatggtcgtgtaactaaattaactattgtcttctggtttaccgtttagaacatgttaggtctttggggggataagtggggtaccaaaggtagctcccctctgctggttctggcttcccataaaataacctacatctgaaacagtaacgcattttgaagcttagtctgtttaattccctgcagaataaaagctcaaagagctgtacatatttaatacgtgagttagaagagagctgtggtcggctctgttataaaatgtagtgatcttagaattttattctgctggggctagaactaactaaatgtgaaaatgaaatattcttctataatgaaatgagttaggatcttggttttacctattagtaaaacaattttttcaacaaaaaacaccatctgaaatgtaaatcaagatagaaaaaggttttccgtgtgtcgcttcatcatgtatgccttactttaggacaagaaggatggtgattggagtagagactgtggaccaagctctcttgactttttctttttttttttccccctttttttggagattttttttttgctctgtggccaggctggagtacagtggcgtgatcgatctcagctcactgcaacctccgcctcccgggttcaagcgattctcatgcctcagcctcctgagtagctgggattacaggcaggcgccatcacactcagctaatttttgtatctttagtagagacggggtttcaccatgttggtcagcatgatctcgatctcctgacctcgtgatctgcctgccttgacctcccaaagtgttgggattacaggcgtga

SEQ ID NO: 105103 - DNA, 1187 bp, Homo sapiens
gcaaattctcagaaagggttaacatatgtaatgtgttgacaggttgtgaattttgttttaaaggttcatctcaaaggaggagtcagaaataccttccgtgaaaaagcttgcatggttcatttttaaagaaactgcaaactcataccagttcatttaaagtgtaatcaagacaaagtcttgaagctcagcatgctcagatacatcagaccctgagcaccttttacattaaaataataattacgaattttgtcaatgattttgaaaaccatagggaaagccaggtgtaatagtgagaatataaaacatgctcccttggagacagtgttgtttgtttgaattaaaatcattcccaccaaacagacacacaaagtaaggaccttgaccatttaaacagctaaaaaaaaattgcaaaccaaagcagatttagtagttgggaaagtgaatgaagtcttattaaagttgagtaacttctgaaaaagcttaattttaaaagcttcatttagatcacgaatgctgctgtttattgctgttggcagtcagcacttcgtgttttggtaaaattacatcttgtcctcatgaagcgcgtttggtaggcgctgttacgttatggccactgtgggatggggagctctacctttaatggtgcttgtctgggaagatggccagtaattttggactaagtaactttggttgttaaaatgaagggcttcagatatttttctctccccttctgtcctaatacgggtctccttcattgttagatcacattctgcttttttgctgattgatgatgacatcagtttgtttaccctagaggctgggtcatttgcttacttgtaagtcagtggaactggcttttgcatctttgctactgactagctgagtgccctcaagcagggttttttaacctctccttgcctcgtttttctaatctgtaaaacggagataatatcagaattattatcaggattaaaaatctgtgatgttgatagtattggatttcaacccttagaataacataaatatacatgattcgtgttgatataaataataggatgaacaaatacatggggtggggtgagtaaaagctcttccttaaaatagacttctaactaataaatgtagaataatgagggaaatgaaagatcaccattgagcaaacatcatagtaatgattgttgcaggtc

SEQ ID NO: 105104 - DNA, 1172 bp, Homo sapiens
taggatttcaatatatgaggtttttttttttttttttttttttttttttgacagagtcttgctctgtcgcccaggctggagtgccgtctcgtgatctcggctcactgcaggctccgcctcccgggttcacgccattctcctgtttcagtctcccaagtagctgggactacaggctgccgccaccacgcccggctaatttttttgtattcttagtaaagacggggtttcaccgtgttagccaggatggtctcgatctcctgacctcatgatccgcccacctcagcctcccaaagtgctgggattacaggcttgagccacagtgcccggccacaatatatgagcttttttagcggggaggggacacaaatatttagaccgtaatatgcacatatatgtatgtgtttgtatgtgtgcgtatttccattgtggttttgttaatatttgtatctggttggatgagttcttcccttttgctcacattttcaaaattaacttgatctttcatgaagctttattcttctatttacgtattagaataaatttgttgagttgctcaaaaaatcctgccggaatttttattacaataattataaagctaattagagagaactgacatctttacaacattaagttgtctcatccatttacctgatatgtgtatttccattttctcaattctgcattgatttcttttcatggattaaatttttttttttcctctataaaggtctcatatactccctattgggttaatacttgtacatcatagtttttattactattgtgaatgatatcttattttctattttctgattggttatcgttgatatgaaggaatgctattggtttttctaaattcatcatatatctggcaacattgtgagacccattgatttttttttttttttgaaataaaacagtcacatctacagtgattgttttctagtcctattttgttggctagtgcttccaggaaacagtggtagtggaattcttgtttctaatattaaaaggaatgaagctaatttgttaaaacttaaatatgacttaaatatgatggttactgtaattttttgctttgtaacctaattaagaaaatttctttttattccttgttttcagattttttctctattaaaatggcaattcagcatttaaaggtctctgtgtta

SEQ ID NO: 105105 - DNA, 1040 bp, Homo sapiens
gttatttaaattgtgtaattaaaataataagtacagcagcacaaatacagtagggactaaataccgttggctgttagtaaatacccagctcagctggtgggggcagagtgtgcaggcataactagagaaaggctttgagtcagcactagaatgcatcagtcagtaggttttggaagaaatgtggtgggacatccaattagttggttaaattgaggatattgaaagcatctactacagcttttctaactctgctacctgaaatcctgagatggggcaacacaaatatcttctcatttaaaatagcctaagcctcgcctgggttgtttctaatggctccatccacacactttctgcagatttcagtgactggaatgacagcagcctagtgcctaaaccacaaatactgctaaagatcccctgtcttgaattcattggtaaaaatggagagatctgagagtgagtcaggcgctttcctttgtgcttcagaaattagtagaaaaataagtaaataaaaataagtaaatgaatcttgttggctctgtttactcaagtcctgtgtctggattcaggattcttaaaagtccaagacaggatctaaacatatttgtgttttaaaaataagcctaggccaggtgcggtggctcatgcctataatcccaacactttgggaggccgaggcggtggatcacccgaggtcgggagtttgagaccagcctgaccaacatggagaaaccccgtctctactaaaaatacaaaattagctgggcgtggtggcacatgcctgtaatcccagctacaggggaggctgaggcaagaaaatcgcttgaacctaggaggcggaggttgtggtgagccgagatcacgccattgcactccagcctgggctacaagagcgaaactccgtctcaaaaacaacaaaacaacaacaacaacaacaacaagaagcctaacttagtgttagcataagcctgtgagcctacagtttatttctgctttggcaaaagtgccttactgggaattagggaggggttaaatctagg

SEQ ID NO: 105106 - DNA, 1034 bp, Homo sapiens
tcttatttctgctattgggtaattttgctttcatgttttattaagctcagtgccatttttcttctagaatttttcacagataattactttttgggtacttaaaactaagtgtaaaacatcaccctcctaaacataccatcaaattaagtaaataaaacacaatttaagaacagcttttattaaaacaataaagtttggggatttttttaattgtcttaataaagtgcaacaattttgcataccttctccagcataatcttaacatttggctgcccgccttgcctgaaaggaaagtcctaacattacccaggaagatcattttaggtcaagaaggcctttagattaaaacgtgtgtgtgtgtgtgtgtgtgtgtgtgtgtgtgtgtgtgtgtgtgtgtaatataaacataaatgtatataacatatattatacatatataaatatatatatttttaggaaaaaacaaaatggtacagttttgattcagttgaactagtttattgcaccatacatctgtacttaaatagggcttttttctacaatacttgagttgctgtttttttgcctagaaccttgtggggtgattttccatcgctagccctctgtgagaagttctgacttgagggtagacagctcttagtctgaggacatttcctgcactgaactgcatccactgtgagtgataaagttggggtcagttgttcagagtgggggtgtctggtccctgttttgctaacattggaggaaaggcttagaagaacgaatgaatgcttggagtagcattcaacaaacactgcaagtagatgaatgcttgggagtagcattcaacaaacactgcatgtctgtgtaccataatgttctaggcactaggatatagtactggaccctggaaagtgactacgtgtagcttgtacttgtgtgagggagacatccaacagacaaatatgtactgtgccaggtggtgacaggttctatgaagaaaagtaaaacaaggctggaggctagagaacaacagtaaatattttaaggtattc

SEQ ID NO: 105107 - DNA, 1093 bp, Homo sapiens
ccagtttattataaaggatgttgcaaaggatacagatgaagagatatgtagggtgaggtataagggaaggggcgtggaacttctacgccctccctgggcggtcaccctcctagagcctcctgtattcagctatccggaagctccagctcccatttcatggtttgtctctttacttttcccattttttttgacatagacaaaattttttagaacaaatggaggatctggtgtgatagacaatgtagggaattaggtaaaaacaacaacaaaaaaaaaaacctggtttctggctgtgcctgggccactcacaggctactacctagctttgtaatctcaagtaactcagtaaacgagtaatgtctcttagcctcagttttcacttctgtaaattgggcaaaataatggcatcaaccctacagggcagttgttaggattaagtaatattaagcatgtcacaatattctttttataacacagattcacccaattctgctacaacatttctgttgatggataacttggttgttaagccaagttctacctgaagatgatcatgaaggagtggctaagaagcatctctaaaacctgattgttatgactttccccctaaaagttttgatagactgcccaaatgtttatattccccatgcatcagaaagctccagtataatccagactcagccaggctggccttgttcacattgtgcatctggttttgagtggctcccatctcactttctgtgatgctgcaggattaaaggcaagtgctctaggctctctgggggcagtacccggttcagaactagccctatagtgccacctggggcaagttattccttgaaatgaggacagtaatttttgatgtgaggattgaattgtatgctgtggtgaggattaatgagatcatgtctgttgtgctcttagtacagagccagacactgaatgagtttccgtgaggggtactgtgctttcaggacccagctaagttgggccctgcgaaacaagcagtacctgactgcccaagactggaaaggcacagcttgtgaaatgaaatggggtatttctgataaaaaactgagcttctgcaataaaa

SEQ ID NO: 105108 - DNA, 1055 bp, Homo sapiens
gcaaaattattcttataacgggtatttcagaatccatttttcatatggctcaagagaggattttccgtgggattcagtgcagtctctgttttggtgtaagtacaggccgcttgagaacgttgtgatctgtgcttgcttccccaccttcttgctacctctcactccccaggctccccacccccttaggtgggtgtagaaataagttggatgtgttttggaacaatctctgcaatcatttctttctctgttttctctattttagctgctgatgcaaaagagaaacaattctgggtgactcagcttcgagcttgtgccaaataccacatggaaatgaattctaaggtaagtcaccgtgagaaaggaaggaggcattcgaataaccagcctggctttcagccccattatttgtttcttcggggaaggtgtttttcatgttattttttaagttgcccactgcagtggaattcctacttgtcctgctgcacataaatttaaagccaggagaaatgtagtaagattttcttgtaggtagaatacgcaggcacgcagacactatgggaaccgaatctggaaagacacttttgcattctgttgtcaatttaggcagctgttaattggtctattgagaagctctagtggatgatttcattgtggagatggagttgtcagatttacagttcgtaaatctagtagccatcaccgatccttaaataaaacctagaccctgaattgcttatgtactttgcaaggagcttctgcattcctagtgtatcaaaatgttctcgggtaatttggcatccaagtatgatttattctctcctggggaccttgtgagatcttgtgttaggtgtgcaggaggtaggaggtgggcattttcatggattattgtggaggatttacattcattaaaatacaggaaacaatttcaaaatgcatttatctagggcaataaatatttgttaaaattaatgttccaagggctactcctttctatcattagttcaaatatagttagtgtatccaactgctatctttttctgtattccatgcatcct

SEQ ID NO: 105109 - DNA, 1059 bp, Homo sapiens
agtacctgtgtgagtgtgtttatatgtatagtgtgtgtgagatgcatgtatgtttgtgggcatcagtgtgagtgtgtcacatatataagtgtatatgagggtatatatgtgtgcatttgtgcttcttttggaaacaatggatatatctgaaggatgttagtaggcaatggcttgtcctcagcccttcccaggaaggggcctacacttgccctatctcccagctttgggattgagcaagggtttcaccaagaagctagcctggtgagaattaagatggctttcctcatgggtttgttcgctttcttccctcattttccctttctccctgcagcacatgctttgatttttttttcctcttttattgatgttatttttaacatagcaaagaaagtatgttctctctgggtacaattaagttcaccaacacagcagtcaagttgcacactgtagcttcaagaagttaattaataaaccccagaacgtaggaattagatttgccttattctgttctctagaagggaagatctttaagaatgtttcaggattttatctgacaatttcacttggtttaatgaagcccgatccagaaatacggtttacttttccatttagaatgaaagctgtgactttgagatatagctgcgtgctcctaacagcagtacctgacaaagccatgaccctgtgggaaaccaaatttaatttctttcctaccagggaatgtgacccacaggaattcttaatgctatatggacagtgcttatccatatatgacacaagctgacttaactgtcagaggccatgctgaaagaacacttgttgagtctgttgcaatttttttctagtctgttggaatttttaatcagatagtgtcccatcagtcccttccaaatataaaaattttaactgtctttagaagaggagtaaattattgataactctccttagtacacatgattcaaacctgtgcatttgcattgaaactattttagaaagcagtggaaacatgttcttttttttcatctgaggcagaaagttaaagatgtcagtttgaaatagtta

SEQ ID NO: 105110 - DNA, 1041 bp, Homo sapiens
tagggcatttacgtggcaaaaaacacctggcaccattgtcctgggctggccatcttgcctctagatcagctggtagagcaacaagttatcaggctgcaggtgcaagagaagggggtggctcttccagttgtgttggaaaaaattaaaaggtaaacttttccatgtgaccaatctgcacaggttctgtgctcacataaatctctgcctagacaattatactaagctcttagtggatccccctttctccacccacccaagcatcattctagagtgagctgctagtgtcatgtctttgctcagagccctcctggggtctccctttatatctggaatcaaccccccagtccctatcatgcctgcaaggttctgtgtgatctggctctggttcccttcatctcccatcacttcccccttgttcactccacccgtgttgcactggctgtttctccagcacaccaagcctgctcccacctcagagtctgtatttattgcctgaaacacagttatttttaccgccaccatgctttaccctcttccttccagtctttgctcagagtcaccttacagacaggccttccctgacccagtgaagttagaactgctcctccaccgcagccttttcccagcctccaacactgtagcctgttttatttttctctaagccacttatggacacttactatgtttgtgtatatgtttataatttatttcccacccctagaatatcagttccacaagggcaggaatgcttatctgtttcacggattgttctattcccaacatctagaggagtctttggcagtgaatatcaacaagtattgaatagggaacctcataatttaataaaataaactatagaccaaaaattcaagtatctggtcctggtccttatatgaactagttatgagacaatggagagatcacttaaattttttttttttttttttttttttttttttttgagatggaggtctcacccaggctggagtgcagtggtgtgatcttggctcactgcaacctctgcctcttgggttcaagtga

SEQ ID NO: 105111 - DNA, 1048 bp, Homo sapiens
aacctgcatccccatgggaagcaactttatcagctagagtacaattcttatgtgctgttccttttgcctttactcttacagatgccactcacttgcaaagtcacttaggttactctttctcctacctccttcagtaaggttgtttcctacatttgtaatacaattagattcttttgtcacaggctgggttctttcctaggatcccctgacttcctaaatgattcttcttttcaaatttgcatatatccaggttcactctttgtgttggacagttctatgaattttgacaaatgcatgtcacatatccaccaatacagtatcatacagaatattttcaccatcctaaaaattcccaatgcttcacctgcttattcctcccttcctcccctaaaccactagcaacccctgatctttataatgtctttatagttttaccttttccatcttctgcattttaaattctttacacttgaatctcttgagcacccactgacaatggctggccagtcagaactcatagtcattattctattattctgctcctctggagggcacagaaagttggacttctctttggaataaagtagaagatagttatgaaagctaaaatgcattatcttaacaacacgtccatgtttcacagtctgcactattagtgccattatcctctaataaaaaagtgctttcattctagtcttcctgtaaagcctgatttggtggatagatttgcagtgcctgtgttgtacttcctgttttcctcagcccaggatagtgattgctatttactcagcaaacagttttggaggcacattctggaagccattcctcctgctctgtgaactgcctccctggacctttggtaatgatgtttattaactctggtgatatgattgggtgaaagagacaaatcagatcctcacttagaaatttgaattgatgagatagccggttgggatgagcacattcctggaattctagaaggtgtcatcttgggaactgaaaccactatgttcatttctggaaaaacagagattggaaccagagggag

SEQ ID NO: 105112 - DNA, 1022 bp, Homo sapiens
gacaattgaggcagatttgcattgggctaagaaaccaacctaaaactcctctttccccaacttccccttagtattgttagaagcttgatctgtaagtttaatcacagagtaaataataaataatgagttaattgatttgaccatttatttcctttggacttggctggtaattaaggaatttctctggcaccttaccaaacacctgctcccttttctctgaataatcaaatagtcttttattacaaagttaatttcgctactctggaatttacttatttggccctgcattaccatagaggtactctctaactccatcatggatggtgggggctccagccatgattctgaagttctccttaagtcaattccttcttgaatgtcttggtccagattgtacacactgtacagaaaacttgatttgggggccttttccaatttcttagctatgctttagtggaaaggaaaggcaaagaaatacttcttggaaaattaaaactgcttagcaacactcctggggtgcattgaatgcacacgatgaaatctggaaagtaaaacgtgaaactttataaagtcagcataaaaagcaccataaaaattggaggaaagttgttagttatatgacggaggatgactgcccgtttattgctcgagtgtggtcgtggagattcactctgaggctaaagtgctcttaggcagaaggtaggtggaactgcaggctgctgcttgcaatagggaacaataaacccagttacttgggaggtaagccttcagtctgggttgtaaaattatactccatgctcaaggcttttcagaggtgctcaaccaccttgtacagatgagttttttaacttcctggatggtttccagagagatggaaagatgaaaagactcataatgatgaatggcccttccctctttccctgcatgtatattgttctgctggacttctagaatggactctgtccattgtggatgttgctggtgccctgcacagatcccctttactgggtcagggcacccag

SEQ ID NO: 105113 - DNA, 1026 bp, Homo sapiens
tagcatccatggtgagaaagatgctttgtgttattgaaaagttgacataacaaatataaagactttttttgggaaaaaaatgggcccttgtcctcccatcctaatacaactgttactgatttttgtgcatttcttttgagtcttgtcctcctgcatatgtacctctgtgaagtcctgatgtgcgcaataccagttgatattattaaaaagcataacacaccatatatctgacagttgttactacattggatctagtgaggcctaaaacatacaaactagatttgtcagagaagatatttttaaggactaatttgtgaggtgtactgtcattttgtgcatttttaacttttttcaattgcaagagtaatacttcactcattatttacttcagccctaaatattagtagaaatcaggccagagctaaagtaaatcaggtaattggctattcaggggctgaaagatgtttagtggcaaagtcacgctttagctctaagttaacattgtggtcacaagggtattctggtggcccgagagttactgcacccctccttgcaaatggctacaaaggctaagacatagcacacgtttaatttttttcttccttcttagctggtgcacacacaataaaccaagaaacaaatgaccatacttcagtgtcactctatacaatgtgactttaaagatgcatttttaaaaacaggaatctggccgggtgcggtggctcacgcctgtaatcctagcactttgggaggctgaggtgggcagatcacgaggtcaggggtttaagatcagcctggccaacatggtgaaaccccccctctactaaaaatacaaaaattagtcaggcgtggtggcatgtgcctgtaatcccagctatttaggaggctgaggcaggagaattgcttgaaccccggagacggaggttgcagtgagccgagattgcaccactgcactccagccagggcgacagagcaagactcctcaaaaaacaaacaaaccaaaacaaacaaacaaaaacaaaccaa

SEQ ID NO: 105114 - DNA, 1029 bp, Homo sapiens
gagactccctatctgccagattcccagactgtgagctgcttcaagatcagggaagtttttcggtacgtaatttcttaagcactcagcaaagtgctaagatagtcttccctgcctcagggagtttggaaggacatttttccatggagtacatcagacctaagagggagagttttgtttttcttcactgataggcaactttcattttctgcatttgagagaacctgattttaagtagcacagtggccacgtcacaatccaggaataattttggcatttttcctgtatcctttttctgcaagtgtttttcacaataaaccaaaataacctagtcaaggggagagggaggctaacattttctttcatggagcattattctgaggcttgaaggtgctcaggtgaacttgcccaagttctgttttacaggtgaggaaactgcctcaaatagatgacatttaattcaaagttacacacggagtttgtcgctgagttagaacaagaaacagaatatgcttctcagtcagttttggaaaaactccagaaaggtgatgctaaaaatggtctttttgccttgtgttttgttatatagcaaagaatacccgctggcttctcattatctagctgatgccctgagactcatctgatgttctggcttatgtattagctgctttgagtgatggcgaaaacttcaaaatgtgcagagagctcttccttgaacccagtgatcctggggtattaacagattgtgtttgggatatcttatctctgagtctcatgctaatttcctctgatatatagcaaaaagactgggtttaacagtagttttcagtagacaaagttgcttttattttattttccaggttatgaatacagaactggcctttaggactgcttctgatctatcagtagatagtacactgtttatagtgctgcaaaaagagaaggtggacttgtaaattcaggaagggacctggctaaatttgattagactgcattaaaaatttgagacttttctctgtgagccgatatctc

SEQ ID NO: 105115 - DNA, 1246 bp, Homo sapiens
catttacagctccccttcccagcctctaaatcctatcttcctttcctattttatttctctccatataccttgctattatctgacatgctttatattttactttttttggtctctccacactagagtataagctccctgaggacagataattttgtttgtctttgttgctgctgttatctccagtgttgagaacagggtctggtatacagtaagggtagagtaagtattgtcaaatggataaaaaaatgaataaatgtcagagagggaaaccagggcttagttctatttgagccagtgttagctattattagtatcagaagtcttggttctgtacctgcttgtaaccttgtccttgtgttgctgtgtttatcatctgtcctgctctctgcaaacagtctttggttctggatcagggagtatgactcttcctgtgacgtgcccaccctgatttagggcccaccacaactcacccattgggggccattagtgaccaaatatccagggcttgcttttgactctatctggattaacaacatacgttgagtgtttagtgtttagcccccagcattttggtgccacttatcccaaattaaagcatcactggggtatatatgaatttttaaagccaccttgaaggaaaataagtgtttttttgagtatcccaataattttagagggaattggtgataccagggttgaaaatcactgctctgggttttgtattcttgtccgcgtgtacataggaaatatctgcatatcttcctgtgtagtctgccagagtgttttgaggccgtgtgctaaaatcctttagggacactaactagtttcattgatggtaataataaaagggatggttgcctaggttacaaaacactgtataatattgtttattcacttatggttcaaaatacgtattgagcacctgcttcgtattaactactccctgcagaatctgccctccccctcctttgaaagtgtgtgtatatttgaggagattcacaccaaaatggttttctttggttggtgggattatgggtgatttccattatcttctcttgtctgttttcccaaggtgaatgtgtgtctgttttgcagtttgaaaaagttgttgaggcaaagaaaagctgctcatgccttttcacgtcatctgtctaactgagttttgcgagtaaatttcaagtctaatctacattcagaaaagtacacaaatcatatacatacacagttcaatgaattttcttaaatg

SEQ ID NO: 105116 - DNA, 2164 bp, Homo sapiens
ttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttgcaccgtggatcctgtttttctttttatcagcttaggtaatcattttatttgtcggctttttcttttttcctgaactgtgtttcattaccaatatcaaaaacagttttcaacagaagggcttcatctctaatcccaggccttaaatgcatctgtttttattgtttactgatatttttatacaattgcagtttaggatggagaccttctagtgaatttgaaatccccttctccccactccatgtatacctttaaaagctgggaaaatataaccagtgctgatctcgtaaaaatgtaagggagctctccctctacctctacctctacctctctacctctctacctctctacctctctacctctctacctctctacctctacctctacctctccgtctccctctctttccacggtctccctctgatgctgagccgaagctggactgtactgctgccatctcggctcactgcaacctccct

SEQ ID NO: 105117 - DNA, 1043 bp, Homo sapiens
tcacctgcatcagtgtcctgagtagctgggattacaggcgtgcgccaccacacctggctaattttttctttttttttctgactttttagcagatatggagtttcaccatgttggctaggctggtctcaaactcctgacctcaagtgatccacccacctcgacctccccaagtgctgagattacaggcgtgcaccaccacgcccagctaatttttgtatttttagtagagatgaggtttcaccatgttggccaggctggtttcgaactcctggcctcaagtgatccatccatctaggcctcccaaagagatgagattataggcgtgagccaccagacccagctgaatattttctcttttaaaaattttttgaaatgtcttcctactgtcactacccttattcaaagaacattttcatccctcaaaaacaacctcatccctattagtagtcactccccattcctcccttccctcaacctttggtaacaaccaagttactttctatctttatgaatttgcctattctggacatttcacataaatggaatcctatgtggcccttttggtctgacttaattcacttagcatcatgtttttaagggtcatccctgttgtagtatgtatcagtacttcattatttttaaattgtcaaatatttcaatgatgtatacattattttatttactcatcagttgatggagtttataataggtacttcgtgttcatgttttaatatctgaatcagggtgcagcttataatggatgccaaattcatatactgctaaaacaaacaaaaacctggcagctgggatttcaatctggattctgttgcgtctatagatcaatttggtgagtactgccatcataacaaaatgaagtcttataacctatgaacatgggatgttcatattgcctattacgaataatgctgctgtgaactttcatgtataagcttttttttttgacacacagtctcactttgttgcccaggctggggtgcggtagcgcgatcttggctcactgcaacctccgcctccccagttta

SEQ ID NO: 105118 - DNA, 1062 bp, Homo sapiens
caacctctgccttccaggttcagatgattctcttgcctcagcctcccaagtagctgggactacaggtgcgtaccatcatgcccactaatttttgtatttttagtagagacggggtttcaccgtgttggccaggctggtctcaaactcctgacctcaagtgatccacctaccttggcctcccaaagtgctaggatttcaggtgtgagccaccaggcacagtcagtctggtctttttgaggcagtgagttctctctgagcacccagagtcatttattggtttccccgataacccaagaatgaatctctcaacatgtcttgatgggattccacttcctggacctttgccactggctgcatttgcagtgctagttttctatttatctccctggccacactgaacattcttcaagggaaggagctatgtcgtctttcttgtatacactggccttgtgcatggcttccttagttgtcctggtgtccagtaaccttagtgaccctcattcagctgctagaagagttaaaaaaaaaaaaaaatggagtttttcacaaaggtgctgtaaacaggtataatccaggaaaactcaagtttacatggaaactaaattagaaaatgattgtccttccaaataggattgtatgcattctcttctgaatagtacttctctgaggcttttaaaataaattttgatttacagcaacttgataacatcttttagaaaaaaatcccttaaaatgttggggctcacctaggtttaaaaatgtggttgttgatgcatttttaaaagatattagaaaggcaatattgatggctgttaaatttaaaaataaaacatattcctacaactcaataattcatcatcctccaaggaggattttatttttaaggaattgccctactttgattgcctgaaggttttgattcttctcctcttggaatgaatttgaatttgagactcccaagcaaaattggatttttctcagttgcaaaataccagattcagcatatagggctttcagagggtaactggagagttccattcccatctgccaaattgtataaac

SEQ ID NO: 105119 - DNA, 1030 bp, Homo sapiens
acgtaaggtctgggcatcacactttatgtaagttaaacttcagtaaagtgctctcagcacacatccgcagccgcacccacacaaaatcccaggaggctcagtaccagctgtggtccgggccttgcccacctcggagaggccacgacccaaggcatccggtttcctctcgctccagtctaacttccgcgcatctacgagggccgggactgccgctacctttctggaaggcgccggccggccagtcaccggagggatcccgccagaggcggctccgcgtctccagcagcggggcagggacccgggcgccccgccctcgccagcgcccgcccccgcccgcccccggcccgccctctgtatctggcccctgggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtaagtgagcgcggggcgcgaggccgaggttctacagggcgtcccgggaaagcaggggtccgggagcggacgcgccgggcgtctggacccggccggagcccagggagcatcgcgcagcgggcggggcaccgcgtcgctaaagttcgcggcaggcttcctccgggaaagttgctgccgcagcccccgcgctggagctcagtccccagagccgccccggcccttgctcccgcggacccaggtcgccagggtcgcaagtttctccggccacccccctgcgaagcctgacccgcctactgactgaaaccacgggcaaagttccttttcgtctttcttcctcttctctgggccgcgccgcttcgaacccgagccgggggtggaagagtcgcccaggcggcggcgctgagggagcgaaacccgacctcttccccgtccacggcctcctctttcctccgaacccagcgc

SEQ ID NO: 105120 - DNA, 1008 bp, Homo sapiens
aggcacccaccacgatgcccagctaaattttgtattttttgatacagacggggttttgctatgttgcccagactggtcttgaacttagagattcaagggatctgtccacctcggcctccccaagtgctgggattacaggtgagccactgcgcctgcatgagactcttttttttaatagctatttttttttagccctattattgttctagtaattacatactatataccatgtgtgtataatctcattaaatgtttctaagaatccagtgaagtaacatgtttgatagataaggaaacgggctaaagagttaaagagacactaaagtcacacagctcttagcagtagtggtggaaccgatccaggcctaatggcctgatctccaaaactcataactctggcagagttgttgcttgttaatagttctagggatataaaagccacagtgagataacacttcacacccacggagatgacaacaatagaaaacaacaagtgatgaagatgtggaggatgtgaagaaattggaactctgatacagtgctgatgagaatgcaaaatggtacagccactttgggaaactgtgcagtttctcaaaagttaccatgtgacccagcaattctactcccagctctacccaagaaaatgaaaacagatgtccacatgaagacttacacattcatatgtgttcataacagcattattcataataaccagaaaatgaaaacaacacagttgcccatcaaatgatgaatgtataaacagcaactaaaactaagtgctacattcatacaattgaatattattcagtcataaaaagggagaatgaagtactgatgcgtgtaaccatatagataaccatgaaaacactaagctgtgaaaaaaagccaaccacaaaagaccacattatatgattccatttatatgaaatgtccagaataggcaaatgcgtagacacaaaaatagattagtggttgcctaggtcagggagcaggggttgaaaggaaatg

SEQ ID NO: 105121 - DNA, 1060 bp, Homo sapiens
tatcattttcaccatattgtaaagttagatttatacctaataaatatttccctttttgctgctattgtaaatagtcctctcctttgtgtttaatttttaacttcagttgttcattgctaagatattgaaatgcagttgatttttgtaaattggttttgtatctcatgacattactaaagttatttattagttctaaggaggtttttagtagattctttgggattttctacatagatcattatgttgtctaccaatgaagtagttttgtttcttccttttcaatccatatgcctctatttctttttcttaccttattgcaacttccagcagtataagaatgtgagaaaagacatcttttccttgttccctgtgttgggggaaagcatgcagtatctcatcaagtatcatgttagctgtgggttggtttttagatgccctttctcagtcaaggaagttccctcctatccttgcttgctgaaagttttgttttgttttgtttaatcatgactggatattgaattttgtcaaatgccgctttttctgtctcagttgatacgaatatatggcttttcttgttttgtctgttcataaggcatatacatttgaaacatttggaagtactgaactactcatgcattcctgtgataaaccttagctgtggtacatttgtatttcttatatatgttggatatgatatgctaatattttatggagggtttttgatagcctggagtttctctgtaagcttgttaatgactcaacccactttgcgtccttccttttgagatattcatgtattcatggtctagtgtgggttattctgaatcctggtctctctttcctctctgtgtggttggtgttcttttgggtttatctgtttctcctttttgcctacatgttagaaaaacttgaagttatgcagctcaattcaggaacaggatgtaggaagaagtatttgagtccagtagctagattcaaattgatttgcgtcacattattgaggtcctaccaagtgctgggtccctgttgtcaccttagaagaacagtttatttgtgttta

SEQ ID NO: 105122 - DNA, 1057 bp, Homo sapiens
gtcagttgatagctgtaaggtatgaattaccatctttgtaggtcaaaaaccatcaaatattggcaacttcgtacaattgggcctaatatgtaaaccccaggtcaccatcacgctgtcctctttgctctatggatatccagcagatgaaagggatggttctgctttgttattttcttgttttcctgcttcttctgagggggcttcccgctggcacaatctaacaaacttcagagaggacgaagtcagtctctgctgtcatcagtgttcacagacagtagtttcaaagtgtgtaccacatgaagttgcagtcttccaaccttccagccagtgtgtatggaaataacctgaattgtattaatagcagttcttcaatgtgggcctgctgggggatgcttggttgttttccgttgtttgttccctgggtgcccgtcttgggcaagcatttctctgatgtctctatttatgtggcaggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcggtaagagagtggtctggccctgtcctccgcatgcacaagtcaggatgttagctagagtactgagacctgacagagtttttcccgtctgcccatctcacctctttaaccattctttgctgcctctgccctgaatttcctattgtttggtggacatctctgcttgatgtcctgctggtttttaaaactcactttccagctacaagaaggctgtggctggccgggcgcggtggctcacgctggtaatcccagcactttgggaggctgaggcgggcggatcacgaggtcaggagttcgagaccacggtgaaaccccgtctctactaaaaaatacaaaaaatcagccgggcgtggtggcgggtgcctgtagtcccagctactcagagaggctgaggcaggagaatggcgtgaacccg

SEQ ID NO: 105123 - DNA, 1469 bp, Homo sapiens
agaagagggaatgacaggaaaaaaaaaaaaaaaggcaggaaggctcaggagtgagaaagccagctgccaccacacatccacaggcacttcacagaagtgccactgacctcattctagagtctgagtctgacgggaccctgggaatgaatacctctcaagtccacacttggggccattcacagagtgggctgacactcccatcagtcacacaagaccagcacattgttagcccagaactttctccgaagcagaagagaaaggcaaatatctctttaaggtactttgcttctccgagctggagctttgtttaaactctccagccgggaagttgcaagaagctcgtttgctttttagtagctttagccagaggttaaggcactgtccacagattgctctcaggagtagaggagtccttagtggctatctctgctcacaccagaagcttcctttctctctgtcctcttcccttcctgcctgcccggcatcacttctgtcttgcttggcctcttcctggtcagcccgcatgttggctgcctgcgagcggctctgctcatcccatttgcgtgttgcaagggagaagaggaagcgtcactctctccctttcttttcatgtcttctgatgcccagttgctcttcccggaccagaaatggacggccctacccacttatttgctttgtttctgcccccaggaacttctgcactatttaatcggtaccctgctcctcctcatcgcctccattgtggcagcttccaagagttacaaccagagcggactggtagccggagcggtgaggatgttttggggagcctttaggaatgaattcttatttaaaatgctcattttcttcctgatgggggaagagaagggcttggtttctggggcattcccttcatagaatcaatacctaccttgatccagccatcagctctctccaaagagccttaagcagaggcgtacagtcccagaaggtggattgtcagggctgccagcaaattcatagaccccagcagcccaggcctctctctcttacaggcactactgaaatcagggggccaggcgggttttaattcacacacccactctgatcatttgctcgttggctgcctcagcactatgcagagacagatgctggagcctcttttgggcccagtgggaaatgtactgtgatcaattagagatacatgccatgagcctgagctttgccattcctgatttttaacagtattcaggccaggaaataatactcctgtatctttcagaggcaaaaattgatccatctgatagccataaatagaagtagatggaaatatacaaaaatacagtcctgtgagatatatacatacatatatatgtatatacatacagatgtatatgctatttttttaaagattcatagattcctgtcatctgatttctgatttagctaactatttatagttcagtggcctgtgggccaacactgatttg

SEQ ID NO: 105124 - DNA, 1005 bp, Homo sapiens
cagaaggtcactgtagagggtggccaaacctcccaacactgatgctccacatggccctcccacagcccaccatcacacctctctgccccctctctctgctgtctctgaagagagggatggttgccccctgaagcttaacacctgcccagctacagtgcagggtactggaagaggcacacaggagacctgtgcccactgtgtttccgggcccacttgaggagattcccactgtgtttagtaattcaggttgcacataactgtttagccctggaatctctatagctaacattcatcatatgctgtctgtgtgcctaggaccaaacctgggctatgaggaagttagaagaaatttttaaaatatggtccctgcttataagaaagtggtcatctagcttaggagacaagacacatgaaacaattagtaaacaaggcgttgtagtctagaatagcattctgtagcgatataataaactgttcaattatgcagtgcagacagttggggaccgggatggtatataacgtgctaattgtgcagaacagacaatgagaggccgggacaggctctaataggctaattatgtgctgtagacaattggtacaaaaggagcccaggaaaagaaacccggggaagaagtggatgtgggctggtgggggcagctgtttatgtaaagcagcatctgggcttgaaaagaaaaccaaaccttgttgaaaatcctacccttagctgcccctgcgccattctcactggacaccagtggcggtgtagtgaagtggaggcctttgtgtgggtctgagaacacctaggcacccggtactgcagagtgcggactctggagccaggctccctgggctcccatcccatatctggcccttgctggctctgtggccttcggcaaaacagatgaccgcctgtacctctgtttctttagctgtgaaatggaggagcagggtgggtaatcctagcacccacccagcagagttgtgagggttaaaggaatcaataca

SEQ ID NO: 105125 - DNA, 1078 bp, Homo sapiens
gaattattaaaatatcccagtaaagctgtttaagaaaaaaaagaatgatttttaaacgtagagaatataggggaaaagagaagttaataggtggtgtctaacaggataaatctataaatattggtataaattggttttttgaattatggaagaatcaccaaaagaaatggctaaaaggcttgggaggttgctgctgaggagtaagactgaggtcgggggagtgcggatgggagtcacctctgcactaccgaagttttttccttgtttggaaatgtatttttaaaaaatggaataatctcagtgcaagtcggcactgggtggaggacacaggtgcccccctgagcagaacttggagtcaaacctgtggagtgtggcttgtgggtgggccacatccctggcaagctgtcctgactgccatttccttcccaagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcggccagttgcacaaggatttcttattgaaccagatgaaggctgtaaaacctggcc

SEQ ID NO: 105126 - DNA, 3671 bp, Homo sapiens
aagcagacgcatggtcttctgtctcttgatagaattctcagaacgtatgatcgtattttagaagagaacagttgaggaagtgatttaaggaagaggaagtaggtagtggcgtcatgtcactgtgtcattgcagtgtgacaactggaacattatttaagtaatttaacctaatagtatcttcaaaatggaatttctgttttgatattaataacttttttcattttcacctaggctgagttgcctagtcacgtattttccttatcgcatctgtgggtcaatctaaccatgcaaatatttttgttttgtatcattttataggatttaatgtttatctgttaaccctactttcatatattagccctccacatataaacatgcacacataaggcagaacattaatattttgtgagactttgactaatagccattattctggaagtttttcttttataacttctttccattttttgatgacttaaaaaaattttttttaccattaaagagtagtcgtgtataagataaaattcatgaacatcttgtttatatgaaacattctccaagccaagtaggaaatgtaagattatattccaaaattctcatataacctttcctcctttttttcctcaggtgtttggatttatagcaagttttatgttcctacttgactttatcactatgctgtatgaaaaacgacaggagtcccagctgagaaaacctgaaaataccactagggctgaagccctcactgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaagtaaatatccagggaaccctgcccagactaatactgttggtggcataagagaatcaagccattctcaagagataacttcataaccagaattgtctgttggctagcagctgtcacagataggcagggcacttgggatatgacctttctgtccaggtgattcacagactagacctttcttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtgtcttagatgggttttaattgcatgaatgtggctaatgtggttctcagaaattggtcagtatggcccaacatagcttctgctctgtcttactgactcaatacctttaggatttgtatcagagtttggatactagtgttagtggtggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaatcattttatatttgtcaatttaaatcttatgggtcttttttttttatctctcttgatgtcagattttatagtctttttaaataaatccatttaattaaaacgttcttacctttgtaagtgtttattacagaagtgtgatgtttaaatgaaaagctgtctctgtagttgtgggagttggctgcacaatcttgttgagtgcctatatagaatactagattttagatatatctaggatagaaaagaaacaaatccatttcccatccataaactgtccctcttgttggaaagttagaatacacatttaaacaacatttttagggaaccacagaggaagacttacaaatggctttaaatacttccaa

SEQ ID NO: 105127 - DNA, 1091 bp, Homo sapiens
ttggaggtcggggtgtgtgttgtctgtatgttgggtcagagggcaggtgccatgctccctcatttctggcctttctatatactgcttctctgctgggaatttctttccttaatctttcatcccccaaactgactctgttcttcaggtctcagctttctccttcaggaagcctttcctgaccccgcagttgagcgtctctcctgtgtgcttttataacaatattatatatttcccctttgctggcattagtacacgataggttaattaattctttatttacctgtatttccttcaaggcggccaaactgtaagttctgtgtagataaggtttattcattaatcttgtttgccatagtctcctcattgtaaatatttgagtaaacgtattattcagaaacagctttctaaatactgtagattctctgaaaaaacacttaagtaaaatgttttgcttcatttgtagttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggtaagcatgagaaaatatcatccctgtattaatagctgttttgtaatctggcataattttattgttcaaagcagtaatgttttcaaaactcagcaacatgaaaagacagtatcccttgttccaactcgctctgcttctaagcacctcattttttcctaccaaggggatggtagagagggaaagtgagattagaatgagagtgacagacactgccaatagtttacagttattggtggtttaatgtaattcacattagacttaaaaaagcctaggattttgtcacttctgatttctcacttttgagtgtcactcattggttctacaattattaattgtgtgcctttattatatgccaggcatttatatgctagacattggagatagagtaatgaactaatgtgaaatatttctggagctttaaaataaaacaacatttaaagcttaaagcttc

SEQ ID NO: 105128 - DNA, 1158 bp, Homo sapiens
ctcctcctccatcttctttttttttttaataaatttatcaagccaccagaaatgctgaatccattattttcgtatcatattttcacgtcacttatcactatctgaaattgctatccatctgttttcttgtttattgtctgtctctgttactagggatcctgtgattttgggtagtacttggctgtcacccaagtacctagaacggggttcactgcacaccgaaagtacgcaaaaatactaagtgaatgaatgtcaggaggatgaaagatggagggaggtgagaaatccatcaaaggctcacagaaagaactcaattcttggatgaaagtcggaagaatcccaacagctaacaagcaaatttgctgagagggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctggtgagtccgcggtcagggagggcgagcccgggctggggagcggggtctggcccgggcttgggaggccgccgagctccttcgtttcagcttggttgttcagtaaaaggaggtttccacacctctagttccttccctctcagcctggggaagggggcgttaccctccgcccttccgccgggcggcccctcagtcccaaggctctccccatcgggatcccacgaactggggccacccagcctgttaggcgggctcaggaaatgcgtcggagacccaagtcagccacttcaacatctttcactcatcctctatggcgactttcctctcttctctctgctgctaccctgcattatcgcccacagtgcctgtatttagactgtgaagcgctgtttatctttctctggctcttgcggttttcctgctgcgagcccatgggggcagtttaacttgctggacaaagtcctgcgataccacgcgtggcattgagatg

SEQ ID NO: 105129 - DNA, 1425 bp, Homo sapiens
agtgttgtttgtataacttagtgtgctaaataaagttaatgaaagtgttaggactttttaaatgaagagatattggtgaaaacgatactttcacttatatctaaatcttgttttttttctttttcttcaatgtaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttcaaataacttgttgcattctcttatgtttaaatttacatgtgtcagctaataaatgagattcattagtacagtcatcccttggtatccatgagggattggttccaggacctgcctcaggtaccaaaatctacagatgcccaagtcccagatataaaatggtgtagtatttgcatataacattcacatcctcctgtttactttaaatcatctctagatgataatacctaattcactgtaaatgctatgtatatacttatactgtattgttcagaggaaaataacaaaaaaagtgcctgtttagatgcaacttttttttcaaatattttccttctgtgattggttcaatccatggatatgg

SEQ ID NO: 105130 - DNA, 1084 bp, Homo sapiens
tataaagcatccatcttctgtttgtgggttattattagtaataagaaaaggtcaaatgaaaaatcagttggtgtggtatttggtttggatgtctattaaaagaaatgcatgcataaaaataaaatagcaaaaatatttcacattcttttattgagcatcacctcaggccctgtttaggttctaagtgctaaatgggaaggagagtgatacctatagtaaaccaatacatagacatctgtcaagtagtgataagtgctacagaaataaagcaggatgtagggagagtgagcaaggggactgggctgtgagggatgctgtatatgaatgatgggggaaggtctttgataaaggggggagaatgctgaaggcagggggaactaaaagtgtacatgccctgaggcagaaatgtatgaggaagacagaggcaggaaagagctgtggggaaggttaagctagttgatgagaggcagaagtaagttactgtgggtctttatcattaggctacagtaaggactttaggtttcattctgagttagatggaaagagattgagaggttgagcagaggagtgatgtaatctgacttaaccttttagaagaatcactggctcctgggaagaaaatagactgggtatgtgttatacagcaagaatagaagcaggagacttctgcaattccttttcctaattattcagctcatagaagagccattatatttttatttcagagaaacaagggagaagttgcatttcacttaactaggatattactggcccttttaaaacaccctaactgctgtttagcaaattttataagcatgattaatatgcttgtgactctagggttgtgctgttcaatacggtagccacttgcctcatatgccttttaaatgtaaaattagataaaattaaaaatcatttccttagtcacactagccacatttcaagtgctcagtagccactggtggctagtgactgccatattgaacagcacagatatagaatatttccaaaactgtagctagttactggacacctctgctgaaggccttgggtagggcagctcacgcatgtgaatataaatata

SEQ ID NO: 105131 - DNA, 1892 bp, Homo sapiens
gcatcttttttatcttttttttttcttcagacagagtcttgctttgttacccagcctggagtacagtggcacaatcttggctcactgcaacctccgcctcccaggtccaagagattcttctgcctcagcctcctgagcagctgggattacaggcatgcaccaccacgcctgactaatttttctacttttagtagagacggggtttcaccatgttggccaggctggtctcaaactcctgacctcaagtgatctgcctgcctcggcctcccaaagtgctgggattacaggtgtgagccaccatgcccagccaagtctgcatgtttaatactgtagctgctccattatatttcatcaaattgcctttttggttgaagctagttccagttgggtttttcacttggtactagaaagcatccttaaataatcggtgttataatttataagatttatcctttttttacatatctaggtgaagatggagctggaaaaacaagcttaataagaaaaattcagggaatagaggagtataagaaaggaagaggattggaatatttgtacttaaatgtgcatgatgaagacagggatggtgagtgtcatttgtaacataaatttctgaagtctattttgaggtgcactgccattcacattagtctttgattttttttagtgtgtaattttttactagaagttctgtgatgtcatgctggtcaagaaatagctatgtttagccatacttttattaatttgggattgggattcatatatgatacttttaagcatcttaaggtatcctggtgtgcagatacttctttcctaccatacttgaagaatctcagtttttcagttcatcttccctcagatagtgattgttttgttgactcccatttcactttctaattttctgataaaaatattatctactcagcttttttatctatcagctattttttcttctgtagatcacttgccttctcatttttgtatatgatatcttgagtatgcatatctctatctgctgatggtaaaaacataaacaagttatgcatcctctggttttggattaagaaatatgaagtagaggatgctacagttaagtcattttaggcctttagataaattagcagatggcctaaacagttgaactttactggcagttaagtcattttcggcctttaaataaattggtagatggcctaaattgttgaactttgtcaaagccaatagcacatctcctgtggagatgcactaaaataccaagtggtactgttagttggatgatgaaatgacttaatcttgttgccttggttactttgttttgtctgttgtagatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagtgtaagtaatctagaaacagtaatgtaggtttcaaatacaaaatgtcttggctgactttaatcattaggaatttttgactataaaaaaggtttaatgaagtaagcatattgtaagtactttttttttttttttggagacaagagtcttgttctgtcacccaggctggagtgcagtggcgcaatcttggctcactgcaacctctgcctcctgggttcaagtagctggtattacgggcacctgccaccatgccctgctaatttttgtatttttagtagagacggggtttcaccatattggccaggctggtctcgcactcctgacctcatgatccac

SEQ ID NO: 105132 - DNA, 1022 bp, Homo sapiens
tggcacgcacttgcggccccagctattcaaggaggctgaggtgggagaatcgcttgaacccgagaggcggagaataccgtgagcagagactgcgccactgcattccagcctgggccacagagagagactctgtctaaaaaacaaaacaaaacaaaataaaaacaaacaagcacacacaaaaacagataaactgataaaatggtaactttctttttctgaacacaataggtggccgggcagcgcactcaggggcagctggaagcagtggaggggcgacctggtggggaggcataggtcccacagccccaagccccgacaagagtgcctggggctcgtccctcgaggctgcctcgggcgccagcgaaggccttggcgaaggctgaccccaacgagacacgggcgggacagagaacagtcattctggcctgagccggggaactgtgtgtggagaccattgcaaaagatgcctactgctgtgctcaacagggaaacaggaaaaccctccagaggagagatttggataatgcgatagaagctgtggatgaatctgcttttttggaaggtacttcgggtcgattgctcagcagtgcaggttcccggccttcatctgcatccttcagctcgcccctctccgcaggcttcagcgttgagaagaacagtcttggcacttgcatacatactcttcctgttctaccctcgctcacaccggtataagcctccatctcaaccgttggcttttccctacaagatcttccacaacgtgtgtccgtcttccagtcaggcctggatgcagccgctgctgcttggagcagagatgaagaaagtgttctgcttaagtggcttactgcacgatgaggaccagaataaaggtctttgatcagaaaaggaagggaaggaagggaggggaggggaggggaggtgcggggaggagaggagaggggaggggaggggacgggaggggagggcaagttaaatggtaacatatgaacacaaagaaggaaacaagagacactgaggtctac

SEQ ID NO: 105133 - DNA, 1034 bp, Homo sapiens
cagggtcttgttatgttgcccgggctggtctcaaacttctggcctcaagtgatcctcctgtctcagcctcccagagtgttgggattacaggtgtgagccatcaccccatcctgacttccattttaacataatttttctggctgctatgttgagaacagattttcagaggcaagtataaaagtagtgagacaagaaaggaggctaattaaataattcacgtgggaggtaacaggagtttggatccagatgatagcagaagtgataagaaatggttatacctggatatattctgaatgtagggccaggagaatttgctgacagactaagatgggtgagcgggaggtataagagaaaaagaagagtcatggaagatgccaacccaagaaccaagatgtaaaagagggcagacggagtaagtctgaggtagaatattaggagctcagtttgaacttgttaagattgggatgcccttttttttttctcgcgtcctggccatcttagcggctgctcttggtggagggccatctcgcacctaaggcaggaacatggtggccgcaaagaagatgaaaaagtcactggagtcgatcaactctaggctccaactcattatgaaaagtggaaagtacgtgctggggtacaagcagactctgaagccaaggcaaagctaaattggtcattcttgctaacaactgctcagctttgaggaaatccgaaatagagtactatgcaatgttggccaaaactggtgtccatcactacagtggcaataatattgaactgggcacagcatgtggaaaatactacagagtgtgcacactggctatcattgatccaggtgactctgacatcgttagaagcacgccagaacaaactggtgaaaagtaaacgatgcaaaattttcctttaataaaatttgcctgagcttgtttaaaaaaaaaaaaaagattgagatgccccatttgtcttaaataaagatattcagtagaccattaagttcacagttctggaattcagggaagaggatgtctgtacta

SEQ ID NO: 105134 - DNA, 1041 bp, Homo sapiens
tgaaaccctgtttctatgaaaaaattagccaggcatggtgacacatgtttgtggtcccagctactcaggaggctaaggtgaaaggatctcttgagcctagtaggcagaggttgcagtaagccaagattgcaacactgcactccagcctgggtaacacagtgagataccatctcagaaacaaaaaaagttttggattttggaggattacaaatttcagatttcaacatttcaggttaggaatgcacaacctctattggaattcaggtttctttccgcctaaagtaatattcctcattacatgtgctagtgtttagtagatattttcctaaggaagatttaatcactggaatttctgaaatgagaggccttgcagtgcctagtaaaatgacattgttggcattgcaagttgctttcattcgtggctctaggtgataggcattcatttgagtaaagacttatgctttgctatttaaagctttgtatacttttttggagggtggtctgaaatgtgtgctttactttaggttgtgactattcttttctgtgttttttttctcccagaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgaggtgagtctttagaggtgatcagactaaaatctaaaatgtgattaattctctctacttgttggtttactggattaaaaagaaagcaattaaaatatgattaatgtttgtggttatgaactattaacagcttaaagatacaattttcatattataagctttaccattttaaagtgtagagtttagtggttttgagtgtactcacatttgtacaaccattactactatctaatttcaaaatatttttatcaccccaaaaagaaaccctgtaccatttgcagtcactccccatttccccctttcctcagccccaagcagccgttaatctaattactgtctc

SEQ ID NO: 105135 - DNA, 1006 bp, Homo sapiens
ctgagcctaagagggaaaggcccagttagccagccacccattatcaaacttttttttttttttttttttttaatgataaaagacataattcctagccaggcgcggtggctcacgcctgtaatcccagcactttgggaggctgaggcgggcggatcacgaggtcaggagatcgagaccatcctggttaacacagtgaaaccccatctctactaaaaatacaaaaaatgagccgggcgtggtggcgggcgcctgtagtcccagctactcgggaggctgaggcaggagaatggtgtgaacccgggaggcggatcttgctgtgagccgagaccgcgccactgcactccagcctgggcgacagaacaagactcattctcaaaaaaaaaaaaaaaaaaaaagacataattcctgccttaaaggagaccacagtcatagaggaaagacaattgaaaattaatagtcatcctaaatcggcgaaaacttcaggaggaatagctaccactaagaataagcactgaaagcccttgtttctttagtgaccagaactttggggtgggtgggaggcagagcaaaggataaactaggatttagaaggaaagcctgttgctaaattaagtgaataaataggccaggcgtgatggctcatgcctgtaattgcagcactttggaaggctgagacaggcagatcacctgaggtcaggagtttgagaccaaccttgccaacatggggaagccccatctctactaaaaataaaaaaattaggtcgggcatggtggctcacgcctgtaatccccacactttgggaggctgaggcaggcggatcccaaagtcaggagttcaagaccagcctgaccaacatggtgaaaccccatctctactaaaaatacaaaaattagccaggtgtggtggcatgcgcctgtaatcccagccactgaggaggctgaggcaggagaattgcttgaacccgggaggcggaggttgcagtgagccgagatcgcgccactgcac

SEQ ID NO: 105136 - DNA, 1026 bp, Homo sapiens
ttcctgacatttatcctttaatattcattatcatatggatccttgatctgaaatgcctaaaatcaaacaattatttagcttttaaaaataataacctatttaggccaggggcggtggctcacgcctgtaatcccagcacttagggaggccgaggtgggcagatcacgaggtcaggagatcgagaccatcctggctagcacagtgaaaccctgtctctactaaaaatacaaaaaaaattagccgagcatggtggcaggcgcctgtagccccagctacttgggagacagaagcaggataatggcgtgtacccaggaggcggagcttgccgtgagccgagatcatgccactgcactccagcctgggtgacagagcgagactctgtccataataataataataataataataataataataataacctatttaattgatggcaaatgtattataaatcaaggtagaccgaaacattgaataggttttattgtcatgaacacatgacaataaaatggttaaccaagatgaatttttttttttttttttttttttttcctgagacgaagtctcaccctgttgcccaagctggagtgcagtggcgtgatcttggctcactgcatcctccacgtcccaggttcaagcaattttcctgcctcagcctcccgagtagctgggactacaggcacatgccaccatgcccggctaatttttgtatttttagtagagatggggtttcactattttggccagtctggttttgaactcctgacttcgtgatctgcccgccttggcctcccaaagtgctgggattacaggcgtgagccactgtgcccagctgaaaattttaaaaagtggaaactttatatagactctaaaaatgttggctaggaaagatggctcatgcctgtaatcccaacatttaggggaggccaaggtggatcacttgagtccaggagttcaagaccagcctgggcaacatagtgagacccccccatctctacaaaaataaaaataaaaaataaaagagaa

SEQ ID NO: 105137 - DNA, 1160 bp, Homo sapiens
tgactttatattttatttgctgcccaggataagactgggttctttgggatgccagatttgataaagataaaacttctttagctttttgtgttgtacttctatttctgttggatttggactatgtttgtcaataagattctttttgcacagaactgttattagcaaaatgtttacagaagataaaattaaaaactaattgaacaactaaacttcaactttaacagttgaaagttggctgagtgtggtggctcatgcctgtaatcccagcactttgggaggccgaggtgggcggatcacctgaggtcgggagttggagaccagcctgaccaacatggagaaaccccttctctactaaaaatacaaaaattgagaagtttcccccttgggcagtggcggaggtggtaactacgacagtagcagctccggcggcagcagcagtgactacgaggatggcggaagctgcagcaggacctgcaacttcccagaggtttttccagagcttcttggatactctaatcgacgaggacccccaggcggcattagaggagctgactaaggctttggaacagaaaccaaatgatgcataatattagtgtcaaagagcttattgtcacattcttgtaattactgtgttgctgttgctgatgcaaagaagtctctcgaattcaatccaaataattccaccactatgttgagaaaaggaacatgtgaatactatgaaaaaaactatgctgctgccctagaaatttttacagaaggacaaaaattagatagtgcagatgctaatttcagtgtctggattaaaagatgtcaagaagctcagaatggcccagaatctgatgtgtggactcatcagtcaaaaatcaggtatgactggtatcaaacagaatcgcaagtagtcattacacttacgatcaagaatgttcaaagaatgatgtaaatgtggaattttcagaaaaggaattgtctgctttggttaaacttccttctggagaggattacaatttgaaactggaacttcatcctataataccagaacagagcacatttaaagtagtttcaaccaagattgaaattaaactgaaaaagccagaggctgtgagatgggaaaagctagaggagcaaggagatgtgcctacaccaaaacaattcatagcagg

SEQ ID NO: 105138 - DNA, 1028 bp, Homo sapiens
tactcgggaggctgagacaggagaatcacttgcaaccgggaagtggaggttgtggtgagcagagatcatgccattgcactctagcctgggtgacaagagcgaaactccatatcaaaaaaaaaagaaagaaaagaaattacattattagattttttatttttattttcttttttctttttctttttcttttttttttttttttgagacagagtttcgctcttgttgcccaggctggagtgcaatggcatgatctcagctcactgcaacctttgcctcccaggttcaagcaattctcctgcctcagcctcccaagtagcttggatcacaggcatgtgccaccacgcctgtgtaactttttgtatcattattggattttttaagccaatttttcaaatgtttgctgtgaggctactttgtaaatttattttcctttgacaaatggtgactgactggatttatcctcattttagccttttttaataagggttaaactatttcagatatttggtttagatttctttaactcacaggatctatggcttgacaaattttaatgcctagtcttgcatagcttgttgtaacttggtgcttgaagaaaatgtttactcctttcttttcctttccttttttttttttttcttctttttttatcttcttttccaaggatgggcattctggggacctagagctagttccttcagcatgtgaaggggagagtggggttttgtcagatcctccacaggggggaaaagctagtgtctcttcccttgaggtatagttcttccagtctgatgaactgtcagatccactgagtgattggtaaagcagattggacagtgactcgaggaagtgggggtggggacaatattttaagtagtaactatcaaaagtaaagtgattctctgggggctcagtagagccatgtgtgcttctagcgttagcagtctgcaggaattgtgcagagtgcggtgttttctaagaggaaaaggaggatgagtgtgagagtgatgagaggtgagttgggatgg

SEQ ID NO: 105139 - DNA, 1065 bp, Homo sapiens
ctcctgagtagctgagactacaggtgtatgccaccacgcccagctaatttttgtattttttttgtagagacagggttttgccatgttgcccacgctgttctcaaactcctggactcagcagtccacccacctaggcttcttgaagtgttgagattaaaggcatgagccactacacccaggcagttgattcgttttacctaaataaatttagatttcaatttaaggacatgaaatatgagacctatatccaatgtataataacataatatacccagcattattttacattgggtatttttgtgacgttgtacttttcagtttggaatctgttttttcattttaggtttttgggacatttatatgctgcagaagccctcatctctctcgacagaatatctgatgccattactcacttgaacccggagaatgtcactgatgtctccttagggatctcttcaaatgagcaggaccaaggttaatgaggacatctttgatcagaactggtcactgtttccatttccctcctgtcataattcaggatgtgtggaaatttaggcatggtggtaatgagaagaaagttttaggttggctttccacatttttgtctgtacttactttgtagcagttgtttgctaagtagacctgagagttaatgatcacatcatctaaattctcacttttgaaaggctggtactgttagaatggttaattttggttctgatactatttatttgttttcctttggagtgattctaaaatccataggggagtaaaaatattgcattcaagagtcagttttagtccaggcgtggtggctcacgcctgtaatcccagcactttgggaggctgtagcaggagggtcacttgagcccaagagttcaagaccagcctgggcaacctggtgagaccctgtctctattttaaaaataaggaaagaaaaaaaagtttgttttaagtcattgctaaatttctaaataattgtcgggtgcggtggctcacacctgtaatcccaacactttgggaggccgaggcaggtggatcacctgaggtcaggagttcaagacc

SEQ ID NO: 105140 - DNA, 1235 bp, Homo sapiens
aacatggtgaaaccctgtctctactaaaaatacaaaattagccaggcatggtggtatgcccctgtaatcccagctactcaggaggctgaggccagagaatcacttgaactcaagaggcggaggttgcagtgagtcgtgccattgcactccagcctgggcggcaacaagagcaaaactccatctccaaaaaaaaaaccagcctgaccaacatggtgaaaccccgtctctactaaaaatacaaaaactagccagggatggtggcacatgcctgtaatcccagctactcaggaggctgaggcaggagaatcgcttgaatccaggaggcggaggttgcagtgagccgagatcatgcccctgcactccagcctgggcaacagagcgaggctccatctcaaaaaaaaaaaaaagaaaagaaaagaaaatatgccctctaccttctgagcccgaggagaaaagaaagaaaatatgctctgttgttctgcccctcagatttattttcgtgtttttgtaggatcagacaaaggtgaaaatgaagcaatggaatcctgtaagtaagaagttttgtgatacttaagtagcctggcctgcatcccaaaaatttagattctaaatcttctgtgttcgtttttctgcctgaggaatactgctgtgccaagtggctcctcaaggcgatagattgggttgcttccttgctgttggcacggcctcttcaccagtgtctacactctttttccccagctggtaagcgggcccctcagtgctaccccagttccgtcaactctgccaggactgtgatgctgttcaaccttggcagcgcttactgcctgaggagcgaatatgacaaagcccgaaagtgtctccaccaggtgagtccagagtgggaggaactgaaccttgtaaagcagccaacacaagtttgaggtttatattttttgttactttgtttgaagcatctgatcagtttgttaaatattggaatatcactttcccagatataaaaatattcttgcaaggtaaacaactaatcagcattgtaaatgaacctagacacttaaaggaaagttcttcttgatgattttattttaaaaaaaatttttttttgccaggcacagtggctcatgcctcccagcactttgggaggccgaggcaggcggatcatgaggtcaggagtttgagaccagcctggccaatatggtgaaaccccatctctactaaaaatacaaaaattagccagg

SEQ ID NO: 105141 - DNA, 1034 bp, Homo sapiens
gcctcagccccccaagtagctgggactacaggcatgcaccaccatgcccagctaatttttgtatttttttgtagagacggggtttcaccatggtacccaagctggtctcgaactcctgagctcaggcgatctgcccaccttggcctcccaaagtactagggttacaggcatgaaccaaccctcccagatgattgtttcttttatacagcccacctataacaagttctctacctgggctataccttagaatcactgggaagctttttaaaattccattgcctgggccatgccctacatcgcttaaatcagaatttctggggataagatggaggctttatgggattccagtatacagccaaggctgcagatgacagctcttctagatcatcttttacctccccagcaggattttcatgtcttgctttgtgtgtggcagtattgttctgtgctttgttttttaacgggaagtgtttttataggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattctacccctgacatttggccaaaagcttacttaaaattaaggatttactaagtcatcatcagctgtttttcttaatttcagccagactattaattttgagccattatgtaatatatgccataggcaattaaaacataattttatcagaagtcttttacacttttattgactattagattattttagcatctgaggttttgtgttaacgttcaaaaattgacaaagaacatcagcagtagatgaaatagccagttcagaagctgacctgggggtgaaggggaggga

SEQ ID NO: 105142 - DNA, 2720 bp, Homo sapiens
cgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgcgcctcaccaaggaccactacatcgagcgcggcccgccgggtcccggtgccgcagcagcggcgcagcagctcgggctcgggccgccctttcccggcccgcccttctccatcctctcagtgtttcccgagcgcctcggcttctgccagcaccacgacgacgaggtgagtgcgtgggggcgtgtgtttgtgtccatcggataactgcgtgtgtgctcaacagcgtttcccggccggtcccacagcgaggggaggaggccctctccggatttggtttgtatttcctttggctacgtggcagtccttgctaccaaagtagatcatgacctgggaagtatgtggaagtggattctgtgtacgtgtcgcgaggggctccgaaaaatcccatagcgtggggtcctcccttttctgattttaatttctgtgtggcaaaacgcggcaatcgtcttgagttaggcgtgagttgggaggagataggtgtgtgtgtttgtgtagacgtggcctgctcctgctcttgtgggcacaccagaggcctcccaacgtgctgagaaggcgctcctttattttcagatttttgtttggaaaactcatagattgttgcctttaaaatggggcgtgagcccggaagagatggttgtgtgggtgagtgcgtggagtttgtgtgcctccgtagacctggtttccacgtgcgcacttgtgaggggaagactggtttttttgttgttgggacagcatggcagtccttgcctccttatgttgggtaagagtgggagcgtctgtggatctttgagggccaagggcccccagtcttaagcccttctctctctgcggctgcttcctatattgtttaaaatgcgtgttctggcccctgaattctcctagcgtgaaatcgccgttcgtgggcccacggctgcaccccgagatagaagcggaataaagggacgacgttaccttcaccagcctgagtctcttgggccgcgcccgcctgccccgactccaagccctacaggaaccggtttccctggttaggaggtatccacccggctcaaccagggtctcgacttccttggaaaagaccaaggcagccgtacgctgctggaacgccggagtgcaaaggcttttagggctacattgcaaccctcgggctcgatttcgccctttgggctgtcgagtaaacatttgcttttcacacagtgtgacccctttctcctttccactttggtattatgcgagtgtcgtcttctcccccgaacccaatgaaggcaggccaaaagtcttgagaagcgggctcttgccgagggggtcggtaacttaggcgatctacctgtagaccggtaagagagggtgtgggtgaaagtcttgacttagagcgtaagctggagactgcagaggctttaaaagccatagtgggggtcgtggcctgtgtgagctggagagtgggtaccgagcaccgcaaaggtgagcccagcgccgctgccttttccactcctaacctgttatttggggaggagggcggagctattgcctgatggcctttagctggcttctcctgttggaaaaaagttgaaattctaatctacttgttgtaggcatctccttttaaaaggtttcttctaggtaagaagctagggggcagttatcttttttttccgtttttaaactttgaatggactcctagttttaatatactgtgggttcatgttctttcatcacttttagaaaaatgagtgattgaggtaaataccgatccaaatcccaggaacagaaaaatggagccaattcacttgcagtttgggatcaaatgcagggtgagcagaatggggttgaatccaggagtttccccttctgagaggtgcttttagtttaaatgtcagtttatatttccagttaaagatacacctatattttatttgggctgaaacagtagatgctcagtgttggcagacttgtaaaagatttattcacttttaaaattagaaaacccttcaaactgcattggggagtgtgaattgagaagtgaagctctccactcaccctgggaggtactcggaagctcttcaaattcactttttagcatgtgcaatgtcaggttgaagtaactaataatccttaacataaaatttgctcagt

SEQ ID NO: 105143 - DNA, 1072 bp, Homo sapiens
agtgaccctttagtgttgttttgcttttggcacatagaacgtgagccctttgcagccttggaggcgacaccggcagcagaaatgctgggtgtgttgtgtgcctaagctgggcgtcaggattctgtgaatggcgggaagttgagcagggtttgaacccaggaaagcctctgtcactagcggtgaggggcagtgggggtgacattgttgccacctggaaaacattgtagcccgccccacccgaggatggcaatattgttcccagttaggcaggtctgggggtggcgttttctggagtctggttggaaaaaggggtgcaggtgttggtagaatccatgcggtccctgtgttgggctttaaaatgcctcctgaagagaaaagttctagaattccaacttgatttgaccctgaacattgagcactcctgggactgtctcctggcaggaaacttaaagtggcttcagtcacttggaacaaggaggtttgctgcctaaaataatcggttgctgtgtgaatttgttttgtatattttaagtcatattgtaaatgggactgtacctgtattcagcaccagtgtatattattctctgttcccaaagtctaagttttttcaggtctgcatatactcagtgtatgcatgcttattttaaattatattcatgttcttgcataaattataaaatccataccaaaatatttttaaaagcataatacaaattttcccacttacactgcatgtcgaagtaattctctttttaagggtgtgaaatgtaggtatagctaaagaaccactttcctatcttttccgtctttagaggcgatcagatgtaactaagttggtgaaatttatgataaactttgagaatttctacaagaaattggcattttaattggaatccgattgattcatattaatttcaacaaatttttaaaaaaaatttttttaaaggaaggacaaggagagaaagtgaacagaaatgggtattctagtatttctgttacctgctttcaacctgctctacactactgggtgaatatgtcctctgagtgcagacatctcacctactggctggaa

SEQ ID NO: 105144 - DNA, 1942 bp, Homo sapiens
acacctaggaacaactccactcgcttctgagcacctgtctctacctgctttgctctagcaccataaagattgcccctgtaatttcagcagggatttccccacagctcagcagggagagaagggagaagagaaaggaaactctcagtgctggtcctcatatgctgaggaggggaatttgcagattccatcactgtctagatttactgctgggaaaacattgtccgttttgaaaactgttagtttgataatggcataattatttattgttggtcattttgctttgactcccaggaagctcagagccaaaccatggtctcaatccaggaagtcccatcccgcatgctgctctcctttcatgactcaagcttgcctgtgtttgtcttctttgtaagctgcttttcttagatttgggtgagagttcctgaaaaaaatttcagtaaaaattgagtatgatggggttgtaaattgtccaggatagacaggttttgatccaagaaatcagactgctgagttaggtaaaagaattaagccattgtaccagcatagcacttgtcaaatatgcatataatccccatgtatgctctgtcccttcctggatagagtccagacccgtgccaaggggcgggtgcagagtcttgccagcatgtgcctcacagagaagtcggggcagtgaggactacaaagctctcctctgtaaaaatcaaagtgatttgagaaaccccagggttattcatgtccccttatacagacaggccttagccaggtgtaggctcttctgatccccatctccccacccccacccaagaaccctctgttctgcaatttggtacatcttgaaaccccttcttgagaggtgagaggaagtggttaatccccacttccttccctgggagttttatgggcctctgggagcctgccttactctggccttaatggtcataaatgaccctctctcagggcagggccaagcccctatgagtcttaggtgcttaataaatgctttttgatggtgattcccttggtcttctgtaattggagggcgggggtgggactatttataggattatcggggtgttggccacagcccctccagctgggtataggcctggaacattgtgattgggcaagggcttccagggtgctgggactaggtttgactgaattggtcaagtcatgcctttgttgagaaatacaagaggggcagggcctcaccctccaagggagccctctgcttcctgctactttcaccccccaagatctggcctgcatggtagcagggggtgggagaaatgtgaaggtaatggtaattgagggttgatcttgatttgcacctcaggacactccccccaactcaccaggatcccttttctcatcaaccagagttctaaggcatagcagtaactccccagtaagcttatttcttggtttgcccagctcttgggacaggcttacccaggggcctcgaagtaagggatactgggatctgtgaaaatggagtggatggcccagttgtgcttagcacatttaatctttattagtggcaaaagagctctgggaaggaaatctgggcaggcatcacctctcctgctagcaggtccccctccctttccctgccagctaatccccgtgcctcccattctgcagggttttaattaactgtgtttaatcttccccgggaagcaggcttaatgcccgcctgcgtgcttatcccgttacccgctgggttttctgttccagcccagccaaggacaagtaacattctggaggagtcttcgcccaagggccattagctgagggaacctccctgagctcctttcctgtcgtgctgctttctgggaaggtgcagagccggcccagaaagcaaaccagggtgtgggcaagggttaatctgggccctgcccgcccaccctgcctttgtggaggagctccataaatcctgctg

SEQ ID NO: 105145 - DNA, 1012 bp, Homo sapiens
taggcccaaaatactccgtcctccattaatgatcagcatggctccctccaggaatggaaattgtcagattgtcatagaatgttttagtcatcctgatgactagagtcattctctctcctgcttaattctcgaccttcttttgcaaccactggaacataacagcaaataaaaataacctttaaggaagactagcttgtgtagatgaacattctttgaattttaagctgaaatactgagtgcaggatggagagaacgctgctaagcagggtatcttgaccggcttgttagtgagggttttgtaggggggaccattcgctgccctatccgcctgtttctcttgtgggattaatcatttccttttgaccttgtgctctgcccctaacatgttgcattgatcagatcccgaaatctcaagtcattctccacccccaccacccacctcattctaatgagacatcctgaggtgcaggttggggaggggtttaaatagaaaaggtgttctctatcaaaatacacaaaatgaaaaacaaattattatttttcaaaacaagcctctccactttcctgttttgttttcttatggttctgtcaagctttttagaaagctccgctttctcactgtgactatggaaatgttactggttcagcttacacattttaaaaccttgtgtttctcgggctgtggggaaaaaagtttgttctttttgataagccttacgtctcaatttcctcctcactctcactttttagaaaatttcttaagtagatggtgaaatttgaatttcaggctacaattagtaaaagaactgaatacagttggtaatagagtggaatacaatgaacaaatggccaagccaatgaggaggataaggagaatatgcagaattcactgattggtatatttctctccttaactgaatccacccagctaagttctttgaagacttagcgttgtcctcctcacctttaattaatgaaagtgaactggcaaactggaaactttgttttttgt

SEQ ID NO: 105146 - DNA, 1008 bp, Homo sapiens
cactacgcctggctaattgttgtatttttagtagagatggggcttcaccatgttggccaggctggtctctaactcctaatctcaggtggtctgcctgccttggcctcccaaagtgctgggtttacaggtttgagccaccacgccctgcctgaactggcaactttgaaagggttggggcagttctactgtgtgacattaatcttgggaaacttaattatttcaaacttaaatttcaggtggcaaaacaggtctgaagagtatcaaaattgcaaaagagagaaaggaaagctgatgttatcacttaggcatagcaacagctttcttttgtggggtaggcaggaaaggaattttctgttcacttcccacttgggaacaactattcaggagagagaagtacccaaaaccctctggagcgtgcccgaggggtcctgtgggaacaaaggctctatattggacctgctgccagcttggaccaggctgttttatggtcggtcctcggccttggaccaaactggtcacagattccctggggggtagccttttggattgtggggccatgaatgaaattggggacagggacagtgtcacggcctaaactggagcgccggaggcacatcctggagaaggacattgagggctgtgttcctttctctgaccagagggagggtgggggttgggaggcagataaataggtttctccagcttctccatatgtccactactgggtttatgcctgagggtgttgtgtagaaatttgaagtattgggaagcaaaacagtggttcaaacaaatgcagtgataggagagtggggctctcagatgtgagaacttagaaacggacccaaagcaagacaagagcattttgccagagaggtcttcttgtgctaggctcattttagggagctatgggaatgtgctattaaagtcaggcttgttaaacccagcaggcatttattcttgacctgtaggggatagggagccattgagggttcttgagtttggaagtaa

SEQ ID NO: 105147 - DNA, 1054 bp, Homo sapiens
agtctgtatttctgcttctcttctcaggacagttttacccaggtgatgagtgccttcccttgctttaaaaaattctgcctttctacaccatctcagccacatgggtgattgaaacctacttggcttctttaggaactgaaagggtttcaggtgtacactgttgcccgctgtttaagaggcgaggactgagttacatggccacctacagagtctgaccattttttaaatgtcagccccaaagtaccactgactcttgtccatagcacaacagattaaaaccttgccttgcttttgcaaccttggaggcagctggaaaacttgtgtgtctacgtccaaatctgtctttcgtgtccagtttaaaaatatataatttacatgggcagtgatctcagtgttggaacaaatctcttttatttgctgctggaagctgcatgggccactcattaatacatcagaggtcagatgcatgccggggcggcagctgggacactaatgatttcatatggctttgtatgaccgctggccgcctgtggtgctgtaaatcgggactcagggttctaattttttcaaaacctccagggaggttgcctcttgcgagatataacttaagataatatttatagtagagggcagaggaaaaataatacctaatgggaacattgtggaaaaaatggtagcaacctattagaagtaaattatgtggggccattggagttaactcatttatgggctccatgagtattttattaggtccttagctatgaagagtgctgcgctgtggccaagctccaagcatcaccccctcaacaacttaggttgtcagtggaaggattctcccctcacttttgggagggaggagtattaattgaaccttttttttttttttttttttttttttggagctggtcttgctgtgtctggcttgagccaggctgactgcggtggtgcatacatggctcacagcagcctcgaactcttgggctcatcaagccatccttctgcctcagctgtgactataggcatgccccaccatgcttggttaatttttaattct

SEQ ID NO: 105148 - DNA, 1093 bp, Homo sapiens
ctgcagatttgagcacaagcactcagtctatctcagtcaagtaaagcgttgttttaatattacttaatagacttatttcatggctagattttacctccttgaacttggcttatcatttttaaaacgaatcttgtgttgtcccacgtgagaacctgcagagtagcacacacaggtaaggcttcttctgggcctcatttgcttctggaacctgttgttgcctccactttacttctgtagtgggaaactcagaaaccctcttgggtgggtggagatctagccaggtgtcagcggttcagccttggtttgtgggagcccaagtaaatgtcctcagtcattttaagggataccaaactaatctttaaaaagtttacagcagtttatgtattttagttgagacatttcgatgaacttaaatggcaatctgggccttcctctgtcctttcagcttacattcttcactgataggggtagttgtgttttaaacctgaagctcattctttcagatgtcccttggtgtgtgtgttccttgttgggccacagatagtgtaaaatctagattccagaagcctgggtgcacgtgcatttgcatgtgcacacatgcgtgcacacacgttcattaacaaagcattttatttaaacactggctaaggtacaaacatgcctactttgtatttttatttatttattttcctttaacctccctcccccattcctcccggcctagtctcccgcccgttcctttcctgctgggctcacattcctaggtctttgtctctgcctggtattctagattttggggagaggaaggcaatgggtgggacgttctggaagctgggggcagggaagagggtggtcacttgcagggtcagaggtcaagcctcctccatttagctggggcagccggattgtcgccaggcccgagggggcgtgtctgtgcatctgcccgggaagccccaaacaggccctggaattcctgctgctagacgacctgttcttcccagtcccttcccccctttcccgggagccgctgttcatggctactaccacatttctggctataggaccctccacacagctccagtttatttcctta

SEQ ID NO: 105149 - DNA, 1052 bp, Homo sapiens
ctcttgagagctccttgtttattagcaggtaaaggttgtgccagcccttctctctcttcctccctccctccctccctccctccctccctcccagcgtgctgggccccagggaagtgtagaacatcacataaagcagttctgtcagcactggctgcctcccaggttcaactccttggaataacttggcatgaagaagaaaggcaaggagctggctgaccttaccactagctttttgccttcgttccagaaacttaagcctgtagcttgcttgagtgcctgggagaaccatgctttgcactttgcattactacctgtggtgtgaggatggttgttactggctcttaaccttgcttcacacatctaggctagagcagcaaaggaaacttttctggtacattcttacatccaggccactaatatcagactaggtaacacagtcttaacaacttttctggataatgaagctaagattcagggcaaactctcatgccaggaggtttgttttgtttggtttctgccttcgaagtgtctctgttacagttctgaatgagactagagtgggatatggcattcagttgtgttcccccctccattcccccttaatttggggcagagagagtgggagaaaaaaggaagcagatatttttagttatgtttgcagttacgccactgctgcctctccctttggggtgtgcttgctcattggggaagctggtcgttcggttgtgagagccagggccctccagttgctgtcttccctcctcctcccgtcctgcatctccatttatgcctgtaccctctcttgtccccaggtgctgcacctgtactgtgacacttgctctgtacccatctgtcgtgagtgcacaatgggccggcatgggggccacagcttcatctacctccaggaggcactgcaggactcacgggcactcaccatccagctgctggcagatgcccagcagggacgacaggcaatccaggtgagccttccctgcccttctgcagttcccacgtgaatcgagcccccctttctgtcgggtggcatggacaga

SEQ ID NO: 105150 - DNA, 1023 bp, Homo sapiens
cagagggtgaggccaggaagtctggggaagttgcttgtgtggctggagttgtacattttacatctgatcctcattcccagttttcatctgtcacccagctacactggttttgctgtgtcagagtatctcttaatagttctgacattcactgtgtaggtgctatttctcatgcaaagaaatccagctcttgccagcaactcctttagttacatgtcaaacagatgccagtctctccctaagtgcctgttttccttccaagggagtgaatcaagtggtctgggaacccagggtgtcagcttttcaagtctgacagagcagattcaaatgttttgtataaggaatgacagtccttctaatgcctcgaagttgtttctttttggttttccagctgagcatcgagcaggcccagacggtggcggaacaggtggagatgaaggcgaaggttgtgcagtcggaggtcaaagccgtgacggcgaggcataagaaagccctggaggaacgcgagtgtgagctgctgtggaaggtaacagggagagctcccccacccaggctgtgcccactcggcttccatgaacctcagcagcactctacgggactctttacagatccaggagccaagctctaagtttaaaacacttcgtaattttccagaaagcctgttagcagaaagatgcagggggtccctggaacattgtgggtgctgtctgcagtaaaacaacaagaagccttttcagaagtacgtgggtaaccaagactggaagcggtctccagttttatattgcattcactcaaaaggaggctaaagaagggagcatagtcgaaactgttgttaagaaaggcaggctggtaggaaacatccctatttttggtgacctggctggttgcacttcctgacctcttgtggaaaaccagttttcctcttcggagggcagtgagtgtgtgtcctttcttcctgttggagcaggaaagagtgccgagcacactagtgtgctgtttagataaaaatcagctagaaagactact

SEQ ID NO: 105151 - DNA, 8481 bp, Homo sapiens
gtgtatgtgtgtgtgtgtgtatgtatgtatgtatgtatgtgtatatatgtttgtgatctgagagtgagttggcatattggaaacacaatgcctttacccctaatcacattacaattacagaaatcaggaaatttgattttgatacagtactagcatctactcctcagtccataatcaaggttcaacaattgtcccaacagtgcttttcatagctagccactccctccagtccagagtcactaattacatatagttgtcctgtttctagtaactatcctctgtaacccagaacagttcttcaggttttttggtccattttgattttgctgcttttgaagaaagacagatgtcttttgtagaccatcccacaatatgtgtttgtctgatgcttccttgtgattagttgtggcttatgtggtattttctgtgcttggctctaagcctctgtgtctttctccactcttgcttttccctccaggtagaaaagatccgccaggtgaaagccaagtctctgtacctgcaggtggagaagctgcggcaaaacctcaacaagcttgagagcaccatcagtgccgtgcagcaggtcctggaggagggtagagcgctagacatcctactggcccgagaccggatgctggcccaggtgcaggagctgaagaccgtgcggagcctcctgcagccccaggaagacgaccgagtcatgttcacaccccccgatcaggcactgtaccttgccatcaagtcttttggctttgttagcagcggggcctttgccccactcaccaaggccacaggcgatggcctcaagcgtgccctccagggtaaggtggcctccttcacagtcattggttatgaccacgatggtgagccccgcctctcaggaggcgacctgatgtcggctgtggtcctgggccctgatggcaacctgtttggtgcagaggtgagtgatcagcagaatgggacatacgtggtgagttaccgaccccagctggagggtgagcacctggtatctgtgacactgtgcaaccagcacattgagaacagccctttcaaggtggtggtcaagtcaggccgcagctacgtgggcattgggctcccgggcctgagcttcggcagtgagggtgacagcgatggcaagctctgccgcccttggggtgtgagtgtagacaaggagggctacatcattgtcgccgaccgcagcaacaaccgcatccaggtgttcaagccctgcggcgccttccaccacaaattcggcaccctgggctcccggcctgggcagttcgaccgaccagccggcgtggcctgtgacgcctcacgcaggatcgtggtggctgacaaggacaatcatcgcatccagatcttcacgttcgagggccagttcctcctcaagtttggtgagaaaggaaccaagaatgggcagttcaactacccttgggatgtggcggtgaattctgagggcaagatcctggtctcagacacgaggaaccaccggatccagctgtttgggcctgatggtgtcttcctaaacaagtatggcttcgagggggctctctggaagcactttgactccccacggggtgtggccttcaaccatgagggccacttggtggtcactgacttcaacaaccaccggctcctggttattcaccccgactgccagtcggcacgctttctgggctcggagggcacaggcaatgggcagttcctgcgcccacaaggggtagctgtggaccaggaagggcgcatcattgtggcggattccaggaaccatcgggtacagatgtttgaatccaacggcagcttcctgtgcaagtttggtgctcaaggcagcggctttgggcagatggaccgcccttccggcatcgccatcacccccgacggaatgatcgttgtggtggactttggcaacaatcgaatcctcgtcttctaattgcatttcctaggtttctgtgtttggggtgtgtgtgcgtgtctctctctctctctctctctttctctttctctctctttttgaatttcaaagaagaaacagtctcagggaaatttcttttttcttttttttttttaaagagaacaagaaaagtacaacattgcttaagtcctacctcatctttatttttttacagatgaatgtacttatcttttctgcagggattgagcctgtgaagtgataatttctatctacctcataaatctttacatttccttctgcaacaggccctcttcccctcctcagtggagtttgcatttccctcttcccctgcgtggggcatgatatgcacaagcctggcatctgtatggctgggagggcactggatgtgtgtggtggggtgtattctgtagattgagccaaggaaacacaaaaaaaaactactaagtaaaaaaacaaaaaactataaaacatggaaaaaataggatttgaaatgcataattatagaatacctgtgttcttgagaatactgtttatatggggtttagattatgttgtgttgttttgatctttttggaaaatcttctctttttaaatgctgcaacagagaaatttcctctgttctctgtttatacctcagtgtgtttaacatcctcttctgcatcgtttcttgatcttagacgttgtggctgtggcttgctagccaagaaaagcagacccttcatattttagggtatataatctttgtttcttttaagggagggtgtgtgcatgtttgtttcaaagccatcttgcacccaagtagtaaagctgaaaatgacacactgcctcccaaagaacctctccttttcacactttggtttcttaaaaaagtatatagatggtagctcaggatttttgattaaacatattctcaaaagttatgctttcttattttgctgttaggttataaagggttaaatggaaggaaaaaggaaattaacctcgttctcagagagagggttttcaggcatgggctgacgtggacatgaatgtgggtggacatgcgtgtgctgagggagtcagggagcacattaaagaacaaggcacccccaaactataggaactccacagaaagggcagggtctgccctgacccgcgagtgcatgttgttctgtagtgctaggggtttcttttcctaagaagagtaggcaaaggaaagaacttttattttacaagcacaattttttcctgctttgaaagttcagggaaatagaaggtttgaaagtcaaattaataccaacagcccagtcccacaccctctgcttgggtcactttttataggattgtttgcacccaggccatgctttaggacctcatggttaacatgaatccccccgccccctctccccccaaggcctttgaccataaaggatctagaaaccaaattgtcccaacctgaaatgtaggatgtaatgtcttttcttaaacctgtaactcggtaccaaagaatgaaaatttaaggctcccactgcagaactgtggggtagaatctgtgtcactttacaggattggttggttgtaagctggacttgggtacaaaacttgtgcttctgggcattgtctgtctttcaagtgcaaagcagatgtagctgataccctgcttgtcagaacccagtgggttcctgcaatgccccaaatactgaaataagaaccaaattctggaggagccctcctcagggaaaagagggactctcaaacaaacgtcagtgacttacaagggagacctcttgtttaaagacttatggatcaacttctgttcctctgtttaagagaaatttctattgcaaaatgggtatcgttttaaatgagcagaacagattaacaaatggagcaatttgtttctgttatcccaatagaaaaggagatgatggggacagtgtgacaagtcaatcaagttgcttttcccgtacacctcttttggacgtttaatttactactactacaagctactctgtctcttcccattgctttaattctagggtttctgagtgaccaaaatgggaaggaaaaaaaaaacctcatctcacagaggagaactgcatgcaataaaagattcaaaagttggaaagtagcttcaaactgctgctggctcccagctgctgttacagggtgggaaggtgttaggaaatgttgtttgttagaagctccttttactgtagaatttaatagtgaatccttccccaatgcctattcagttgccttttggccgttaagctctaagttctttggtaaagagttaatataattaaacatttttactgttttctattttggagtaacttggtgctgatcttccttccctttccccagctgcccaacaagccaccctttaaacaccaaagacaactggttttaaatgcttgaaaaaaattttattgaggagatggatcttgattaaaatcttttcatcatcattttcattctgctcttttctttctaatttccccagatgtaggaaaattttgggacctgaatgagaaatgttcttggtgcataacagtaactagagctccttatttgacattttactatggatgtgatcgaaaagccaagattttcgctccatggctgaaattatcaggtcttaatttacagacttgtaaatttgcaggcttagagcaactagaactatcccctgaaataggtgtgtaggtcagagatactacctctttgtcctcagtggtggtatatctatctccttacctttctgtacccaaaatggtgcatgactggtatttgagaaacatggtcacatttggaaagcttttgtttttaaaacattggcggtttttcctgcccgtggttgactcctgacccatagggattggtgcgaagcactttggagagtgtttattgtatgatgtgaaatgttctaaatcaaagaaagatgataaaagccaacatttggcagtccctagtgtgaaactgtgaaaagtacctgtgtttaaatgcataatctcctgcccgggtaatgccaggtagccaggagttgggtcaaagaagggagtcgtcatcctgatggaaaaaataaggtcctgggtattatgaggtaggagaataaaaaggtttctggggagtaagtatgacaattactagtccccatggaggtctgatctggtcaggtggcaagggttgggtggggtatgatgtaagctcagtttatgtgtggagatgcccattgggtttggatatataggtttgagtattgagatgtttaaaggacatctaacccataggtaaaaactacttttgcttgacactgacttaacatttcaaaagtgttatttttggtcccaagatctaatgctgtctcagaacatgtgccctgttgtggctgcaagtggcactcaagttgactagagcacagtgacctgggttgtaccccaagtgcactaactcctcaatgcccttttaagtctaacttatttgggaaacacataacaaagggtaccataaaccgaatccaaattacgtgttgggccaaaaatgttgccagaactgaggcactttgtgatggagttgcaagagatagcttgagatcggctcagtctgatttattctagttaagccaaagcttaattatttgaggaggaaagtcttttaggcttgaagcagcaaaatactgtttatatatgtgttaccttcctcgttggaagattctacgattgctctgttctggtaggtggtgaaagatatgccaaagttttaggcttgtttttctgatcttatttttttaatccagtggtgccaaaaagtatttagggtatgtttaaggtatatttaaaacatcactctgaatgagtttccaacagtctggggctgtataaaagtcacactcttgtacttgcaggtgatggtgtcacagggccagggcctccagagctctacggctttctctggttttctatagggccaagggcacaggacgcagcattccagaccacactgactgcttttgctgagtttctacctcacttgtggcaagtcatctacctcatgttagcatctgacaggtctcaaaaagaatagtattaatccagtgggcagtgggtgggagtgggaagctacctctaaaagaaatgttaccataaatctacaactgatttctcccaggagaaatgttctacttaccttgaaagagaaatgtcaggcaaatgtagtcataaatccaagtagttcttagcaatctggcttttccccctcaaaaagaattatgcataccattactgttgttcagtattatgaaactactggttaatctgacctattggaggacttaactacaaataaagacctttaggtctctttctcttcaagagaaaaatattttatctgtatttcgaatgtctgcaaataataccctttaggagcaattctaaaggtctagatcttggaaacatcaaatatttgaagggaatgagaatcctcttgacttcatgattgtatttgtagctctctggacccggcaggacgttcatcaccatgatgttgcaacaatcactgttttgactgagcagtgactgttgaagtgtgtattgctcttttgttttgtttttatttttttctaccaaaggtaacatgttgacgggttttttttttccttgtttattaaatacttgataaagttgagaagcacattaccaggatatactgtattgaccctcccacctctcttctgccctaatttttggttgtttggaagagaggagggtcctaagaccactgtcattatcatgaggggcttataaatgtcatggtgaagaaatacctcaatgatgtctatttttaaaactgatcttacgggttaacaagccagcctggtgggatattttccatcatcatttaaccaataatggttctaaaagttttgtgtatccacatggtcttagacctccttttaatgattgtattaacttacaagctcaggtagtatttttcttaagactctatctcagagcacactgactgaatgttgatgtgtgtagcaaagtgtttactttctttaaataaccagctctgtaactctgtaagttctttgtgtttctagcagtctgtgtagttgtctttcttcagaggaagatttttcacatttctggggttttcttgcttttagggtggtaagattcctttctttttttcccttttctcctaaaatcgatgcaggtaagggtgggtgggtaaggggtgttgttttttaactagcatgttagttatacttgggtgggtgggagggttgttaaactgaatcttgcttaatactgtccattagctctcatgccgggtcagcaaaatgctttaatttttaactgcagaacatgtgactcggttgagtctttttgtcttttttttttttaaataaacaattgggggaattaatgtgggcaagttgccttatgttagaatgactaagttaaacctcttaatttgtatttgtccaaggcagacatgatataaggaatatgcactaccgtagtaactcccctggccgcagaaaccacactgcaagcctgtccggggtggggtgctgactgccatttgccacttttaaatgggcactgccgtggtaatgtgaatcccatcaatgcagtagatgggtggggaaatgaagatttccccccaaacctttaggcaaaagtgagtttttgtttggttgattttgggtttttttcccccctcctcttttggctttcacattttaaatcttaaatgttactattgcaggccgcaggcatgacaggcaatgagcaggtgaagaaccaatggaaaagtgttcaaaaactcctgtgttagctaacaggcttctgaatgtatcactgtggtccacagagaaggctggaggaggtagcaaggagatgctgtatcagctactacagccttaaaacaaagttggtgtctctttggactttaaaattgttcctatgcagcttattttatttttgtttaatcaaataaacgagggtttttccatggctacagtgtgtctgtgtgatcctttaatccatagtaaataagggtatgtgcactgtactggatggaaagggagtccctgaggtagacagtccaggagctgtactgtgactggtgggccagattgggcccatgcggtgccttcaaaaagaaaaaggtgatgggagcatttttaaatagagtaaatgttaaagagcctaaaagttatggattgtcacgaaatttcagacctggaagccttgtatgtatcttctcccaaggagctgagtagcagatgtccctctagaggcaaatatgtgacttcccagctgccaccaccctgtccccctttctctggaaggtcttggccttatcacctctgtctgagtagaggtacctgggaaccatttggggtctaaactgtggccccaggagatgtgagcaactcatccaactggcttctccctcagtggggggataccgtagatgctgggtggataaagactgttaatcgtgagcttaatgtgttcagaactttatttgggatttcatttttcactgga

SEQ ID NO: 105152 - DNA, 1189 bp, Homo sapiens
ctttttttctttttctttttttttttttttttgacacagggtctcactcggttgcccaggctggagtgcagtggcacaatcatggctcactgcagcctcggcctcctgagctcaagcaatcctcccgcctcagcctcccaagtagatgggactacaggcatgtgccattatgcccaaataatttctttttttaatttttgtatatgtgctgccaaggtgagcactcttttttaagtttttctagatacagggtcttgctatgttgcccaggctggtcttgaactttggcctcaagtaaccctcctgcctcagcctcccaaagtgctgaaatcacaggcatgagccacatttccagcagttttgttttttgaaagcagggttatggcttatatttattcttgattctctattcttagcctagtggcagaatgaaggctgtcctggaagaagtgaggaggttgggaaaggaactcttttgtagggaggaagaagacatatggagtggagtttgggctgggtttggaacctgatactttctgcaatattgacaaatgtgaataagacctttttagtcaaaagtcatacagacacatggtttggctgggtagtcacatgcttttgcctgttgagttttgtgacgtgaatgtgttttctgctgaaccaaccccttgaggcctgctaaaacaggtgactcaaaaacaactttgttttcttgggtggagtaatttcctggtgtttttctcaaaagttgtcaacttttattttagtgatggaggccaatcttgacaacttttatggtcaggcattctcaatatgttttaaaatgggtttcaggcaaggtgtggtggctcatgcatgtaatctcagcactttgggaggctgaggcgggagcatcacttgaggccaggattttgagaccagcatgggtaacatagcaagaccccatctcttcaaaaaaatgaaaaaattagctgggtgtggtggaacaagcctctagttctagctactcagggggctgagatgggaagattgcctgtgccaggaagtccaggatacagtgggctgtgatagtgctactgtactccagctgggtgacagagtgagaccttgcttacaaaaaatttaaaaacaatttttttttgagatggagtcttgctctgtgcccagtctggagtgcagtggcgcgatc

SEQ ID NO: 105153 - DNA, 1034 bp, Homo sapiens
agaactgaagctcctggcagagaggtaagaaaattagtgagtgcccaagctggaatctgaaacaaatctttctgcctccaaagcccaaaattatttcgtctggctgcagggccctgtgagtaatcgagcccttcatcttgggaaaggcatatacagacctggagcaaaacagtacgcagccatgctctgcatttagcaatactttggtttatttttgttctcacagaaatctcctttgctcttcccctcattagctgcttctggttgggcccagacctgccttgaggagcctgtagagttaaaaaatgaaccccacggatatagcagacaccaccctcgatgaaagcatatacagcaattactatctgtatgaaagtatccccaagccttgcaccaaagaaggcatcaaggcatttggggagctcttcctgcccccactgtattccttggtttttgtatttggtctgcttggaaattctgtggtggttctggtcctgttcaaatacaagcggctcaggtccatgactgatgtgtacctgctcaaccttgccatctcggatctgctcttcgtgttttccctccctttttggggctactatgcagcagaccagtgggtttttgggctaggtctgtgcaagatgatttcctggatgtacttggtgggcttttacagtggcatattctttgtcatgctcatgagcattgatagatacctggcaattgtgcacgcggtgttttccttgagggcaaggaccttgacttatggggtcatcaccagtttggctacatggtcagtggctgtgttcgcctcccttcctggctttctgttcagcacttgttatactgagcgcaaccatacctactgcaaaaccaagtactctctcaactccacgacgtggaaggttctcagctccctggaaatcaacattctcggattggtgatccccttagggatcatgctgttttgctactccatgatcatcaggaccttgcagcattgtaaaaatgagaagaagaacaaggcggtgaagatg

SEQ ID NO: 105154 - DNA, 1045 bp, Homo sapiens
tccagattacagtcaatggtgtcatttttctcagtatttgtctttgcattgtttaatgtgcttatgtttgtgtttctgcctaggacgaaggcgatggcagcagttttccaggctagctgtcttcacaacccgatggctctcttcttttctgctgccacagagactgactgtctgcctcctgcaaatttgaaatttggcaaacctgcctcctctgcttctcagaaccaaactggggccaggagaacttctgacccaagtgttgatcacctctcttcctgcacctcactgtgcaccctctgctcaggaaatgcctttggcgtgttgctgacgtctgtccctgctccatctcttaccaccctgcacttcaccctttcccacacaggtttcacctgatctcagctgctttgggcagaccatccaggtattttggagtctgaaaaggatctctgtctctaagtctggtgcaaatggagtttgggggttttaaaattcattcttcttgctgctgtttcacaatttctcagaaaaggtgaaaatgcagactttggcagttatgttcaatatgaaaagtcttaataaagtaatttttgacctaaagcccaccagtatttctggaacaattcagtcaatctttgaacttggtcacataaagtcttattagaaacacaacggggattttggagacaggactagtgaactttgtgtagttaaatagaaacttgaattgccagtgtagagtacttgattaagagataaggaaatccactcattcagtaaaaaataattgagttttgtgctagcaattttactaggcagttaggtggtgggtatttttggtggagtgagtctaattcatgattaaaatattgtttctcctgaacctcaatttcttggagtaataaaatcaaccttatctactttaagaagagggtaaaatgagtgtcaatatataaaagcacttggatttctgattttatgaaaggggaatttggagctattgtaagctttcaagcggtaaagtattatgaccacaaaaagtgggtgg

SEQ ID NO: 105155 - DNA, 1656 bp, Homo sapiens
tgtcttctgtgtacagaaaagtcagggagaggctggtctgtgggtacaggcagcacctgggaaccaggatgaaattcagaaatttccacactgttctctggtaccaacatctgtggccactgaagcccgtcagagggaccaaacctgtattttcctgaagcaggagtgggtctttggggcaagtttttgttgccccaaagaaggtggatgggggcatccaccttcttcccaccttggccagttatcccagcaagaagctaaaaccaaggctggcatgggcctggctgtcagcctcgcctttctgggggcatttctttcctccattgctgctggcctgccctacatcagggcccccaccttcctcagggctttcggtgcatctggggttgatggttctctgtctctctctctccagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaatgatgatgtcactgtttttaatgtgcaggtattgaattatatggtctgacttaaatcataactagacttgagtgggctgaataaaccacttcactaacttgaagttcaaaaggatggaaaatagtcttggtttgatctgtggactgctgcttttctgatcgttatttgacttgcttttggactagataacctataaatacagctcaaaacaattatgcaaacaatctaaatgattaacagttgcacagtgtacatagtatggtatatctatatagaagcatagtattttagccactaaaatggtgagagatctatacttatatgcaaattttttgatacatgaaaaaacagattaccttaaattggatcccgttttgtgtgtttcaacataagaacttcacatattcacacagtacaggcctatacacatgtcagtagtcaggcatgcacgtgtgtgtgtgctgtgtatgtgcacagataggaaaggatgtggtgtttctgatattcctgtcctgacatggagcagtagctctcatttgttgaggacttgttctacaccatgcacagttctgagtttatgtttaactcacttgcccctcacaagaacactgaggaatatactgtcat

SEQ ID NO: 105156 - DNA, 1159 bp, Homo sapiens
ttgttgcttttaaaggagctcccaaaaaattttggaaaattttaaactacaacttaaaacagtagtgagaccaggcacagaggctcacacctgtaatcccaacattttgggaggtgaaagcaggaggatcacttgaggccaggagtttgagacaagcctaggcaacatagtgagattctatgtctatttttaaaaatagtttttaagttagctggccatgatggctaacaacaacacgtgcatacctccccccgatagtttcacacctatagtcccagctcctcaagaggctgacacaggaggatcgcttaagcccaagaattcgaggctgcaatggactatgatagtgcagctgcagtctagtctgaatgacagcgtgagaccctgcctcataaggaaggaaggaaggatggaaggaaggaaggaagggagggagggagggagggagggagacttttgttttaaattccatttatccagatagtttaaaacagacagacaaacacatgtatctgtctgatcaacaaaaaagtaggtcaggcatttccaggaacctcacatttatgaaactattattattgccttagtgattacagcaaagggtggagagtctgccagggtcaagccgtggtcagagaaagtcactttgtcatggaactattttaactgagactgccttaggaagccccagaaaccactgcttggtccccatggggctgacttcattaagagtgtatctacttttagatcatattcagcaacacgtgcatacctccccaccaaaaataattgcaaaagcataactttttaagagaaataaaaatcaatgtatatattttttaaatagaatttttaaaggtaaattatattaaagtgtttttcattggttctaatcaaggagggaaggcaaatgtttttcttttagtgaacaatattctttaaaactcttaaactgggagcagaggaacgtgaagaattctttcagaagggcttcatgtcacctcttcaacgaatcttttcttggcagaattatcaacaagtagcagcagccatgagtgctactaagtgtatattgaatatcactctcctgcgtgcggagaatctcgcctcaaacaaaatggacaaagactttcccttcctagagcctgtgttatagctg

SEQ ID NO: 105157 - DNA, 1031 bp, Homo sapiens
ctttgttgttattattattattattagagatgaggtcttgctatgttgcccggactagcctcaaactcctgggctcaagagatcctccccaagtaactgagactacaggtgcatgccactgcacccagctcattgccttttgttttgtatgttaaagcagatttagcccatgaacttggagacagttttgctgagcagaacttcatctcttggctttgctgtttgtttgccttgtttttttgttggttttacttagttttgtttttggagctaacatccataacttttgctatgtatgatataatcccctgtatgaccctgggcaagtaacttaacccattcagggtccaggttcctcttatgggaaagggatgcttgataagacactgttcatggttccttgcagtttactattatgatagatattcgatgacctaaaaattaaaccagtttcctttttcaaatttaattttttcgggaggtggaggaagattttcattccttatggtttgagaaacatcgctttcatacatgtctagggtaaccaagttctctaaatgaatggcaatagtgatgtatttttcttaaatccttttctaaccagcattatgggtttgtgctgtaccggacaacacttcctcaagattgcagcaacccagcacctctctcttcacccctcaatggagtccacgatcgagcatatgttgctgtggatggggtaagaatcgtctctgaactgtgcgttttgtcccagtgagggtggggatgagcagcctgcacttgttaacacagcatttggggtctttgctcaccttttcagcctcaggctctacccatcatctttttttttttttttttttttttttttttttttttttttgagacagggttttgctctgttgcccagcctggagtgcagtggtgcaatcacagctcactgcagcctcaacctcccaggctcaagtgatcctgctacctcggcctcccaagtagctgagactacaggggtgcaccaccatgcctggctaatg

SEQ ID NO: 105158 - DNA, 1061 bp, Homo sapiens
agtgatacaggcatggaagatatgccacacacaagttcagaggagggtgaagtaactaggaagtattaaatattaaggtgatataataatagcatgtctaatcttagttgaatgtaactggcctctggttactacttttacttcttagttgttttactcgggggtgttcagagagggtttataaggaggcagcatctgagccttcgttttcattcattttaagaatcttttataggtctctgagcaggttggacttccgaataggtatgtttgaaacctttttaagactactatcattcatagttttcatcaggagttagggagtagatggagaggactgaaggagactgggaagcaatactgagtggaatttgaatgatttaggtttatttaggggtttggtcaaacccactgatgtctttgataattagggaatgactctgtaacctgatgaccagtgaggggtgcagtgtgtgaatgctgcttttgtttcttttcagttaaagacagtgggagcagctctggacattctgtgtccctctgggcccatcaaaagcctttatcccttgacatttatccaggtgaaacaggtaggccttcaaaggtaatgcctcgccttttttctacttgcaaaagtgtgctttctgcactgccttgcagtgcccattctgaattcaggggccaaaatggtaagcaaatgcatcagatcccaggtaaatgaaccatgaatttccaggctctctttagcttgaagtgctgcgtggtgggctgatcatgcctatattttttgccccacttcttctcactcatacaggaggtagcccaacctgcttcaacataattctgtacaagttataaattgagttcactgaccaatctaattaatctttattactaggcatcagtggaagatcactgttttaatactcaaaacagacagtttaattatttgttcttagttcaatggcataaggactgtgttttttggtagactaggttctttgagattctttttcctgcttttgaagagaacagagcacatctttttttttttttttttc

SEQ ID NO: 105159 - DNA, 1022 bp, Homo sapiens
cataacaatatggagaagtattctctcttgtaaccacagtaaatttaacattgatacagaactttagcaataagattaatatttttcctatgataggctgtctcccttcagagtctgtcacgtacctgtttccttttttcctcccactcccctagccttctgctgtttaccctcattctctctacttgtttttgctcttttgttttgaggtctttcggtttataattatttggatattcctgaagcttaaaacacagacatacacttagaggtaaaaaatttaccagatcctgctttggaagaagtctctagttcctttgattttccaaaaaagcagtggcactgttgagtctttgaccttgctttcaaataataaattttatgaatatgtttctgaaggtttaccaactttttttcttttctctctttttctactctggtttatagtttgaaaaagtaccagaaggtcctatccctccatctacaccaaagtttgcatatggaaaggtcactttggaaaaggtaagaaaaaaaaataacagaaactttgaaagtgagagatgggagtgagaaagtggaatttagtagcagtgagtgaaagtgctgtgctggaggaattggttcgttatttttctgcgaatttgttttctgcaagcctaatggggtaaatgatgtttctgggaaaatggggagagagaggtgagaagatactcatgcctgttgacaggatgagcagatgagacatgggtgggagtagtaggcattcttggatcatttgggtcatcttggttcctttatcagtggtttaaacagtgtcaagtgcctttgtggaaataacatgccacctcattgttatggctgccaaggctctttgtcgtatttaccttttttaggagttccccaaaatcacaggcattttgatagacctctgccctaaattatatacttacctccatctcaaagtcatgtcctaatttttatggtctgtggtttatacgttaaatggggacactgggggaaaa

SEQ ID NO: 105160 - DNA, 1053 bp, Homo sapiens
taagaaatgggggaaatggtatgactagatcagttcagttggttgagtggtccagatctttcaaagtttagattctgtgcagagaactaatgaaaaagtctttggagctgacctgcttgatctgatcctcagccttgctcatctgtcacctccacaaccagtaggtcacccaaggtggctccatcattggtgagctgcatccaaggaatttattactaatcctaggtaaactatcatgttttgtgcctcattgatgtacaaattaggttggacaaaagactattcctaaaataacttcattctcacacacttgcattgcaatatgctctctgaagtagaggaggaaggcacaaagccttgctggtctatggatggcagcatcagcgtcacctggacacctgttagaaatgcagtttcaggccccactccagacctgctgaattagaatctctgggatggggcttaggaatctgttttaacaagctctccatgtgacacttaagcatgggtaagtttttgaagtaccacccaatgttgcagacaacctcatacctgtgaacatcatccctgacaaggtcgggatcctctggtctagaccccgccccttgcacagtgactgcaggggcatttgtttttctagtccttttgtatactcagtgttggcattatccattggtctttgttgtaggtcaagttcccagggaaacagactctgagattacctggtagaaagcttattgattgtgctctctggagcaatgcctgtaggatagagagggagaagtggggctatgatgcagcttcacaagtggcctcatccaatcttagagggagctctgcagctgggttggctgttcgaggcacattggtcagttgttggatgtgggctatccctgagggttgtaaccttgggtgaggcagctcagcacaggccagcacccagagacggacacatctgagaaatgtcagcagacaacagccctagctgctgggagaatgagtgagtgccctggttctaaagggggatccaagaggtgcaccacagccccatcg

SEQ ID NO: 105161 - DNA, 1047 bp, Homo sapiens
agctaatgtttgtatttttagttgagatggggtttcaccatgttggccaggagggtctcaatctctagaccttgtgatccgcccacctcggcctcccaaagtactgagattacaggcatgagccactgcgcccggcctggagctgttattctataaaaatattttgctacccagtttctttgcccaacaagactttcctactgtgtttaaacaggggatcagctatctaaattttaatataggcaccacttttcaggaatacttgcattgtataagatgagatctactttaggttagaacctgaggactgaacataggcattgctggtattggaagtgctcactggggggcgtctctgggttaagcagtgcatgtcagcatgtcaaccccctttacacctgtcatagatggggcattgcagggaagccctggcattggaaggtcataagtctatcctaagggctacgttctttttttgttttagatcaattctgaattctatactggctggctagatcactggggccaacctcactccacaatcaagaccgaagcagtggcttcctccctctatgatatacttgcccgtggggcgagtgtgaacttgtgagtgttcattgcctgaggggagggtgccctcagtagccatgggctcacagtgaagtaccgtgttcttttgtttccttgtaggtacatgtttataggtgggaccaattttgcctattggaatggtaagagcactttaatatctgtagaaacttatgctagaatgtttctgttgattaatttgaggaggggtgtgcccacagacaattttattttcctttttttgtttatcctctcctaaattttctttttttttctttttcttttttttttttttttgtagacagtctcactctgtcacccaggctggagtgcagtggtacaatctcaactcactgcagcctccacctcccaggttcaagggatcctcctgcctcagcctccaagtagctgggattatgggattacaggcatgcaccaccatgcctggctaagtttttg

SEQ ID NO: 105162 - DNA, 1053 bp, Homo sapiens
gcaatggaattaatggatacttttcctgttttcttttcatttttctagcatttctaccatgggaaggtattatttatgtgatgtttaaagtatctactttctattctagggaagaataccactacaatctgaacaccagtttggtgttttttgtttttcttatttctcagtggtgggagagggttaataggaggtaaacttttatggtgaattgttggtgttttttcttttagtcagttttgaggtctgagtgaaggaaatttttccagcagtcattaagccttgtcatcttagcagatgctcagatattttcccacacaaaagcttgcattagggtggctacattaggatctcctcatttttccctgctcttttttcactcacaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggttggtgtttgtagtaacagaaattgcagcttaaaatcagctttttactcagtcagttgctctgggcagctgttgttataagtgtcatgggcagattgagatttttcatgttttcatttttcaaggaacaggtagaatagaatacttgcacccctcagtaacagagggttatctgtaggccaagagcttccagggtagctgcattttcagcactggtggagctagcctggaaaatggagtactgctatctcaggggctaggctggcccacccaagatgaagaagcaggtaggcatctccagctgtgagaagctctaccttgaggcagtcaccttttaggctgtgtctggggcgcgcttctctgctctttctgccctccctgtcctcccaccttggcaggacactcggggttatgccttggctgtagccaaccttgaggtcagccactggctgggaacttaccttatgctttgttgtctttctgcat

SEQ ID NO: 105163 - DNA, 1058 bp, Homo sapiens
tactggttaagctaataggaaccacattttcctacatgaagatatcaagtctgaaacttgggtgcgtctttgctctgcatggctgtgtcttcttcctttcttctggcctcaggtgcaaaccctcttttgatgccctctttttttcagtctctgcctctccttgaatcactttcaatttctgctcacaacttttctgccccttttggttttggaaatgccacaaaaagtataatcaagtattaattctgcaaaggagaatgaagttgactgtgtggagatatttcttcttgtgtccatccctagcaacctcagatgactttaacttgaccctgggtcctgccaggtgactctgtccccctcctcctcctcctctccccttcccatctccacatgcttgaatcccactaatcatttttgccccttgtttacaaaataaacaagtatagacataagaaagcagaaaaaacataattgttactcaaacctcaggagccatagcaaagctcttcacattttgggagtttccttgaatattttttatgccttttttttctgctttcttacagagtaagttcattctgtgtgacctattttctgtgtggctttttttgcttcattctttgtcatgagcactttttcatatcgttcaaaattctttcatcatctttcatggttgtcctacttaccttctgacgcacagttcctatacgtgttccttctgtctggaagccatcccagttgacatattggcttccgtaggactttcagaaccgtcactgtcgcctccttttgtgaagcacatgtgggagcagtttcatccctgacacactgtgtctctagtctcctggccttccacgcctctgcctggtagccatgagggcacatcatgcatttgtgcacatcacatacccaccgaacggctctggaatggaatagaagctgattgctttgataagaaggaaccgggggatttgtagacagtaattcttttcgttgttgttattgtttttgttttttgagacagagtctctctctgtcaccaggctgagtgcagtgat

SEQ ID NO: 105164 - DNA, 1652 bp, Homo sapiens
tcctgaggcccgggccctacatctgtgcagagtgggaaatggtgagtgtggctagactgggctctacctggtgtgtgtgagctggcaggcagcagctctggggcaaagggaattaaagcagacctgcattccagagagcatggggcctgggactgtacccagcacaggtgtcttttaccttgacaaggtgcccaggcagagaaacaggccagggtcagggcatgggctctcctcttggtggtcactcacatacctcagcttgctcatctgtaagaagcagttaatggtgtcttctctatctacgtcacagggtatttgtgaaattaaattgaaaaatctttatgaaaagggctttggtccttaaaacattgcattcatgcagagtgatcttaattgtcctacattccaatttctaatttctctgcaagttataaaccaaaaagcccagctcaaataccccttgtcccttgaagcttttattcttttccataactactaatagtaatttctatctcctctgagcacccttcacggaacagacattataatggcttgttttccctgaactagggaggattacctgcttggctgctagagaaagagtctattcttctccgctcctccgacccaggtaggttgttacagatgtcttgagaagatttataaaagcttcagcctaggtgcggtggctcacgcctgtaatcctgacactttgggaggctgaggcgggtggattacctgaggttgggagttcgagaccaggctggccaaaatggcaaaacctcgcccctactaaaaatacaaaaaattagctgggcatggtggtgggcgcctgtaatcccagctactcaggaggctgaggcagaaggattgcttgaaccctggaggcggaagttgcagtgaaccgagatcgtatcaatgcactatagcctgggtgacaaagcgtgactctgtctcaaaacaaacaaacaaacaaaaaagcttcaacaatttatatcaaaagggggaggtattttgaaggctggggtacctctgcacaaatacttttgaaagtttagtgaaagtctgagtgtttatcactgaccagtgcatagcaacaaactaaacctctaggaaattaggctttgaactacgtaaccagatcttactgataaactggtaattctttgaattggtattgaaccctgtttgcggttgaccaactgacttcagtgctttctcttcctatttacttagcatattccacagccaatgatagcacctcgctaatcaaaatgacaagtcaggcatggtgactcacacttgtaatctcagcactttgggaggccaaagtggagggattgcttgagcccaggagtttgataccagcctaggtaacatagcgagaccctatctctataaaaattagccaggtgtgctggcacatgcctgtagtccgggaggctgaggtgggaggattgcttgagcctgggaggttgagactgcagtgagccatgattgtaccactgcactccatcctgggcaacagagagggactttgtctcaaaaaaagaaataaggtcgggcgtagtggctcatgcctgtaatcccagcactttgggaggccgaggtgggtggatcacctgaggtcaggagttcgagaccagcctgac

SEQ ID NO: 105165 - DNA, 1156 bp, Homo sapiens
atatctaggatggggcgtcaggctctggagttttaatccattgctttttgccctgtattttacacttagaattttgttaatgggtcttggttatcccagtgacattgttgttgaggtgcatccagtgctcaggcaggtcacagcaacaatggcgtgtgtgcgtgcatgcgtgtgtgtgtgtgatgttccccagccccatgaacagcacagtggaatatcatctcagccactgattgtcagctcagtgctggcctctagaagctaagccttatggaatcctgcatgtggatcctcttagatgatttctcttacctgagtacccctggtggacctggcttagcaatggtttgtatgatagctcagaaaacaagcattaagtccatcagcacattatacaaattcaataggcagagagtcacttgctactctcaaaggatcggcttctgaaatgcagaaggtggaagttctcatgtgaccccatccttgctctgtagaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtaagtaggagggcatgtggctctcacctaggcctgaacacccactctggagagaagatacaactgtatttctcagggtggctattttattgctcagaaatgggaaatggtccagtgtgatgttctgggaggggcttgtcatgagccggactggccctttttcaaataattaactacttcttccaatcttcaattttaatcatcagaaatcattaaataaatagcttaaaaaggaaaaggatgggggaagcaaacagaagtaacaatgattgagcacttaccagatacagggcactttatactaatgattccatttcctcgagataggtattattgttcctgtttatagctggtgaaactgaaatttgcccaaggccatatctttggtcagaggttcagctagtatttgaagggaagggaaggcatgcaggcagctgtagcacaggtatggctgtagtcatacaaaaagctaggttaacaggagaaaagcat

SEQ ID NO: 105166 - DNA, 1006 bp, Homo sapiens
cagctctacccttttccgaattctgccagtagttgcttggcctcctttctacctgtctaatgaatgttcccacctcatgggccacctttgaacttaggaaacttgtgaggaacacttatttgacacttagccatgtatatactatgagaatgttttcaagagcatccattgagacacctggtgtaagaaataatttttctatttttgtgagtttaggggacttttcctttgaacagaaattaaaaccttatttactagaagaataaagtgatgttaaattgacacttgcccttttaaaaatgattcttagttgtttgtgtttatttagctttattgagatgtaattcacttacagtgaagctctccatttgcccctatgaattcttctctgagttgtttaacttccgctcgccagttggatttcaggcatgtgtgatctaggactcatgctgccacagttgcttccaaatacagcttcaagggcaacccccaaagccaccatggactatgatgctactgtgactagagctagtattgtgacctttgaaagcctaaagatgcacaaggaatctgacccataatggaaagcactagttagttggcttcttaaaaccctggttctcttggctcctgtggcctgttgctgccttatccaccagagggcagtgttccactcggcttaacagtcgaacccccacccccaccacccgttgaggtcttgcctttcaaaatcctaacattttagctcctgaagtgaccccaaaacagtgtttcttaaaatcgtgcttggtagaaataaatcttacattgcaaccaaatatacatgcgtacatatacaactccacatatgtatatataacaaaagttttataaagtaatactttactatgtgtaatattctttctttctttctttcttccttccttccttccttccttccttccttccttccttccttccttccttccttccttccttccttctttctcgttctttcttttgacgg

SEQ ID NO: 105167 - DNA, 2467 bp, Homo sapiens
tcgctcttgctcattggctccctctacatttggcgcagcacagtgagcaacctctgccactccccagctgcagagtcaacctgttttcagctttggaaggtggtggttctggcatttctggccctggcccattccagtttctttaccatgttctttttagtggccgaagagccctatctcttttccttggcggcctactcctgcctgggtgcttacatcatcatgctcttcttcctcttcatcctcagcggcatggagcaggcctaccagctcttggcctggcgcagtggtagggtcgtgggcagccttgagaagacaaggaagctcgtgctcaggcctgccctggcagtgggagtgactgctgtgctcagcgtggccgggattctgaatgccgcgcagcccccggctgtgaaaactgtggaggtgcccatccatcagctgcctgcctcaatgaacaacctcaagatcgtgctcctctcagacattcacttgggccccacagtgggcaggaccaagatggaaatgtttgtgaggatggtgaatgtgctggaaccagacatcacggtgattgtgggtgacctctccgactcagaagcctcggtcctgcggacggctgtcgctcctctgggccagcttcattcacatctcggtgcctacttcgtcacaggcaatcatgagtactacacgtcagatgtcagcaactggtttgcacttctggaatccctgcatgtccagcctcttcataatgagaacgtgaagatttccgccacacgggcccaacgtggtggtggtggcagtggcagtgggagtgaggatgaggactggatctgcttggctggggtggacgatattgaagcagacatcctgcactactctggccatggcatggatcttgacaaggccctggagggctgcagcccagaccacacaatcatcttgctagctcaccagcccctggctgccaagagagctctccaggctcggccagatattaacctgatcctttctgggcacacacatgctgggcagatcttccccttgaacgtagcagcctatctcctgaatcccttctttgctggtctctaccaggtggcccaggctacattcgtgtatgtcagcccaggcacagcctactacgggatacccatgaggctgggtagcagggccgagatcacagagctcatcctgcagcggtctccctgaactggccctgccctgtgcacctctgccctgcccttgtcctcgaccctccatcctgcttcagagtggtttgcctgcttttcccctccagccttgcccactcatccttgcctacacacccttggtcacaagcctgactcaaacagtgacttatggtgggcctgcctggcatgttcaggctggtttaactatttccttggccagttgctttttttgatgcacttgtgagatcactaaggtcacatatattagcactcccctctattttccagatgatgtggaatggggaccttctcctgcagagctcccagggatgaacctcccctcggggttgctagaaaggcatacctctagaaggtggggcggggaggagcaggagcatttttctcctggtgttttaaaattgtctttaggacttaagtggtttccagaatcattgatccagagcctttctggggaaggggtagtgttgccaggtaatttgggagaacaggcaagatggaagggccctctggctgctagagaagaatattttcttttcctctgattctatcaggatcacctctattgagggcatcagcaaaatctactggaatgcaaagctcctcctgttccaggccttgagggatgctatttaactgtctgtgctcctgggcctttgggggcaaggtcaggggagaagaacggtgggcgccatggtcggtgatggtgagaacatggctgcttaggaattcagagggctttgcctcccttgtctcattttatacaacccttcggggagctcactggggacaggctgcttttccctatttggagataaggaaaccaaggcaaagagagatagggcacaggcagtatgacaagatatgtaggagatttggggctagaaaccaggtcttgtacctcccagtaaaagcggtgcttttgcccttttgccagaagcaatagatcctttgatcctgagatggagataagcacccgtgttagaaaaggcctcactgagaagacagggctgggctggtttcctgctgggtgatttaggcttgtgatggaaagtcttcctccaatggggagtgaagacactcgctctgactggagaggctaaccctgctgctcactcatagggcagcgttgggtgggtgactttccctcactcagccttggtttccatcaaccctaaaatggggataattatcgtatctacctcaagattgttttgtcaggagggatccatcaagccttgtgcatgagttccacatggcacagc

SEQ ID NO: 105168 - DNA, 2325 bp, Homo sapiens
ttggggcgccctcgctttcccagttggtgctctgcggagcgctccggaaggagaaaaatggggtcaggagaggcccttgcagtgggaacattgggttatttcccctctgggtgctctccctcttcgtgcatcttgttcctttctcaccactccccgtcgcctgccctttggcttgggtttttctttgtatttgtgggaccgttttccttcggcgtttgggggtccaggttgagggggggaataggcaggctgccgggggatgccatcgttgatcggggcagggctggcgaggcgaataggtgaggtgcggggcgtgcacagttggtgggagaggaaggacagcttcactcgctgcgtccgagctgaggcgactggctgaggggctccaaagcgctgcctggggaggtttgcatcacacctgcggaaaggagagtgggtagttgcaagctgctcctctgcacgttccgcggaccaactttggttcctccagggtgtaggtgggctgagcctgcagtatgctttaagtaagagctggtagcatttgacaccgttgacttgtaagttacaccctttaataacgctttcaataacgtgcctagggcagagaaaagtggtacatttatctacaaccaagattgaacatcttaagtatttggaaaacagctgctgaaaatgttttcattttgggaaaaagtcagcacagattatttgctgctccctcttcaccccgtctgtggttcccctaccccagtatgtagacagagttttcttgtccagaaggcccgtaggaccttaggagtcagagctagccagctgtgagaaccactggggaaggtggaactggggcacagttcaggagaacagtggcagggtaaggggctaggggaaaggcagatcttaaccagtatctgggagtgggggtagggagagagagaaggatttatgaaccaggaacaggtggacagggtcaatctgtctgatgtgagctcatcagtcttgtgcagcgtcattgggtcagggtggatgccctgtggctgccatacctgaggcccacacagggaggctggcatcaccccaggaattctcatttcaggtgcctaggtgtccctcttgggcttctgtgcccacagctaaagaaagataccagcagtctagctttccattatctccttgtttacatttctttagggttcacgccattctcctgcctcagcctcccgagtagctgggactacaggcgcccgccatcacacccgactaatttttttctttttttgtatttttagtagagacggggtttcaccatgttagccaggatggtctcgatctcctgacctcgtgacccagcggttctcaaattttaactaaattttagctgtcctagaaattaagagaatattcctttttttttttttttttttttttttgagacagagtctcgctcttttgcccaggctggagtgcagtggcacgatcttggctcactacaacttccacctcccaggttcaagtgattctcctgcctcagcctcccgagtagctgggattacatgcatccaccaccatgcctggctaatttttgaatttttagtagagacagggttttaccatgttggccaggctggtcttgaactcctgacctcaggtaatctgcctgcctcggcctcccaaagtgctggaattataggcgtcagccactgtgcccagccctagagaatattttaaactatttgttaagaaatactacatcattacacgttaataaacaatatatatatttgaaaaacaatagtatttctccccaaattttagggtgaagagttgcactgttttacatttctgcaaatctctttcaatgtctcttaatagaagacagtcaaattttcatgtttatttctgcattaaatctgttgccatatcacatgtcacatagcctctggaagactccaccccctcaggacagagtgagaatggaaaaggcagtaatggcttggaattataataaaaatagttttgactaattggacccctgaagggctctctccagaccacactttgaataccgctgatttggaatgtttttataaaacaagtacatgcttactgtagagaaactttaaacgtatagaacatgtggtaagaaaatgaaaactgcccatcatgtcacaatgctgtgagtttctttttgaataataaagtatagctagcaactgactggtatttgagtagcttggattcaaggtgggttgggcagatgtaagtggcctttgagttttgaatgggtacaaggacactctaatatcccacaaagctgatgctggttcc

SEQ ID NO: 105169 - DNA, 1039 bp, Homo sapiens
cacacaaatcgtcagacctccaccccagactttctgaatcagaaactctgggggcacagcccaggaatcttcgttttcacaaacctccaaacgaatataaagatcgtagattatatagaccgtagggccgatgtatataatctattagggccgcgtcggccttgcaggcgggtctccaagtgaatgagcggcagagtcccatcatgcgcatcagcctgcgtgaaccagtgcgcagcgcgcctttcccgggcaccctctaggtgctggcagctggcgcccagatcccccggctgggtggggaggggcggccggacggggcgggccggaggctggcgtccccgccccgaaagcactgggcccgccgcgtcgcaccgtcctctttcctttccttctccctccccttttcccttccttcgtcccttccttccttcctttcgccgggcgcgatggagccggggcgccggggggccgcggcgctgctagcgctgctgtgcgtggcctgcgcgctgcgcgccgggcgcgcccaatacgaacgctacagcttccgcagcttcccacgggacgagctgatgccgctcgagtcggcctaccggcacgcgctggacaagtacagcggcgagcactgggccgagagcgtgggctacctggagatcagcctgcggctgcaccgcttgctgcgcgacagcgaggccttctgccaccgcaactgcagcgccgcgccgcagcccgagcccgccgccggcctcgccagctatcccgagctgcgcctcttcgggggcctgctgcgccgcgcgcactgcctcaagcgctgcaagcagggcctgccagccttccgccagtcccagcccagccgcgaggtgctggcggacttccagcgccgcgagccctacaagttcctgcagttcgcttacttcaaggcaagtccgcctcgccccgtcccaggccccggccccgcccctgacccagcctccaggccctagccccgcccctgcgcccggggccgcgttgcccctccagttctagacctggctccctccca

SEQ ID NO: 105170 - DNA, 1110 bp, Homo sapiens
ttatcaattttaagtgtataatgcagtaagttttgacaaatacatccagtcctgtaactgccatcatagttacgacatagaatattttcatcacccctgaacaatttcctcttgtccttttgtagtcaagtttttgctgtaacccctgacttctggcagccactgatctgatctctgtcatagttttcccattttccttaattcagattattatcaagggcctgctactttttgaattgaactaaataagaaatgtacccatcataagcaaagtagaaaaatctagatataaagtaactcactgattgacttcttcaagggccagtgtggcttcttcagagctaatgagagctagcttggtggtggtcttggttccctttgagatttcatgactgtctcccttcacgcccaagagcgagcttcactggcttctccatgcctttcagagcctgttcatccgagcagtgcgggcatacaacggtgagaactggagaacatccatcacagacatggagctggcccttcccgacttcttcaaagccttttacgagtgtctcgcagcctgcgagggttccagggagatcaaggacttcaaggatttctacctttccatagcaggttggtggtaggtcaataggctcactactcccatggaatagtcttccttagatgtctggtttctgcctgcatgcctgctagatgcctggagcagcctctgaggaatttttgagcatacttattaacgggtaactgagggtagtcaccacctgcatagataaacctttgacttggcaggggcttctagtgaaatcactgagagaaggttcaagcacaggcctgccaaggtagaattctgtgtctgccctacttgcttacagatttcctacagtcattttgaaaaataaaaatgggcccaggagcacctcagtgactcacattactgagataactttgatgatggcaattttccaacacatataaaggtagaatgaacctttaagtggccatcactaaggtagctttttgaaattttcttttctgattataaaacaatgtgtgctcattataggaagtttggaaaacacagaaaggaaaaatgaagaaaggaag

SEQ ID NO: 105171 - DNA, 1016 bp, Homo sapiens
cctggtagtctcttttgcggatggaccatcatttaattcccttgataggcaaactcaccacttagcatgtgttgtcagtgaaccccattcattatatattactttcaaaagattttttctaattgatctttgctcttgtattttcattgggatttctatatgccatcttgattttcataagtttgtcttccactgagggctggccactcttttttaaaaattgagatataatttatataggatagaattcacctttttaaagtgtacaattcagtggttgttagtatattcagagttgtacagccattaccactatctaattttaaacattttcatcaccttagaaaaaaccccatatcctgttcctccctcctcccagttctaagatgaaaaggttggtcctataaactgttctctgttgtgtctgaacaggaagcagttcagttctttaatgtgaccacactccagaaggagctgtatgactttgctaaggaaaatataatggatgatgatgaggtaagttttcatgcttagcacatgtctggtggctacgagaaaatattactcacatctttgctagaatcactggaaggctgagtcctccctgaagtaagaaacagaggggaccttgagaaagacagttcctgtgggtgtttcagtgacagtcagaatgctggcatgggaaagagcggctttctaggaaacctaggcaggagtgccacatttcctgatagcgaaacgggtgtggggccacactccaggaattcacagtggtcattcttcatcttttcactttatataaaaacagtgaatttttaattgctcagcactctgaagagacatggatactcacaccccaatttttctgctagactattgctattattattttttctaaattgcatctttactgtaagcattttgtcattctctagaattgcttgaaattcctgattccaccttactcagctgaccccttttctgaccctgactcaactggttatggagtggtcatt

SEQ ID NO: 105172 - DNA, 1647 bp, Homo sapiens
agcagtatgtatgcaagcactcaatcattcatccttcaacacatgtattgagcaccttctgtgtgctggactctggggaagaaaaatcaacccagtcccctggtccttgagaagtttgggttctggtggtcaaggcagaaagggaacagatagaaaatgttcctgtgggagacctgcacacatgagaggggaggaaggggagtaggcagagatgcacacaggagggccacttagtagagctgttcacaggctgggctgtccgcctcacacagcatgttggcggatctcgcagagcacttgataccaagttcaaatggagtggaagccgaggtcccctccacagggagaaatcaggtcctctgggccccagaccagcagaaaaaacctgtttcagccaaagcagacagtggtgatggcctctcgggatactgtttctgctcatcagtacttttaaaagtccaatagcccatttaataaagttgtcctgttgtctcttacagggagaagttgtggaatatgtggatgacctcttggaactggaggagaccagctagcccacagcaaccaaagagacttcctcttggcgttcaggaaacacagattctttgtccttttcccaacagcccaggctgttgatacctcagagccttctctttactctccaaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgtcttccccatgttcatagctgcctttcttaccattttggtttgaagggcagtcttctctggcttgtttttttgtttttcccagaaaatcagtattattttttaaataagaaaaacattcctagaagatgataattgtgaaaacctcctttggcttatttgcttttccagattttagtctcctttctccccatccgggaaagatggtggaagacataggctaaatttctccagcctcacaatggtcttcacttggtctgacttgtaccaattctagcacccactgaaaaacaagttgagtagagagtgtagagtgcagaaatgtggcttttgccccactttgcatctccaaaattacaacggttggccgatcccatttgaggacaatgcttagttataagtctccgagttggaaaaggaagaaagccagagctgtctagtttcattcattctttcagtaaatatttattgagtacctactgtgtgctaggcattgacctgggaacta

SEQ ID NO: 105173 - DNA, 1046 bp, Homo sapiens
ggcgcacgctgggcagtggcctgggcaaccccaaacgcagccagagccctcacccgagtccgctggcccgcgcactcccggaccatgactgccgagggacccagcccgcctgcccgttggcacagacgcctccccgggctctgggcggcggcgctgctcctgctcggtctgccgcgcctttcggtgcgggcggatggtgagtgtgcgggaggcggcggggcggggggtggagcgtggggtccgggcagggagggcgtagctcgccggggctgctccctctgaccggcccggcaagcggcaagcgcaagcctgagaggaacgaacgagccgcggtcctgcgacccagcatccctctcctggcccaccaagtctccgcgtgcccgtgcgcccaaacgcccgcctggtgcctggaccctcccttagcgccgagcgcgtaggtcccgcagtcccgccgctggctttcctaaggtctccaagaaagctcgaatgaaatcacctctaaggtgccctagaacctcctctgctaaggggtgattttccgccgtccctcagtttctcaacgtctattaatgtgcccctgaggacaccgccgatggttagaaaactccctcggatattttggcttggtccgggaagacgtgaaagatgagtgggaatcagcgaggctaagagagagagaatggcctggccagagggaaaagcacgtgcaaaggctgtctctgagtgacaggaaaaacgggacaaatgataaagcaaagtacctggaggcgaggggacgtcttgagacatgaggtagagaagtgggcaagggccagattatggcaggttctctgagaattgatccacttcttgttcgtttgcttggtttttcagcctgaatttagcttgtaatacttgccctaaaatgagcaggattggagctctgtatccattcccttttgaaaagctaattcagctgtgttttcatattagaacaaaatcccgctgacttggtacaggagcatctgaaggaagcaagcttaaagccagcagttctcacacccatg

SEQ ID NO: 105174 - DNA, 1039 bp, Homo sapiens
tccatcgtgtaccattttggtagaccatggaaagcatttgtatttttttctttttcttttttctttttttttggacacagagtcttgctctgtcacccaggctggagtgcagtggcgcgatctccactcactgcaacctctgcctcccgtgttcaagtgattcttctgcctcagcctcccaagtagctgagactacaggcgcccgtcaccacacctggctaatttttgtgtttctagtagagatggggtttcaccatgtcagccaggctggtctcgaatttctgacctcaggtggtcctcccacctcggcctcccaaagtgctgggattacaggcgtgagccaccttgcccggcctgtatttttttttaagtgctatgagaagccactgaaaatgctgctattgtgtaggatgcaggagggaagacatggggtcatagtccacttgtgctgctataacaaaataccacaggactgtgtaatttataaacaaaagaaatttatttttcatagttctggaggctgggaagtctaagatcaatgggctggccgatttggtgtctggtgagggctgctctgcttccaagatggtgtcttgttgctgcatcctctggaggattgctgtgtcctcacctggcagaagggatgaaaaggcaaaaaggggctgaattcactccctcaggctctcttataagggcattaatcccattcatgaggacagagctctcacggcctactcccctccttgaggtcctcttcctaaaactgtcacattttatatgttttcatataaagtttgaaggggacacaaacattcaaatcatagcacatatggagatgaatttgggtgagacaatagtggttgtgaggtggagatgttgtagagtggatagattgagaatttaaggtggagtcaagaatatgtgataatggactggaagtgaggtgtgaggaaacagcggaatcagggacaattcctaggtttttgtcttaacaatcaaggggatagtagggactttcgctttgagaagactggggagt

SEQ ID NO: 105175 - DNA, 1037 bp, Homo sapiens
taacatcaggaaggtctgcatttggaaaatggttttgcttggatgtgtctgccataaaatcatagcaataaaaccctctgacttaattttttttaaagcattgcaatggtttattcaattttatgagtctaaaaggtaccaacacttactgatctgagttttaagtgtgtaaaacttttgagtagctatggtgtaacctgatttttaagatttcaaaataagcttgaaaaaaaatcacatccattttacatgcatccattcattacttctaattgattatactacagataacttaagccttagttctttctctttaaggttccccccagttttacgagaggcatggacataattagcttttttcctttagtaaaaatgtgttatgtgctgtagcatacaccagagcttctactttccaatcaggcaacacagactccgagctgcttttgtttttggtccctggaggtgtatatgacaagttgacagaaacaaaaaggtgaagaccctgctccacccagtatagagtcctcttttctttggtgtctcatggaaacctattaacatgccttccacataagtctctatatataaaactatcaggcattatgaattaatttgcagtacagtcactttgataaagttgctatttatcttcaaagtggaaaagtcctgctaatcaaaatggaattgtgaattaaagtaggccactggcttaagtatcaggtagaaaatcaacagcttattttttctgctcagtttgtgctaacactgatggtctttttgaggaatgctgagtatgccaagggtagaactttcgtacctaggtaggtaccaatctcttaagagatccaggtttctggcatggtcctagctgcattgagaccacttgtcatgtgttaactgacacaaggctttgatttgattgtttcacagcagaataaaggtgaaaactatcaccagagtaactgcaatccatacagaagtcttttacctgtaaatgcctttcccaatggagaatcaacagattgggtgatggt

SEQ ID NO: 105176 - DNA, 1057 bp, Homo sapiens
gcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgctttaaaaaaaattaagtcagagggttttattgctatgattttatggcagacacatccaagcaaaaccattttccaaatgcagaccttcctgatgttatctgaaatctgataaaatgaccctactctctgctgtggttcattcttgctccatgc

SEQ ID NO: 105177 - DNA, 1585 bp, Homo sapiens
cggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggca

SEQ ID NO: 105178 - DNA, 1037 bp, Homo sapiens
catgaaactatattcattgaataaaaatatgaagaaaaattcaaacctcaaatctttttgtccagggatttctgttaatgtttattaaattatatttgtggatataaataatgtattcttacgttttagattggtagttcaagatttcaaggtagtaagatgggggaaagaaatagtttattcccatttaaaatgtttttttacttttttggtactttgaaaggtgtgaccttcgtacagatcctacagatcaggcagaaaacagatcaaagattactgttaaaatgcttttctttttttttttttaatttcagtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcaggtaaatcaaatcatttgtttttccttttcagactggtatttacttttatacatgtaattgtagaactgtagaaaaattctgtgacctcttttgaaaatacttatgagaatcattttcagagagttgggaatcactttggaagaacttataaccaagagtttcaggcatcctagtgataatatggaatacaagccaaggaaaactggcttagcctccccccagccctttaggatgcagccaatcactggggcactctagggatagtggcaggctttggccctttttatgaggtgagtcactggatgtgttttccttttgtctattatttgatgactaatttaaaaaaacatgtaagatatataatttttcccctagtgattggtggcaagtaataatagaagagcactttatgcaatttttgttcgagtcatcatccactggagccggcagggaatgtgcccctgtgggtcacatgggtgactgaccaggtctctcagggaccattatggacaggcatagtgaacacaaggcagtgcagcacgtgtgcatctttgctgcctcacactgccttcatgaatta

SEQ ID NO: 105179 - DNA, 3699 bp, Homo sapiens
aagtggctatttatcatatggaagtcaagccttcatcccaaagttcatcttaattcccccaataaactgtatcctgggtgttagagaataaaacaaaagattatggatacattcagacattaaaaagtagagagaatatgatgaactcccatgcagccatctcctaccttcaaaaactaccagcatttggtcagtcttgctctccactatttcctctcctgccttctgttgtatttcaaagcaaatcctagatgccatatcatttatgcttgaaatactgaatagtagttcatggtgtgtatgtactcaggtatggcttttttatacttatatgtaagtttttttttcttgtatggtaagcgaagggagtgttcagatagaatttttaaaagtgtcaaacactgcttctctaggtggtgctataggaaacctgtatagagagacatttacacttgtaaatgacatcgtaagtaggatgtgcttgggggaaatcttagggtataatgtgtgattctctgccattcttctgttaaaattagctgctgtgacagagttgtttatgttataaaatttaacatgtttgactttacattgcacgtttcagaataaagaggcccagtcctagttcggctaccaactcttacagactttaggcaagtcccacaaactctggacttccatttccttttttttaaaattaaagattgactggcccgggtgatctcagggtttgtttctgtggggtgggttagaatcatgtttcttcacatagccacaacccagtcactaaataaggtagatgagtgaaatcctatatcgggaagagttctttaggccctgctctcattgatttgattcatcagcctcaggacttctaagctccttcttgatacaggacatggaaaagccagcattttccttggctctgaaggacaggtgtctgtttgtcttcttatattgttcatgtgtatgtgtgtattcaggatatctgattattttgaaggacattggactgcatgaagacagatgcctgtaaagcagttctgttctttttccatttatttgagaaaaatatttttgctcttctctaggtgccgacttattaaaactgacaaaggaggatttagttcaaatttgtggtgcagccgatggaattcggctctataattcactgaagtcaaggtaaaatactgtgaactgttttgcttgaaataagaatgtacctttcttcgcgtggggaatttgggcagaatgtgtttccacgctaggttggcgtgtgtgcctgtgtgcgccatcgagcattggcagcattgtgctcacaagaagactgttttgtgtacaccttcagggcaggcccagatatgatgcaggcactgatgagggcagaggtagactgtaagactggtagaaatgcacatgggcagtactgatttcttgaagacgactgggtttgttgccaagaaaacaaaacttctaatttaggtgagctatacagaatctatggttttcaaggtcatgactattactaaacagttattaaaaatgtaaactaattgtgaattaaaatgacagaaactgtaaattgtgctggcttgtaagaaccatttactatcattgctctttctatacttgtggtgtgagaattccattaaaattgaatcttactgatttttaatttgctgacttaatcttgaaacttaaatttaccagcatctgacagaccatctcaatggtttagagtctggatcatcatattagaccacctgtgatagttggtgtgaggtgtgtggtttttatatttttattagtaaattactttgtataacgaaataacattataaagttctcataaggaaatagaacttagattcctgtagttgtcatatttgtacatgtgtaaggcagctttctctcccaggctcatcagtggcatcttctgattgcaggtcggttagaccccgtttaaccatctatgtctgccgggagcagccaagcagcacagtgctgcaagggcagcagcaagctgcaagcagtgcaagcgagaatggcagtggggcaccctatggtaggtattgagggcatctcaattctgtcacttctgagactgtcagacagaaacggaaaggactcgattgagcaggctttggagaactcttgctgtgttaggaatgccaagttgctcatgtgggagccttgacagcaatgagaggtggcagctctagggtgaagtccttgggagaagaggaaactggcattctttctcagtcattgcagccacactatgggtctgtttttcatgtggcccttcatgccggaaatatctaacaagtggaaaaactagcttgaatgcattgagttctggcttttttttttttttggtcagatttactgaaatgatgaatataacactggcagcttaacaaaaaagcaggagggtttttctttcctttttctttttttttttttttttttttttcaattttcctgactaggtatggggagaactcttaaagcataacatatgtgcaacagtgcctgcatgtaatagtcctaagtgtgtggacttgtcactgacaagtgttcggccagcattgtgcaccttgtgtggcgcgtctggtgccgtgtttttatgtcactgtaaataatactacccagtacgttatcttgggagggcttctcatcctgagcatttaattgtacggtatagtgctggattaggacagagataatcttggcttctccctcttctcacctctaaatatggcccttaaaaaaagcaagcattttaaaaggcatatattttctcatttattgtatggatatatggtaacatttccttctttccatactctgaagtagaacaaaggcaacatgctcagaactttaaaaaaaaaaagatgtgttaatggcattcagagatgcagttatttgccctaagaataggtagagctctgaaaaatgtcttgtggtttgaattttactgaaaaattggaaggatagcatcactactgtgaacttttctatttggtattattttgacttcaaaagctctgaattttgagattaagtatacaaattcttaaaggataaaaatttaaaggagatctccatgtatcatcaagagcttatacatcacttagatatggccaagattataatattttggaaggtgtattctcaaacatgagtgtttgtggagggatatggggaaatattggatattttcccataatcagcaaactttttctgtaaaaggtcaggtagtaaatatttccatctctttagatcatacatagggtctctcacattcaactctgtgattgtagtgctaaaatagccatagacaatatgtaaattgtagataaggctgttccagtaaaactttatttaaaaaaaaaaaaaaaaaaaacaagtggagggcaggaattggcccatatgggctgtggtttggtgacacctgctctagatcatttctatattcttactgtaattttagttccagcttcttttatgtaatggaaaattctgggtttctatactcacagaccccttgtttggggaagcaaagttctcagtaatgatattcctgatccatgtctggctttaatcagtaattgagcaggacgtacaagagtgagactcactacagatgtgcactgtgcagatgtctgctgataagttctgtgtagcaaaaatgca

SEQ ID NO: 105180 - DNA, 1694 bp, Homo sapiens
cctttaatccagttcttctcatcctctctcttatccctcacccattcttcccggtctctgttacctatttttccactctctcccttcatgtgttcaaatttttttagttcccacatataagtgagaatataagtctttctgtgcctggcttatttcacttaagacaatgaaatgttcatgttgtccatgttgctgcaaaaggtgatttcattagcagcggcatgatttttctctttttttatggctgaatagcatcccattgtgtatcatgtttaagtttctgacaagggcctgcatcatttgggttgctggagtcagactcatgctctttttgggtgttttttacttcagactccgaggctttctgtgttttgtttaaatgttctaagtctgaatggttccttttatttatgttcattttcattgttaatagcaaattcagccttcagctacgatccaggaaacacagcaatggctgctcaaaaacagattctcttcctacacaagactgttctctaatttttcaggtatgtgtatgtgtgtgtgtatctgtgcatgagaatgttttgtttttgtttctgtgcttttattaactttatatttttaaaattttgaaataactatggataggaagttgcaaagaaaaatgtacagagaagttctttatatctatcccccaataggaatatcttgtatttttattatatgctattgaagccaggcagttgacattggttcagtcagcagttttaccagacttacgtgacctcatttgtgtgtaggtgtatatagttttacatgatttttttcattttaactttattttgaaataatttttgttttacagtaagttacagagctagtacagtgatatttcggtgtactcttcactccgtttctcacataattatagtacaatagcaaaaccaggaaactgacattggcacaacgtatgttatggtatagatatttgtaaccaccaccacaattaagatgacaggattgtgccatcactacaaggatctccctcctgctaccccttcggagtcacacccacacccttcccccaccatccctagtccttggcaaccactttacattctgtctataattttgtcattttgagaatgttatataaatgcaatcatatagtatatagccttttgagattggctttttttcactagcataacggccacctaagttgttgtgtttatcagtagtttaatcctttttactgctaagtagtgtttcatagtctgagtgtactcaattacagtttttatatacttatgggtaagttttttttcttgcacagtaagctaagggaatgttaagaaggaattttaaaaggtatcaagcactgcttctccaggtagtgctataggaaacctgtttagagggacagtaatagataatgacaggtggggcagaggtagcatttcccaaatatatttggctctgggactcttttccaacatgaccacctagtaacatggcctggccaaacatcctgagaagtgctggatcacagtaaagtggtagttagcattccttcacctgcagtgcagtagggccattaaaacacaactttgtgaatccctttaagaggacagaacttgtgtgtgcacacactcagcctgaagaaaagcttgattttgctaagaacatggtttcttactatgccacgtatt

SEQ ID NO: 105181 - DNA, 1891 bp, Homo sapiens
acaatggcacgatctcggctcactgcaacccccgcctcccaggttcaagcgattctcctgcctcagcctcctgagtagctgggattacaggcacacgccactacgcccagctaagtttttgtatttttagtagagacggggtgtcaccatgttagccaggatggtctcaatctcctgacctcatgatccacccacctcagcctcccagagtgctgggattacaggcgtgagccaccgcgcccggcctcattatatttattttattgtttttattttttggtagaaacagggtctcactgtgttgcccaggctggtcttgaactcctgggctcaagctatcctgggctatcctgggctaccgccttggcctcccaaagcactgagattaggggcatgagtcaccgtgtccagcctgggacagtcttaaaccccagggctatagttagatgtgatgcctttcttgtgtaaaatgagagaaggatgattatgaaaggggacccttgaaactgagtcctcagatccattggtttttagaaagaatacctgtaaagtgaaatcacaccatgtgatgtctgtatctcaagtctgaagacttgtatttgagattactctggcatgcttagcatgcttttgactgactttttcaacctcctaattgtaatagtgtatctccgtgtctttgttctgtttctggtcagaattttgcctggagctgaaaaatattaaagttcaccataacccttccagaaaatataaaagaaagaaagaaggaaagatagatagatagatagacagacagacagacagacagacagacagacagacagacagatagattagatagacagaccagacagacagacagatagatagatagatagatagatagagatagatgtagtactgtacacagttgatgtattttgatgctgggcctgtctggtctgtcttgaggattattaacctttagaggtatcagagaagcaaatgggtactggtgaggctgctcattagggaagagggcaaaaggagcactagctaggtcagagccatgtttcaggtcaccatgtgatgtcagatgttgcttataaatcctttcttgtcttcgccattcttaaatcttgataggtgcctgttgggaaactgataaagaggatactggtaaagagggaggagaaagctcttcaaagcaattatacttaagcatatattttaaatgcctttataaatttttgctgctgtcatcactttaggtcttctctaagattaatcagtgtctagacgcacacagcaggtaaaacttttctttgccacacagaagtaaatttgacatgtgtctgtgaggttgcttgataaatgtcagctgtctcgcattttataatcttgcatttggttagtgagtgaattacaaaaatatttcttccacatattttaaaagcatatcactaatttatttctgtttctgtccttagtgttctccgtggcccgatgcccccacagcctatgtgaataacagcccttccccagcgcccactttcacctccccacagcagagcacttgcagtgtcccagacaggtatctagtttgtgtgatcgtgtgcctgcagctaactaatgctcatgtgccttcatttccccatctctccatgtacagcagccttttgtttgtattgtacctaaaggaaacagtaaggggaagtatcctgtatcttggtggcagaggacaatcattgtcttttcttcacctaccagccttttttactccgagccccttgtgccttaacatagtcacaactatggtaattgtagacaaggcgccattttcaagacatagccaagatatattctttgtaagattaaagacaacattaacagtgtctataggtagaga

SEQ ID NO: 105182 - DNA, 1046 bp, Homo sapiens
tgaggtgacagtgtgtgatacccatgattagatttgctagtcagctcacagggtcttgggttcatcaaacagtgtaaactgaggaggtgatactttgtaaggtggaaagaaaaacaagggtctagttttttagttatttatttatttttttgagatgggctttcactgtattgccaaggctgacctcaatctcctcaagcagtcctcctgcctcagacttctgagtagttggaccacaggtgtgtgtgtgccatcacacctggcttaaaaggccctaattttaaaagaatgggcattgttgtgtaaaatgtaatttatagcaaagttgctatgccatgcaataagtttattcaaagctctccagctaaattagatttcttttttgaaagctgactgataatagaagtaataagtctgcaatcatttttcttttttaaggagatacataattgggtagttgagattattttccatgtatccattgcttttgatggatgtcagacaagcgttttaagcccctgtagccattggtgagacttaatttctgccctcagtgtgcttcacagtttcttagctccattacaccagtggtcttgacacttacctactcaaaataatttttaaatttttttagagacagtgtcttgcccagtcacctgggcctggagtgcagtagtgtgatcaaagttcactgcaacctcaaactccttggctcaagtgatccaagacacttgagacaggttctcgctgtgttcctcaggctgatccccaactcctggcctcagaatgatcctcccaccttggcctccgaaagtgctgggattataggcatgagccaccatacctggcctcaaaagaattttgaaaaaggatatacttgcacctttccagattgacatctgaaagttttcatcataaagttttttcatcataaatttaaatagctgcaaaggaggcaatgttctggcgtggtggtgatttgcgtttacaatttaagataaaactgtgacattactcttgaagtgcatcctatggaatctaaatgc

SEQ ID NO: 105183 - DNA, 1024 bp, Homo sapiens
cacctagacctgggccgcccccaatatgcagtcagggggcatctggttgaatatgtgctttgtccagttaagtatagcaaatctttattttatgacatgactcttcatctattagtccacaaacgatgatcctgctttgcaaacttagatcagctacataccttcagtaaatataaacacagaacattaaagaatcatttaaaataattgtcatcatatgtattcgtgactgctgtattcactgttgcagtctttgcactattaaagtaccagaggatttttcattcttacacatatcgcaattgctgtggttaaatgtagactttgaatgttactgtcacaagcactatcacaagaaactcatttccaattatagtatcgaataaaaatgttttaatgcttctctatgcaatgaaactgaaattgtactcatcctagtgccactggaagcacacgttacattttctttaactgggcttttttttttttttttaaataaattcgaatcaaagattgttaaaacagctgtatattctttcctaaaacacccgccccagcaattttgtttttatcctcttctgatttctcagctgaagacccaccaatggttcttagtaaacttctttgggggggattctggcaactcacttttcctctcctgttataaaccatttaactaataaagaagtaggttctggtaattcctaaataaaagaaattcattatagcccagaggtaatctgaagatgggaaaactgttggtaaattcttaatgattcttaagtctaaagtatgcaaaacgtcagcagttcactggcctgggatttcacatcttcctcatgtattgcttactgccctggctgtatttgattttgttcagatgcttttaggggtggttagagctcatcttgaaaacctgtttttaaaaatgcagggtacagattgtcacttaaaaaggaaagtttgcagaatttcatatgtttcttcaaactcctacaaaggaaggccaacatttcatagagtt

SEQ ID NO: 105184 - DNA, 1109 bp, Homo sapiens
gaaaaagaaaagtatcagccgtcctatgataccacaatcctcacagaggtaatgtagtaaagcatttggttttggaagagaagcaaaggttgcatattagtctatttctaagatgagttctgctacaaaagggttggggaagattgggtggcagtttgacatgttattctctgtgaaatttctggggaaaatatttaaatttggggattttgatagactgtttcctgggtgggatcttaaatgaagatgctgaaatcccaatgaggtcttagaaacagaccttaaaaactttgaagttggcaagagacttaagttggagcctagaaagtccaatttttgtcactgctggggttttgcattttttttaactttgaatcctgttagtcatgcatttgtttaattggactgaagagacatgaaacagggtgttagatctttctttgtataatgaaaagacattgatcccaatctttggtgtttgtccagatgaggcttgagcctataattgaagatgcagttgaacatgagcagaaaaagtccagcaagcggactttgccagcagactacggtgattctctggcaaagcgaggcagtgtaagggacttctgcttctcttttcattgtgcaagaaaccttgtgcagtgttagatataggaccaacttccaccgcaaagtaaagccaaaattgtttttgatgtccatgtcttgatttaatttgcttttgtttagacttcctgcttctgtttgttcctcactgaggaaaatttcctaaatctaacactttaaaacaaagcaaaaaacaatgttgaccatattgggtggttttggagggaaaaaaagacactcagagatatgtattccctccctgactccttcccttcctccttccctccctctctccttcacacacacacctccttcaagagcactgaaattaattgaaaatactttctttagtaaattagctattatttttgtgtaactgaaaagggtcttgctttctcatgtgtatacttgataaaattttgtggacagttagatgatggcagcaagcttgacattaacacgtgcagttctttgttacatttttctgcatgtagtataaaaat

SEQ ID NO: 105185 - DNA, 3126 bp, Homo sapiens
gtttctctgtctccatcttttcatttttaataactcctgtgtgcatctggtattttctttataggaatgtaattcttgctcattaattttagtgggaagaaccttaattttgaattgcaataacaaatcattttataaaatcaatacctaagttaccattttatttataattttagtttttgagttataattctttgcaccaaataattgtaccgtaatccaggtatccaagggcaaaagagttcacttacagaatgtttaaaacagaatctagttgtatgtgttctactgctacaggttaacacataagaagtagaaatggtcctgcattttagctggagcagtttaaaagtactcattttccgcacttattccacagagcatcataagggttgtattccatgacagacggctacaatacacagagcatcagcaacttgaaggatggaagtggaatcgcccaggagacagacttcttgatttaggtacaggcagtgatcaaaagaccatggagatgagggtattgtttagctatagccagtaatgtgttgtgttggcatcatgaattacttgtgtggggaaagttttggtgtttgtggattttgtgtcttttttttttttttttgagacagagccttgctctctcgcccaggataagtgcagtggcacagtcttggctcactgcaacctctacctcccgtcttcaagtgattttcctgccttagcctcccaagtagctaggattgcaggtgcgcgccaccatgcccctctaggatcttgtgtcttgagagttgttttctatatatacatacgcacacacatacatatatatgtatgtatgtatatacattattttctttttatttttttcccatcctcgtattataaagaaccgagagagttgttttatagttaaaacgtcaagtagctttttggtgctaaactaatgtgaacctggaattttatgattttgaaaccgtttaattgtaaaccatctatcttttttttttttttttttttgagacggagtttcgctctgttgcccaggctggagtgcagtggcgcgatcttggctcactgcaacctccgcctcctgggttcaagtgattcttgtgcctcagccttttgagtagctgggactacaggcacgcgccactgcgtctggctaatttttgtatttttagtagagacggggtttcaccatgttcgccaggctggtctcaaactcctgacctcgggttatccacctgccttggcctcccaaagtgctgggattacgtgagccaccacgctcagccttatcatattcttaaaaaaaatgaaatacaaaccatggtaggggaaacgatgatattcgtttagggtgggtttcgatgttgaagaagttgatcatggagaccattgaaagacagagttcaaagcagttacagttatttcattagaacataatatagtaagttgtaagttttttaagttatttaaagtggatgtttttatgtaacttctttttaaaacatagatattccaatgtctgtgggaataattgacacaaggacgaatccaagccagttaaatgcggttgaatttctgtgggacccagcaaaacgcacctctgctttcattcaggtttggatttttacattattagaagcttactaacctagttatttaggtcatggtaggattgaatttttgatacagtatcatttcctttaaatgtctatttataaactatgttgtagtgtctttctatatacatagttaggtttaatctagtaagttcaccctattttaaactaacatatatgaagacattctatgatatgtaaagcattattcaaatgttatttttaccactagtagtcccaataatgaaaatgtctatttttcatgagatgtatttctcttgaacacaagctgctatttaaaaggatacgattgaaaaaagattgaggttttaaaattccttctagcattatttttaaaacattctaatactgaaaaattcaaacctctacaaataggataataatgatgactaattgtccatgtaaccatcacctggctttagcagtttttagtagtttccgcccccttttagttattcttggagcacttttttttttttttttttgagatggagtttcattctgtcacccaggctggaatacagtggcatgatctcggctcactgcaatctccgcctcccagattcaagctcttctcatctctcagcctcctgagtagctgggattacaggtgtgcaccacaatgcctggctgatttttgtatttttagtagagatgggggtttcaccatattggccagactggtcttgagctcctgacctcaagtgatctacctgccttgtcctcctaaagtgctgggattacaggtgtgagccactgtgcccagcctgttagagtactttaaagcaagtttcaggcataccatttcatccataaatatcatgtctctaagagatgagttttaaaaagtaactataatatcattattctgtgtttaaaaaaaatagtgattctaatacccacaatgttcaaatttgtatgtggtggaatttaaactaccaggtaggtaatatatagaaaaggaaaaccacttacttgctgaccagccttcataagctatgctttgcatgaactgtaaaaaatcatttgtattttgcattttggtattctaccaatattattctccatcagttaatccctgggggcatggtttatatccgttgaatattgatgtaaactcatactgttggtgtttgtctataaggcaactagttatgtagtaaatcaaagtgatacaagacctggctttacatatcaggttgtgttgtcatattgcagagatcagttttaatagtgagtcattagaagagggggatgtgcagcagtcagaaatgaccaaggtcttgctgttaactctgtgtgaaaccctaaggctgtcatccagggtgggtattaggagacagggcaggagtggtggaagatgagtattgccctctggatcctgaatggactttgaagagttgaccaaagagtttagatggatacagaataggatgggtagtgggttttctggactgtaaaatttccccaggcaaag

SEQ ID NO: 105186 - DNA, 1338 bp, Homo sapiens
gaatatctgtgttttctaataaacactaaaagtggaaacaacccaaatatccatcagctgatgaatggataaacaaaatttggtttagtctttacacagtggaatagtattaggcaataaaaaggaatgaatattatttggcaataaaaaggactgatatatactacatatgggtgaaccttgaaaacattatgctaagtttaaaaagcaaggcacaaatacccacatattgtatgattctgtttatgaaagtatccagagtgggcaaatcgtagaggcagaaagtggattggtgatcgctagcagttggccaggtggggggtgggggagggatgggaagtgactaatagaggtttcttcttaggatgatgcgagtgttctaaaactggtagtggtgatggttgcacaactctgactatactgaaaaccaatgatttacacactttttaaaaatgtgaattttatggtatgtaaactatatctcagaaaagctgttacaaaaattagtcttaggtaatgcaagcataataaaagtttagtgtaagagagtggcagatgaagataaattgacagagaaactcttgtctcctgtaataatgttagaacagaaggttggtgtgattttcagggaagagaaggatcaacctgaatttgcttccgtagcaaattaacaaactatcattgtgtaatgtatgttctgagaaacatgcattttgaattatgttaagcaaagtgatgttctttataaggattgttttttatacacaatttctttaaataggtcagtcatatgaaattcggatgctggataatcggaaaatgggtgatatgcctgagatcaatggaaaattagtaaaggtaaggacagtccattttaattcccaatggatattgctgtgattgaatgagtttttgtttaaaaaaaaattaatttcacttcaataattgttgtattacaactttttaactttatgagctatattttgtttattcacctgtaaaatgggaattatagcagttattgggtagagtaattttgaaagacccttggaaatcaaggagcaatagaaaagttagttgtagttatggggtaaaaaactcatcaccacaacaaaaacctataagcctctctaaaagtaaaagataatatggggaagaatgtcaatgttggcataaaactttaaaaaatcctttaccttgtaaagtttcatttaaaaaatagaaatctctgttcaccctactcatgtatctgaatgaagaagtcagtcatcctaggtataggaggcatagctgttttccagctaacctgttcttttaggatgtatcctcagaaccatc

SEQ ID NO: 105187 - DNA, 1621 bp, Homo sapiens
cctataatcccagcactttgggaggctgaggcgggcggatcacttgaggccaggagtttgagactagtctggcctacatggcgaaaccctgtctctactaaaaatacaattacctgggtgtggtggcacatgcctctaatcccagctacttgggaggcggaagcatgagaatgacttgagcccaggagtcagaggttgtggtgagccaagataccaccactgcactccagcctgggtgacaaagtgagactttgtctccaataaaataagtaaaataaagttaaacagagttaccatgtgatccagtaattccagttccaggtgtatacttagcagaatttatctacacaaaaacatagaaaagtgttcatagcagcatgattcataattgctaaaaaatggaaaccacccagatggccatcatctgaatggatacagaatacggtatgcctatacaatggaatggagccattaaaaagaatgaagcattggtacatgttagaacacggatggtccatgaaacatgctaagtgaaagaagccagtcacaaaagaccacatagtcatatgattccatttaaatgtcccaaatagcaaatccgtagagatagaaaacaaatcagtgggtgccaggggctgagtgggtctgggatagtatggtgagtgactactaatgggtatgggatttctttttgaggggagaaaatattttggaattcaagaattagatactgatgatgtgaatatacttaaaaccactgaatttcagactttaaaagggtgactttatgatatgtaaattatatttcaataaagctgttaaaaccaaacaacatccaataaaaacagtgtcccagaagacccctcatcattctcccaatcagtgccccaggttattcttagggggagaatagcagctgctgcgactgctgctgctcctgtttacctctcagtaggagccattgttttagattaggcatgaagcttcatgttcttaacacttgccaaggcacagcagggaactttttgtaaaaccccattttaatcagatgcttctttgtaattctatggtgtcaagtgtgacctacctttggcagcagtattatttcttgcctttcaaatcaagtagctaggtactcttgacttgctttttttttatagaaagaatctggaccttaaagttttaaaagaagtttttaaagtgctatatatatatatatatatatatatatatatatatatatatattcagagctgccctgccgccctcccccacttcccaccccgagataggggttgttaatgccatcctttagatgaaccacatagcattcatagttcttttattctacatataatttctgatcttaaaaaaaaaactatccctaaatgtttatatgcttttaaatatttcagacaagattgggtgcattcaggatgatatggctgtagacaaatatttcaaacccaaagtaaggtcagtgttgattttttgcttttcagtgatgtcttggcattgcccattttcaagcaggaagattccagccttccattggatggtgaaacagagcacccaccctttcagtatgtgatgtgtgctgcaacgtcaccagcagtaaaac

SEQ ID NO: 105188 - DNA, 1743 bp, Homo sapiens
ttttccttataagtgatttacaagtcccattggagctagaatacactgtacgaaaaggcagcacttatattgggagaatactgtctagcgttttgggatcagttcctactttgttgtcctacattatgatcttttctggctgcagattttaatcacttgatgttagtaaattataattgaaagagcagcggtgggagtagcactgtgacttcgttttgttcttttgattgtctcaaagtgaagtttctcattttggagactaccctctcaggctgtttcctcttgagggttttaagatgcagtgattgcaccacaaataattgtttagtctctgctgtctgtaccagcagtcattcattttaatatggagagattgaaacagatctgagcttagtctccgccctttatcctttttaactgttaggaatttggaaactctgtatttttttagtggctttattgaaatatagtttaccatagcgttgacttgactaataaagtctaaaaatcagtggtttggcagcttttcaataatgtgaattaagtgtagctttctgttctttagaaaatgtctgatgttttggaagtgctctacagtttcccagtagcattcatacatcttactgcagctctagaggaggacttctgggttaaagctggcctggaatcttggtggctgctccttgaagtaattgggtctttaaatcttaaggagaaattctgagccataaagaactctcagaaaggttggagacatttcttggagtgtggaagtgagtagtggaaggcatattaaacctggagttccccagcgtctggctctgatttggtctctgttgggcttcctgaacttggcacctcttctctctgcagttgtataacttaaggcctgtagatgagttggcttattttctaaaacagctgtttcagttgttgaggaaattgagctactgaaagtcatggagtcaccccagaggggagtattagaggcagtgcttctctagtgaaaacgcactcctctagtgccattctgctccttagctctctactggaaacacgaggcttatagtcaaggcaaaggaggcacgtgaagcaagttcaatatgtgtctctcctcagttgcttctcttttatggtaaaatgaaagtttgctgctgaaaagtttacttattgatagctattttgagcttttacttttttctagggttttatttgacctgtactttgatttagtgattcagccaacttattaatgtaataacttctgtgtatggtttatttccatgaaaaggaagtacaatcttgatgattttaaacctttccctgaccatgtatttttaaagtaatgtgtgagatctttgtaattctgtgtaacctacagtactctttacagggataattttcccttgaattcttttttggttgtgtcatttaatctaaattttcaaagaagtttgaaggtaattaccatttttaagaaggtttttttttcgtatttaattgagtcctcaaaaactaagagatgagagtgcttgcctcttgcaaattcaaggccctttgtttgaaattctcaaactaaggaaattccaaaattgactcgataaggagaaaatctgaagaaggcgttagctgctgcaggcctccctggactgcagttgtactttccatgcctggccctggagccctgagagggttggagtgcctatgaatggccagcttgagcattcagtcacttcctctggc

SEQ ID NO: 105189 - DNA, 1380 bp, Homo sapiens
gatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaaga

SEQ ID NO: 105190 - DNA, 1052 bp, Homo sapiens
taaggtctgtgcattctagagtaactgtaaggtgtccttggtggaaggacaaagagacatgtactttaatgatatatagctgctattttttattttgctaattatgctctgagaatatacattctctaatcctgtctttataaatatccttatataatctcctcagatgtgtttgtattttaaaactacacctaagtaaaaattagtgtcgtctttttcatagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcagtaagtattttaatatccttactttccagactattttattgttcattaataattttttaaattacattttgctttctgtcatttttgaatatacttttctagggatcagtcactctacaagtatttactgagtatctaccacataccaggcactgtttgaggcattagatttatacaacaaaatcactgccttcaaattccttttagattttcatatagagatgagtattatagagttttaggatagaatgtgctttagaggaaagtgaatcttagattgtgtggtctaagatgcattagatttatacgacaaaatcactgccttcaaatttccttttagatttttcatatagagatgagtactacagagttttaggatagaatgtgctttggaggaaagtgagtctattttagattgtgtggtccaagaaggcctcactccaaaggtagcatttgcattgaaacctaaataaagccacataaaatctagaggagaattccttgaaataattagcaaatccaaagacatttagatgggaacaagctttgtatagttgaggactaggaagaaaaccagtgtagttggaccattgtgagagaaaaggagtggaacatgggccagatcacattgagtctttttttttttttgagacggagtctcgctctgtcgcccag

SEQ ID NO: 105191 - DNA, 1046 bp, Homo sapiens
cattgtctgttaggtcatatttgttatgcttttcatattcccttcttaccttaaaaaaaaaaaaggtaggtcaatattttttttttatccttccagcaaaacagtttgaaagcaaataagaatatcttccttttccctgggaaagatggtcaagcttcgtgctattgaacagaaatgtaggggaagaaaacggtcttgtttgagtaacaaaaatatattcatctactgtatgcctttgttttttaggcagcacagtcagtgctgatttcattatttgaactcaataccccagagtttacaatgttattaggagctttaccaaaaacttttcaggatggtgctaccaagcttcttcataatcaccttcgaaacactggcaatggaacccaggtaattgttacttattttcttggctatcatataatgtgatggttgatttaataataattgctttcttttatacgaagtaaacttgatccttaatatataatttttgcatctttatttggcagcatttcctgagcagaattaaatattgtcttggaaagaacagagtccctattcctgtcctgtttatattatattataatttgtgtgcattaggatagtggtaaacagtggccaggtatgaacaagaaaagcaaaacgtgagcaaaacatagatgagagcaccagctggaagccattagaatcaggacatgctctttagatgaatcaattcttatttgaggactaacaaggatgacttattccagggttaacaaataagattcaaaggaggtagtgctttaagaagtgtggtcacattaaatgatcacaggcttgtcagtccatttatacttggatgtgcaggaatttgttttgaagaagtaagttctgagtaaatgaaacattgaaatatgtatatttgtgtgtttgtgtatacatatatatattttttactggtatgaaataacttacattatatgcctaaagaattgaactgaagcattaaaaagaaagacatttaatggcaaataaaggagacacactgatggcaggcttaa

SEQ ID NO: 105192 - DNA, 1281 bp, Homo sapiens
tatggtatttgtaacactacctcttgaaccatactcttgagtcttggacaactacggtagaaattcaatctgtggctactaaaatgaggcacagttgaatctcctgacgagcattctaggcagctcagctgcctgcagtctttagatcaggagaccataacacacatcttacctagggaaaataaaaagtagtagtatagttacttttattacttccaagcaatagttattgtttcaagccttcacagaaatattttaacttgtgaaagtattgcttctgagaggaggaaaaaaaagagaaaagaaaggaaaaaattctatggactatgctttggaaccaaatgttggccccattcagaagtgggagtatgtgtctattattcttggattattttcagatgtttaacctcaaggattgatagggtctggaaaaaaaagagtttttgtctttagttttcttaattttcctggcaaagaggtgcaagagaaacaaaatcatatgttcttctcccatactattcatttaagtcttgttttaaaaactattttgagtttatcataaaacttcgaaaaacatttgtcactattattttctgagtgtttttcttccatacaggaactttgcattgatggcgactaatttgtgtgtttttcttttttttctttttttctttttgcatgctgtcccctgtgttggaactctcaatagagagtaagttggttcaatatttgttggaaacctaactttactgcatgactgtgaaattaaccctttttctctattttctctcccaaagagttcatgcagtgttggaacctttgcaatccacgaaatgctatttgcagttatgcaaactatcattctgtttggagatatgctttttaatctactaattaatctaatttgattatgttcttctgttctatttgatgactggcacacctaagatataagggagttaaagaaaagtctgcctcaattgtaatagctcgaatattttaattcttttccaacaaattatatttatgagatatgtgggataataaattgattctattgaagattgcttccattgaattattttaaaatgattctgaagtttcacaatttttaaaaaaacatttaacccctgccttcccacaaatgacattttattaatgtcattccataaaagcaaacagagtagattatgggatagtaattctcatctttgtcttctgaaagaacatgtgaatcactagttttatattagcatagccactttccactttgttctttaa

SEQ ID NO: 105193 - DNA, 2996 bp, Homo sapiens
aatgacagaagtttattcggcatggtttgggagactaggaagtctaagattaaagaaccagcaaatttggtgtctgatgaggacccattcctttgttcacagatgatgccttctcattgtgttttcaaatgttagaaggagctagctagctttctggggtctcttttgtaaaggcactaatcccagtcattagggcaaattggctcctacaggccccacctatctcctaataccatcaccttgaggattaagatttctacatatgaatgaagcaggtgttgtagaaggtcagtcagttagaccatagcaccatctgtaaaattgaatagtaatttactgcctcattggatgtcaggattaaaggagataagattttattagttactagttaccatagtggttttttttttacactataatgttcgtttttttgtttcatgcttgtaccttcaacatttccttccatttgaatacttcttttgtctcctgtaggcctgtctgtccacttaggtgtaagatgtgtttttgtgtcaggaatgatggtgcaatgctaatgttccattgccctatttggcaatactctgatcattaactataaagaataacaccagtgttaactaactctccttgcctgacagtagtgctgccactattccttgtttctgtggtaatagatgaggtttgtatggtcctgttattccagcctccagacaccattccagatcaactggtgccctctacgcccccgaagtgtatggggcctcaggtgaaggatgagtacattttcactatcatctggcattcatctcagattttatccttttcagtttccattaaataatattcatgttttaaaattgattttttattatttaaatttaatttgttggagaataaactttttttttcttttctcccaagtaacgttttcccctttagcaactgtattgagcatttttctcactggtatatggacatttttttgtataacctgttgtgtcatttttaaatatagaattgtttttatgttctcatctttgtatatatgtttaaaaaaaaaaaaaccaaaatggtggatgaagtgttttaattgtaaatgatggtatagaaagcagttgagggggagaattcatctctggtttgtctctgtatgcctcagaatgtcgggcacatagtagacacttaacagttatcaaatggatgtctcttagttgtagaataaaacccacttatcttgaaggagaggagataataattagagcttattttccttgtaaatttctagtgtgccttcatggatctccctaaccactattggttgaggattgatctttgtcctgggttactctgtgattcagccgtatggatgatatttgcctgaactgatagagctggattacagggctatagacttgcaagcccttagtctgccagccatgcttccttctaccttgtggttgtaaatgaatagtgaccgttctttatttttcacacattgtcagtaattttaattgtctttacccttttattttgccaaaaactaaatgtgcccagaaaatacaatattgcttttaaaatgctttgccccattggttttttttccttcccctgtaaaggtcttaaagtttcccaacctgacactgttatatttatgactccttcaaatctattttccttcttttgatgaattaggtccaggttatgggatcagccaatcaagtcgactgtcgtcttctgttagtgccatgcgagtcctgaacacaggttctgatgtggaggaggcggtggcagatgccttggtactcttctccattttcttatcattataaatgttccaattacgaaactgttgaatgagtaggccagtctatccatgtgggaaaggggttggggaaaaatcagtgattaaatctaaagataaaacgtgggcagtgtaaaaagcagaatataattaattcttgatccttattaatcagaattttataccagggccagtattactgatggcctatcagaaatataaatatagatgtctttaatatggtaatgtgttttatacactatagtatacttaagggagataaactatataaatatgtacacttaaaatcatgtaatttcaactctagcttaaactttggtatttaggaattattttactttggggctggattttgtttagtattttatctgtgttttttgaactaaaagaaagtacaacctcaaggcaaattataattaagatatattatatcttatagttagatataattctttatgtctgacacattaaacagtgagatttaaaaacatattctacagatccatgatagcttgtcagaagattgcaatacatatatcgttgtttttgtcacttaaaattatgtaagaagtagcatttttaaaaatgtatgtaattggctttggctaatttcccaagtcaattcagtatcacttcctctttcagattatgatattaatcctatgtttgagaaacatttactcagcttcttacccagaacttgtaagaggcctcatctttgttttgaaattaaaaaaaaatatgcttcctaaaatcatagatcccatcttaactagtgttgatataatacagtgtttgccacatagatttgaaaaggcaggtttttaaaaatattcattggtaatagctataatttattgaatatcacacgtgtagttctgcgctaaccatttcgctgtgctgaatttttcccgttacttcagccacttgattattttttataaattaatataattaagtagggactttgttctcttcaacatgggatatattgatcacatcttgttctgatgatattaaattaatgagatgtttttgatttgctattcctcatccctgtatctcaaatcatgttttctgggttttttaaattggataatttaccagttaaattctgcttacataaatgttacgaattgattgggtttttcttgaactattacttagaacactg

SEQ ID NO: 105194 - DNA, 1022 bp, Homo sapiens
tgaacaaagagaaaaattgagttttactgtattgtacagtatgttaaatatttttatttgcagcatttttagtttggtaaaatattatttgcccttctaatttcatacaaactagaggaccatatttaagaatttaactgtattcctggtaatgcttcagcaagagtaatttcttttcagccttagaaaaatttaagttactgttcagtctttaagaaagaaaaaaacaaaattttttaaaatgcaaactctgttctgttttctcccttactgtgtgtgctgctgttgcttcacaccagcccgaagcagtcgtattcctcgaccaagtgtgagtcaaggatgcagccgggaagctagtcgggagagcagcagagacacaagtcctgttcgctcttttcagcccctcggtacgtattcgggcaggtgttatgtgcattgcttatccatggtgttatcactatctgttaacttcagcatacctgggatttagctttctttgtcgacagatctttctctctaccccttttctgtcattttgaggaaaggaaattacatgtttgggaaattcctttgacttgatttacatgtctgaaatgaatatgttagtcattgtattaacagattgccttcataatcaagtaaatgtcacacaggtttaaacttcagaatattgaagtctagatctttcttaacaagtaaacctgcaaatttaaagatatttaaatatttaatctcaagtgaaatgcggactagtttgataaaatacttttgtctttttcagcggaaatgttaacatttcagcttagatcatttaacttaggttactaaaaagaatgccacaaaataacatctgaactacttattaatggtagggattaacatttttataatattttacagtttaacagtcatttcctatgagctaatgctcttgtcactgcggtaaaacttgtttgtccccaactgtattgtaaccttgattgtaatactatatttacctcaattataaaaatattaaatga

SEQ ID NO: 105195 - DNA, 1021 bp, Homo sapiens
tatttctatttcttgtttcgtcaacctcaatcagtatctcaacttccatactttttccttcaccttccactcttagagttatcaatttttacattattaaagtttacacatacattttcttctgtatccacaagcaagtcttatgtacttgttccataagttggctttaaaagatgaaaagctgtaaataacatatactgtgttatgagtaaatgaatgttgtttgcagccaagacacctagtgtactgtgaacccatttcttcccaaaggtacagtgagttccctagggaccacttgaaggagagtgttcctgttataaggagatgaattctctttccttacattcctaccagttatttacttatgtcattataacttataccagttatttacttattatgccacgttttcatttgctgtgtatatagaaagtgactaagaatagtgtgcacttctcatatcctttaggattgctttcccttcagtattgctgaaaggaaatatgcagttccttattttttccagactttcttttcagttctctctggattagttgcatctaggcctcttgctcagctatcttcttgagattcctatttgctgctttcctggtttgaatcactccctcctggatcctctttctcttcctttgctcttttgctttgctcgtacacattcacaaataattccttagaaatagtgtgtaggagtcaagctttttgaaaccttacttgtctgagaatgtctttattgagtagatggcaccgatttcgtttaggcctacagactgaattactgttcctagcgcttttcatttattctgtgcctggtatttggcccatgagcctctgaagttttcatctaactaattcacttctttttgttttccagacattattttaaattctctactccacctttagtcagtcttcacccctgtttattgtttctttcgttccatatttgtgggtttttcatttgtgaggaggtgagaaaaagaatgggaatcgaaagcattgg

SEQ ID NO: 105196 - DNA, 1063 bp, Homo sapiens
tactgtgatcatcatccttactttgtcataaagtaattcattagggcttgcatggtcttaccatatctttgtatcactacttagaaaaaaaaagtctctcagatcaaagcaggtgtgttctgatggctaaccaaaataaataaataaatggagactcaatggagagagcactagatctatatttatgacaaaattgtgtctctttttctgttggtagtggctggttgtatacaaatgattgtacagcccgtcagaaactttgtctcctctcctcccatcttttgtttttcttggtgcatcttaagaaagatgacatttgtagctttttcatgtaatttttcttcagctgtacaatattgtagttgttccttatgagtagttttaaattaaatgtttaatgaaaacatttaatgattttgattttcgactgtcagtagtagaaaagctgaagaatttacatttactgttgcagtctcatttcatctgctttgtacatgagtgtctgatttcagttgattagctttaaaaacaactaaatgtactgcttttgttaaagacatctgtgcttttgggattttttaaagtttgctttttttgccttagggttttttaattttctgagaactgactaaagctttcttatttccatctgccatccatttaaaaactgctccttccctcttcatggattataatccttaccctaattctgcctttacacttgttcaggatcacaatctgctaataccattggtggtaagaatctatagactttatgtgtgcatctgttgtttgatcacctattttcattatgaagaatgggttctattcagcagaaattcttaacgtcatagtctatcatttgtagtcatactggggcagaaattgccaattgtgatttttctttggcctttgtcttattaccaaaattttgattttttttaaatgacacaagttaataccgtggatataaacattcaaaagaaacaggagcttttgtcatgctttgaaatgctataaaaactataaaatggtagtttgaaaactttaggtagcacaagag

SEQ ID NO: 105197 - DNA, 1015 bp, Homo sapiens
ttaatctttagcagtatatcatagtagttagaagacgtgtgcttccatatgtgctgcccagaccagtattagcatcatctgggagctagttagaaatatacaatctcatatgccattacagctctactgaatccaatctttaacaagatcatcaagtgatttatatcacagttaagtcttgagaagtacatactggtttagatcatagatactggagtctgcccaggtttgaatactggctctttgaggttatttgaagttactgcacttctataatttcatctgtaaaatgaagaggagaatagcatctacataggattgttgtgaggattaaatgatgtagcatatttaatagacataaaatattgcttagccctgaataagcactatatatgttggctaataaaattgtcattattttttaattttttaaaatttaaaaaaattttaaatactgcagatgatccttattatttttaatcaaatgtcaactgaattttagactgcttttgtgtacttctgtaccttgttattcttactgccttcagtaaacagagaaataaacaatgaagttaggaaaattgaagcataaagataaccaaccaggaatttccatgtccattgtctaaggataaaaattaattgtgagatattagttcttttctgaaacaatactgaggctgatcttagggcaaagactcaaagggcttttttttaaaaatacttaagagacctccttttcaggtacattgtaagtaaggatcacttcactggaaaatagaataattttttgcatttggcttttcactttgaaacccattccataatcctccacatcttctcctaaattgtgaaaacacagtaattgactttcttagaccaaataggactttaagattagaagactttccctctgtaaaatcatttgggttttatattggagggacttttgtttgtttgcttgcttatttatttgaatgactatatgttccattccgaattcttttgtaaaaaa

SEQ ID NO: 105198 - DNA, 1017 bp, Homo sapiens
agcttatggtataacacgtaaaaaaaaaattactgtttataaaatttttaagagaaatagaacccgtaattgatgattacattattacagaatttggcagtacctaaaaatagtgagattttctcctctcattattaaacattattatagaaaaatgtttttaattatgtaaatattttatttctcaggccgggtgagagcaaaactttcagcaccacttgctggcatgggaaatgccaaggcagattctagaggaagaagtcgaacaaaaatggtgtctcaatcacagcgtatgtattgcttatcagccctcctatatttgtcactatgttaggataagtgtgttgcttttgtattactgtattagacgattgaccagtggataaagacaaagctaatttaaaaaaagacaagccacatactgagttcttgttctgtactttaggttcatcatcacctgacaaaaatgaaggtatttttttcaatgttttggatcagttgttgtgcatgttttggaattttttgagtgggtgttgtcttgtctttggtgttttattagggctgcatcattgatatctgccacttacaaagaaaaacttcatttgccatacaaacttttgcatggagatattttaaatagcagaaatccttagcattaaggtgttcacattctactcagaaacttgctaatgtagaaaattatgctttttagagacgaaataattgccatatattagcatcaaaatctggttatatcttaggtaacataattcaaggacagatacatgatatcttattttcccaaaaatctgttagattatctatttttgattaccatttttggcaggtatatactaatttatagtgaggaaacataatttgaaatgactgattctgtttcattcatgttaaatttaagatttacatttttgctctttcactggaagctgagtttgtcataagcatgattattaaaaagtacaattttgaggtctagctaaaattaattatttctat

SEQ ID NO: 105199 - DNA, 2656 bp, Homo sapiens
atagaatagagaaagtgagttagattcatccagatgtgaaattttaaaggggctgaaagttctaagaaaggatgtgggtggggaagcaacgaggtggtaaacagaggctaatgatgagagggcctaagtgtggaatttgggggtatattataggcaagagagaaaagaaacaaggcaatgtgactgtctgggaaaaactcacagactagagcaggggattggcatgatggcaaagtccaaagctgggacatgggcctcactaacttttctctttttaggctagtgaaatagactcattatcaacttttaaaaaattctctacttagtacattaggtgaagtctttatctcacatctggtttaatttcctagtctgttttagttgaaaacaagcttgatatatacgtctgtactatgaattctgtcttcttaaagaaaatgttttctaggaattataaaaatcatttcttctaatatactaagttttcctctgttctttgcttgtgctttcatcaaagaggatacttctgacaagctggatggtaagaacttcctttcctaattctactaaagatttttatggaacctggattctatataatatccttgttcattcttctcttaatttctaaaaatatattattaatacttatttagtgataatgttaatgtgaaaatggctacataattctctgaatgaatttggggttagggatatctattgggcataccatatcccagtctgctcaaatactaggtaactattttgttttaacttataaaatgtttgcctgagctcttagaagttcgcctctgaatattctcgattcgttaagtcttaataaaaaatattggattcagaagaatggaaagaaatctcctaagtcatttcattcacctctttagtctattaagtgatatgacaaatgacatatttcgtaagttcatatgattgtttttgaaaatgaaatgcaagttacagaggccgactttttaagagtgcgttgtaaactaacatttagtcaaaattgaactttaaactttgcccttttaatttcaatattcaattgattacagtttatctgtagtggcttggttcagtaacaaccctgtatgatattttttgtctgatactagatagtatattatccacactttcccttcacttcagcagataccataatgttacctatgagcttgaccttttttaaataacttaagatactaaactaaatctgtatgtcacattatgagatctaggaaaaacagacactatatatttttctgtaaattattatgtaaatggaaaattgatctaatatatcttctgttttaatgagatagaacatttattaaaccttgggttaggtacatgactgctagttatattagtgtctgcttttctatatgattataataaaatattgaatgaaatgatagcccatcaagagatggtttctatgtatcaaaccccttagacatcctaatattgatattctggatcctttaaaaacgaacttttatcactttccagttcaaaatattttcctgtttgggtaggaaatctcaatctatttgagaagtcactactgttatatgatgtgttactcttactgatgttcaatcctatgtttaaaaaaaatacacagacgtatattattgcgctttagtagtagtgagttatgatgtttgtacttagtcattttttatagatttcattgacatcttaaggaatgcacataaatgttgaataaatagctaatgaattggattgataggtttttgctttgtagatgctttgataaaaatgggcaagtgaggcctaggtcatagattttattcctatgtttgtcagttagctttttctgattccttcatgggctaccttttgaaaatgcagagaaaacatttctactctggaaaggtctataaaatttcattttcaaagagtaattacagagttacatttttttgagtgatgagtttctctaattttttataccatttcaaattttaagaatgcaatatagcagacaaaaagtgtttcctatagaattttgttatttttatttgtctagtttccgtgtgctgtgaatcattggattacctcaaattttgtttttctcaaaatgaaccttcccgcagttaatttaaggctgtcagactaaaagttaattttttgtttttaccctttcattgtagtgttgggtggggactgtgaggtaggtcttaatatcaacattggcagaatttgttgaaatgttgttttatttttcttatttaggaacagcatctgaagatggtaagaactatacattttgttagtaacacaaatacatctacattactattttcattggtaggaattaaatattagaactaaaataggctaatttctttgcaactctttataatttgccagttgtagtaagttctacatttcatatttggttgtcttagtaatgtgtggattttttttttttaattcttcatcctgctggtttgctttgtactttggatcatctcatgctggaaaaacataattgcttaacatgtttaataatatctagtatgaagtaagcatataattcattttttatagtagtgacattaatgcttttcttacatgtttgtgtttttgtttttttatttatgcc

SEQ ID NO: 105200 - DNA, 1062 bp, Homo sapiens
ccacacctctaccaaaataaaaatttaaccaggtgtggtagcacatgcctgtgggcccatctactagggaggctgaggtgagaggattgctggagcccaggaagtagaggctgcagtgagccgtgatcacaccactgcacttcagcctgggtgacagagcgagacctttccacgttctccaaaataaataaataaataaataaataaataagacaacaacaactacttagcagagtgatgatgattagattcgatttggaagtcattagatgattttacttactgtaatcaatattaaactcagagcattccttcttaaagcagttgctactggtttttgttatctctaaagtactgaattttttggcagcagggatattttaagtgttttgaagttcactctttaacttcagcctgaagaggaaacttggtggtaggaaacaggaatttaagttaaggtaaccttgatgtttgagtacatatttatgaatatttattctaacaattgagtttatggaattgcttgagtggaaaagaaaatatagtttcaatgaggtcatatggacagaagtcagattttagttggttgatatagaagttggaaagagaatctgtgtaaattattgttacgcctgacggtcaagaaaaggggtgaaagaatggtaggaattatctgtggttgaaagaacttatcatcttataagattggagaagttaattatgtttgtatcctaaggtggcaagtcagtagagatggaaaagttagaagtgtaaggatgaaaggagataattaatagctaagttgctgtggaaggtgtgaggaatgggatatggagcatagcctgggagttagtcttgaatgtggaagggtgagccatttcacagatgtagaaggggaggaagtgatggaagggaaggaattggaagaggtagtagatatcagatacgatattttggaaagttggacattaagaagagtgtgattggggaggttgttgtgactttctgcctgaagattcagagtcaggatcatgtgctaacaggtgacttgaagtttagaat

SEQ ID NO: 105201 - DNA, 1018 bp, Homo sapiens
tctgtgaagacaagttcatataccttaatcatttctattcattcttgttatttaaggatagtccatatgttttaatataattctatattgcggacacacttctgaggaatctgagctgccttgtttctccttttcccttgttctcatcatcgtcttgatcaaagaaacaattcttgaatccatgattgcctgtagaattttcataactgcacttctaccacatctagccactggtttctaagggggtttgggaagggaattggcttgtatctaactttcctgttttctttctcctacttctcttctcttaccaagaatgtgaagccttttggagatctgggagaactgcaaagctctactctgtctaaccaaaccctaaacatatattccaaaactctattcagtttgatttcttcatgtttttatgtctatcaaattaaaaagttgacgttggtttgcgtatctcttcttcatgcttccatttttttcttttgggtagtactgctggaacactaagcaggcagatcgccagaacacaatacaggttgagcatacctaatctaaaaatctgaaatctgaaatgctccaaaatctgaaactttttgagcaccaacatgacactcaaaggtattttggactgaggcgggcagatcacctgaggtcaggagttcgtgaccagcctggccaaagtggcaaaaccctatctctactaaaaatgcaaaacttagccgggcatggtggctcatgcctgtaatcccagctacttgggaagctgaggcaggagaatcacttgaacccaggaggcagaggttgcagtgagccaaaatcgtgccattgcactgcagcctgggcgacagagtgagactccgtcaaaaaaaaaaaaaaaaaaggtatttcggattttggatttttgaattagcaatgcctagggatgctcagtcatttaagtatgaatgcacatatttcaaaatctgaaatctaaaacatttttggccccaaacattttaaataaggagta

SEQ ID NO: 105202 - DNA, 1003 bp, Homo sapiens
attttgcatacagtagtaaactatgcgtattcagggaggtaaaggaaaacaaaggtttttaaaggaaaaatgaggaagattacataatcattttgaggtggttatcctggactacaaggatcagtaacaagggtgatgccaacttgaggttggacaggcagttgctgcgtagatgtccttgcagaatttttgtttgtttgtttgtttttgtaaggttgcgatagcctttgtgcaaggttgtgtttttttggagtcttttgtgatagctcttgttatcagtcatttattcataagaactctcccttaatggccttcctcagctccatttgtcaagtgtatgtgtatgtgtgtgtgttgtaacacaaatgacttcattttgattctgacaacttcacaccactatcgccaacaataataaagacaggaaaaacaagatttgtacatttgatgtttaagaagattgtaaagaactctgcctttttaaattaggtaaatatgtttaattaaatactgtgttaggaagaagctgaataagacattgttatttgaagtggttcaaacttttgacaacagttgttcagtcatctctgtcttatgtcaggggtcagcaaacaacagcttgcaggtaaaatgtggccaatagtctggttttgtacagcctacacatgctaagggggttttttacgttgttaaagggtgatttaaaaggtaggggatgggggtgaagaatatgagacagagactgtatgtggtccacaaagcttaaaatatttactgtccagccctttacagaacagttttaaccaacccgtcttacattgaggaaaatggtaattggaaaaataagaatgtgacagaagacaaaatcagaaaatgtaccatagaattgccttaaaaatggggagcaatccattaactgtagggagagtgagtggagtacaacctaagcagaaatgtaaagctatgtcatatgctgcagagccatcagataggcccctgaggc

SEQ ID NO: 105203 - DNA, 1128 bp, Homo sapiens
ctgcaatgaatatttttgtacatatgtccttgattatttgtaggtaggagtttctttaggatataaacataggagtagaatttcatagttataatctttaagtttacttagatgttaccctgtagggttgttttaccagttaaaactcctgtgagaaaggtatgatagttctaatttcatcatatccttgccaatacttgttgttgtcactcaaaatatttttaccggtatgatgagtatgaatactctttagcatgtctatttgaaaatattctcacattgctttacttgcaaactaccttctattgcctgtattacctttttagctctctgaaaggaaaattgtccttaaggtatttaagatcttaaaaagttacaagaaagccttaaaaagttttctgatttgactgtattttatccctttattgagatatatgttttttcttattttaagatactttttaaataatagggaaaacatatcccttcctccttttgtgttttacaggctttcatataagggaaagattagtgttgtaggaacaatcagtaaaacttagttgaacttgaatatttttattgtttgatatgttcttgtcagactggtaacatcatggtatgggcagccaagggctattcaactatacggaggggaaaaagctattttataattactcattgctttcttccagctggccctctctgccaccctcaccaccctgtaaaggtgttccacaccttccattgttcccttggaaacatctttttcataagcagcaactcccctaagtctttaaccccatttttaaagagtccgttcaatgttcttgccttgattagaatctgattttttttttacgctctttaaagataaagctgtttattattctcggctctcatactcatagtaattgataataagtttattgtgcttgcactcctcattattactttgtgaccattattcctatacccatttatatgaggttcatgctccctgaccagccttcttattattggcatgtactgatcttgacaacattccagtgctgcctaggtttgaatcccagctctgccacactagctgtgtaaccttaggtacattacttaaccctctgtacttcagtt

SEQ ID NO: 105204 - DNA, 1077 bp, Homo sapiens
atatattcacttccttttagtcagcttacctacgtatttaagttttctcagttgtcctaagaatattttttatagcttttaaaattcaaaccaggatatacttattctctcttggatagttggtaatttactgtttatttctcaggtgattttgtctttaaacaaaatttttggccaggcatagtggctcacacctgtaatcccagcactttgggaggccaaggtgggtggatcacttgaggtcaggagttcaataccagcctggccaatatggtaaaaccctgtctccactaaaaatacaaaaattagctgggagtggtggcacgtgcctatagttccagctgctatggaggttgaggcaggagaatcgcttgaacccaggaggtggaggttgcagtgagctgagatcacaccactgcactccagcctggcaagagagcgaaactctgtcgcaataaataaacaaacaaaaatttttttcctgactttagccagctgtcttttcatatcttctatatatattcagaattttttatattctcattcatctttcttttatacctgtaattgctgtttagttaatattgaatttatgttggagaattgtgttatagttttttccttcttggtaggtgttttttttaattttagggagttacttttatcagcagaaaatatttctgttcctttgttttcttattggagcacagtatagatgtcagattattttgtttatgatgatatattggattttcatagacctcaagtaacaagtagattccgtggggccaggaaaaaaaggtttgcttagtttttaagtttaagagggccctcttctgttggtatagtgaaatgcaccttctttactacgtgatttgttgggggctttctacttctgattctgtgattaccatcttatttgaacagagcccttattttttgtttcttccttttctttatccaccaggattcaaaaggatacctcccacttctaattgctatttacttcttgtcctagagagaaccttagttggtgtctacgttatacaactaactaccaggattcttttctacaca

SEQ ID NO: 105205 - DNA, 1251 bp, Homo sapiens
aatactgcattttgattttgaattacagaggattattttatatggtgttagccaatatataaatgcttattcaaaggacctttatttcgtattatatatcttaccaaagtaatgattttatatatggctttattttatttttgagctttagggaaaatggaacaaagcttagttctcttaaatacatttttctgatgctttgtgcagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtaatgtaaatccatttcaaatctgttatgcatgctccatgcccttgatatggccacacatacttggaacttcagaggaatatgtttattcatgactgcagcacgattgcagatctggagtctgttgcaacattcagaagaatacgatgcccttttgaaatgtataaaatattgtatactgctatttcctctaagaatgtatgtgaattagtctcttcttgagggtatttatttttcagatgccattttgaaaaagatttatggaagttttttggggtttttttgttttttttaagcagagaacaggtttttcagaatttggctactaattttcaagtgcaatagctgttacagaaatgttgaattatgtaatgtttttacacattcctctaggtagtaagtcttaaatactccagcatttaaaaaatggttgaagatactgggtactgaatcatttgtcacaataggagatgggtggtggtcaagtaaaattgcctcaaaaatggttcctggattaaatcataataggaaaataagaaaaatcaggtttcatgcaattttataattcatagcatattcattgatcatattagaactgtttctagcatattgtttatctttaaattttttaatgggtattctttcatgtgttaattagaaagccgtgagtatatttccggtgttagtttctgctacatctttctgatagaatgaatctgtgaaaataagggtatttaattctaaaaagacagtaatctctttctcttttcctttctttcctttttaaaaataaatgtatgtcttagttgtgatattttgggaaaacatatctttccttgtttacagtaactggtgagaaaatcatggtcttgaggatttttgttttttctttttgtc

SEQ ID NO: 105206 - DNA, 1091 bp, Homo sapiens
agtagtataggcagagacaatactggtctggccttagattaggagtggcagcagaggtaaagagaaacagtggatttaagcacaagaactgttggtagacgatctctgtgggtcaaaggaaaacttgagcacattatgagcctgagcagctgagtagatggtgacgttatttactgggattggggaggacttagggagatcagttttggatgatgttggttttatgtgtctatatgaaattagagtggcttggagatacccatgggggagatacctagtaggcaattggatatataggtctggaactcagagatggtctaggctagagacaaacatttgagagttgtcagcatatagaaggtatttaaaaccgttgagaatgaatgaggtcatttagagagtgtatagtctggagagaaggagaatattcaacatttaattgttgggtagagaaagaacagccaacagaagagacttagctagagggacctgtgagattagagaaaagccaaggagagcttcccgttgtaaaagcacagtgtgggaagtgtagacagctaaaatttgagttttccaaggtatctgtggtataatagtttatagggattaatgtttcctaatctcagtttgtaatttagctgttagatataaccatagtcactgctggatatgcagaagtgtaaaacagctcagaaatcccaagtcttgttgttcattgttttaattagaacaaggaaggatacagcttcaagggaagagaggaactttggtataagaaactacttaatgtgaatcagagcatattttgtgcatgaaaatttatagtgttgggggttcttcttactgaactgtttgtttcactgaagaaaatccacataagatgtatttttttctatgagatgtggtataaattttggcttgctcttttatttgccatgtaaaatggtgcagtttatatgaatttgagaagcagaagtttcgggttttggaatacatgtacccataaaagtgaagtggaggccaggtgtggtggctcatgcctgtaatccctgcactttgggaggccaagaagggcagatcacctgaggtca

SEQ ID NO: 105207 - DNA, 1047 bp, Homo sapiens
ccagtgttaatgagaaaaattacggtgtgtttcatcccagcccatgatacttgagtagttttcccaggtagaaaaatatatcaattgaatactgaaaacaaatttttataagtaacaatttgaagggaaattgtacatgaagtaatatcatggagtttaattcaacttcttctttatttctgcacaatttttccccacaaaattttcaggcctttgttgattcatttttattgcacactaaaactaaaactaaaactgtaaataaagtgatagaaacaggaaaacattttaggacagagtaaaggctcggcatgaaatcttgtggaaatagttcatgcacacaaagagctgttgaagatactaccttttctctccctcacttggtgcatttatgcaaaataaattgttttgggtctgtccaaaaatggcacgcaattcaaatttgttccacctgatattctgtgaccagaaactattatggtaaacaaaattttttggtgtgtctttgcctgaaaccataataatgacacatcatacatcttacagcatattgatttagagtgtttcgtgatgaaaaaaatcattttactaaatacaagaaaccaaaggatttgttgtaaaggtgatataacttttttatagctaaaagttgtcatctgaacagtcattaagtgagttatagagtatttgatggttttttgaactcaacttgttatattgtaaaagtaagttaggcagagtccctaaatgcagtagaattagctctgctgttagaagaaaactggatttaaaatctgtcagatcgtgactagaaggagggaacaccagccctgtaggaaagaaaagactgaaagttggagaccccctgcgattatggcaggcgctggtgtcgttatggagctttctagacagtctcctgcacaaaccaaggatgtaaacactaacagtgttggtggctgtaattgcaaatccttttctctttcactgtgaaaaaaactatgcataattcttatttgtcgagtgtgtgtttaggacctaatgcagtct

SEQ ID NO: 105208 - DNA, 1159 bp, Homo sapiens
aatagagacaccccacatctacatatgtccattacttggtgaatagataaacaaaatgtggtaaatccatacgatggaatattatttggtcacaacagggatgactgatacatcatgcatcaaccttgaaaacattcatgaaagaagccagtcacaaaaggccacatattgtatgattccatttatatgaaatggccagatatggcaactcataggctagatatagtctttagagaaaggaagtagattagtgtttgcctaggactggagagatcagggtaaatggggaatgattgctaatgggtatgtggttattttttggggtgatgaaaatgttctaaaatggattatttggttgcacaactctgcagatatactaaaaatcgttatattgtacagtttgaagaggtgaattgtatggtattgaattctacctcaataatactgttattttagaaagataaagtctgagatacctaattgtctctttcatgttatacttgggatttactattcttattctaaacttttaagtctggactttggttagggttgcttttctaattctgtcctccttaccctatgagttagaaccttcctaatactttactggcctctatccttatcctaagtcagaaccttcctagagctttgtgggcctcctaaattgtgtttataatcttttggacaatccagtctctgttgtatttttcttccattgaatttcctaatttcttcccctgaattacttaaaatatcttaggctcttctttctgctcttaaattgtttatttcttccttttttcaccaaattatatgtataataatcatctattataaatgcgtttgtttttctaaaataagtgtatagagtttgatgatggggttggagggattcagtgagggccacgtagaaaattatactgtgttgttttgtttgctttaaagataagttatgaacttatcctttataaaattttgaacaagtgactaaaatatttttaataaataccaaacaaaagtcagatgttaattttacttgaaagttggtaaagtgagaatcattagaaggaaagagtgactgagaagagagagtagaacagtcataggaagagtgtattgagtaactgaagagctggcagcaaggttaatgctgcga

SEQ ID NO: 105209 - DNA, 1051 bp, Homo sapiens
acacaagaattttcgatctcgagaaggcgtgtgtctgtgtcttattgaaaccttaaacatgtaagttttatgattactgaaaataactgtcttgttttttatttctctaaaaaaaacctcagttcacaaagtcaaggaaagctatggtaataacacatttaaaattattaaagcatataacttcatttgatacctttactgttcattttttgtgtatgttatctttcatgttcttaatttttcagttatgtcagtaataagtgtttctctttttttctttagtatgttaatagtagccacccaaaacagatggtcatggaactgatatgctgataacttagtatctacttctgttctggattgaatttggaattgcttttaattcaatgatatttcacatattatagtcatttcccatccccaccctacccctagagcagtgtgggtgggtaccagaatcatagaccaagcaaaactttcccaggtaactggacagtgaggctggtagctgtgtgtagagttctggctgccgtagttgccacagaactatgactctgatctgaaaaaatgctaggacttttgttcttgctgtggattatttttttaggttctatgcaatgtcataggtcatatgtagtagctttcagcttttcctatagtgctacttccttttcttaactatattttcacttattttcttttattactttatagtcctttctgccctctagagcctataagtgtactcagtctgcacagctctttgtgctgggttttggctctcctgccataagcataaagatcttttaatttacttatttcattggaatgcatttatttgagaccagagtctaaaaaaatcacaattttaaaagtgaaaactctgattttcttaagttattcataggttgctaggtttaagagtgccattgttgaacattttaatctattagagtatgtgttgtcttcactgtcagttgtgattattcaggtttgcatactacattgcttagaattattttttgctacattgcttagaattattttttgc

SEQ ID NO: 105210 - DNA, 1072 bp, Homo sapiens
ctatagttgctttagttcatatttgcttcagtttttttgtcacttggttaattttatgaagggttttcctcaagtttctactcaactctgcactttaggttttccctattttcttgtgcttcatagaggattcttcttcgtgttcttgccccttccccactggtagactgctgttgcttcttatttcatgcttgctggtctggttgggggaaacagcgtcattctttgtttttctggtctagcttcagtcttaggaagctttttgttctgagtcttggggtaaggctttataaagaccatggctttccccaactagagacctttaattatatgggccccaggatgtttttctgctccttcctctggggtagaaggctttttatctttttcctctccttaatagcattgagttttacctgtgccttaggcgtaacagtgtttgatatccttcactgaggagcttcaaacttttatttcttagcttcaagcttttgtttcttacgggacaagggtactaggagcctttgtgcctttcctgcacaggcagcggtttccttcccccaggactgtaccaccaagagatactttatccaatatccttctcagcccttagtcttaagagtgtccagtggaggtttgtggagaaagagcttgcaagtaggtgtgaactagagcctgtaagtaggtatgagttctccttgtgtctgtggctagttgtgttttcatgctagcccacactcagttgtaaatagttttgttaagtataactgacttcttcttacccacttacatcatgggtttattttcctcctgtcctctgtcacatgtgacctactgcctgtgtcccatgtctttgtttagatttcaggttagttggttattctccagccttagctttttgatggattcaagaacagtcatgattttgtagacccagtgggctttttcttgttagaatgagagggatattctttccagtttctacatcccagacagaagatgaaattcctctgtaattaaagaggcctacatttttaactgttacatttaggaaacatttcaaagttacaaa

SEQ ID NO: 105211 - DNA, 1365 bp, Homo sapiens
atgtgtcttagtagataggctaatgctgggggggaaaaagttacaaagatgaggtgcgagaaagaatgagcctttctgaagagttggtggtaggcagggtgtaatgtagccgcgttgggaggccaggtaaatattttgtatttaacttgccccgtagtcgttagtagttacttttctttcttgtcttctggtggcagtgttgctttaaaatgctgactgcagcttcccatggatgaagtgattcttcttagtaacatattctcatgatccagcgaataggctgtactttgaaaccttttattcaaaaagagaagaaagacaaactctagaattatgacgcagatttaatggtaaagcccagatgagttttggaaaggttagactttttacaaggacaataaagtttgagagttacccacgtcgatgcttcattacataccatctcttgattattatttttaaaacgtttggggaaaaggtaatttaataatatatcattaccatttgggagattatttctttggaagaaacaagctaaatttactctgtaagaaaggcatatacatattcacactcaagatagttgattttatgctacagcatagactgttgtagaaagacagcgctttggtaatgtttgcaccccttccgaagttaagattggtgtgccatcttctacacgggctgttgtgaattggctttgggccatttcactcctcagatgtacctcagtgaatgacagttgagcaatcacgctgatattctgtgataccacagtatgctagttttctgttatgcctctaagccctacttctactcggtgctgtgtttttaactgttctttaagagttagaatccatcaggggtctcatccgggttcttttctgttttcactacgtattttctccatgctcctcactagataatgtagcccaagacaatttcagcagtcagaagagaactgccatagtctcccaccacctgtctatacacttccttgtagctgtgaccatataatcttcctttttccttgttagaatagataaattgcctgttttcctcatttatgcaattccctccacgaaagtattagattccatgccttcttgcttactcaaggacattgatccatcaattctgctctctttcctaaatcactagttcttccctttctgttgaattctatagcatagaaacttttctgacattgctagggaaagggcattctaattaatctgttgctttaagttttataagctaagttacccaactgggtaatcttttttttttttttttttttttttttttacttaagatacaataaaacatacttaactgttttaaaaagtgtgtcataggagcttt

SEQ ID NO: 105212 - DNA, 1051 bp, Homo sapiens
gttgaagtcattgtgtgtttataaagatgaataagatagtgtttatgattaccaaggcagaatgaccatttgaaatatcccagtgccagtattttactttttttagatttcaatttaaaaggagaaggaaaggaagttgggtggttataggagataatattttgagcttttgtcctttttttcatggtggatttttcttcaaagaagacttaatatttaatgagattcaggaaggttacctaattttctgttttctttcattctatccagatctgcttgacatttacctggaaggatgctttcgataaaggttcactttttggaggctctgtaaaactgggtatgtaatttttaataaaagtgataggaaaattggtctaactactttgcattgtttttagtttttaaaattgttatcctaatgactctttgtaaatactaaagttttttacatttcattctctttttagcttcaacttttaatgcaattttgaaatatttgtagagagcccatgccttgccaggcactgtcctagttataaaaatgaataaaaccgatgtacttagtttttgggaagatagttgatcatttaaaagtgtaatatgtaatagcctatgaacaaactcatggaagcatatatgaggaagaaagtaattctaccttttgaaagcagacaatgtttgagttaggccttgaaggatggatttgtagaaaataatattacagatacaaaatcataaccataggtcagaagggtgaggacatttgatctaccagctccagcaagataacctctctgtgccttaattttcttatctgtgaaatggagataatactatttctctcattggattctttttttttttttttttgagacagagttttgctcttgttgcccaggatggagtgcagtggcacgatcttggctcactgcaacctctgcctactgggttcaagtgattctcctattcttctacctcagctgggattacaagcacccgccaccacacctgggtaatttttttagtagagacggggtttcaccatgtt

SEQ ID NO: 105213 - DNA, 1032 bp, Homo sapiens
atttgctgactaccagtcagaaggaagagtaagagttgaggcttgactctgagatttaataagttggtttgacctgttggatatttattcctctttagtagaaaggttgactctgatttttctgtgttatgtctgggtagacatttctctggcattttgaaataaaggatttaaagctcagaagagaaagatatacattcgggaacaattattaggtgataataaatttattccttctggcagataattgactgagaaaagtatcaaagtcagagctaagtaatataacattcaggggaaatagaggaagaggttctgggaatgaggttgagaaaaagctttcatatcttacaggaaccagggtaaaatagagatgtgaaggaatgccagaagagtttcaaaggtgatgtggtccagtggttcccaaacctggctgcgtattagtattacctgggaaaaatgttaaaggtttatctttaaagatgaagatacagagtgccagatgtgataggagaaagttttggagtagggcactggaattagtatctttggaaatatctccgggtggccgggtgcggtggctcacgcctgtaatcccagcagtttgggaggccgaggtgggtggatcacgaggtcaggagtttgagattatcctgaccaacatggtgaaatcctgtctctactaaaaatacaaaattagccaggtatagtggcgcacgccttgtaatcccagctactcaggaggctgaggcaggagactcacttgaacctgagaggcagaggttgcagtgagctgagattgtgccattgcactccagcctgggtgacagagcaagattctgtctaaaaaaaaaaaaaaaaaaaaaaaaagaaaatatctccaggtgattctgatgatcatcccaggtccaggctggaacatccttgacagagtcattgtggcagaactcaagtcatgtaaggttggagaagtcactggatttagcagagagaagtttctcttggagtatcctgaataagcatcagattgag

SEQ ID NO: 105214 - DNA, 1069 bp, Homo sapiens
ttttaatcccagactgatttatttctttttcttagtataatttgtttcatgaaagcaaagttattttagtattaacaaaatataattgagatgaaaaatctgatggggaacatttcactagtgagctctgaaggccagacagaaatcactggcaatgggtagtaatgctgttcctcagaggactaggtgtatgtactacctggggtgtcccctaactacggcatgtttaattatttgaaagatgaatttgtttgggaccaaagcaagagcattgcagtactaaaaatattttaatgtttatccccgcctctattctcatgttaattttgaggaagtatatctaaaaatagtttaatcagattgttccattagtttactttgtttttccttgtaatttacttttaatctttgttaaatctcttgttacgctatagagttttagaaagataaccttattgtctgtaggtcagatgttttagattggttttgcataatataaaaatttaaatatattaactgttcactgagttaacatttgaaatgacttttatatgtaacagtaggaaattaagtcttgctgagttcctataaagaaattctttttcccccctttagtttgctagtggtgcctttttacatattaaagagacggttttatctgccttaagtcgagagccgaccgtggacatatctccagatactgttgggaccctcagtcttattatgctggcacaggctcaagaagtattttttttaaaagccacaagaggtaactccaatttatctttttgttgcatgtgaaaaaaagtgataaggcttttaaattaagaaagtgattagaatataatatgttcaatgtcgagctgtccttcttgaacttgatacatgaattatggaaaattttcagctatccttttctgaatttgtggcacaaatttacatttaagaatgtaggctgtgtttgaagtcatgaaatagatctttagtaattgtctttaaacactccattctggaatagtatttatgtatgtttttaacatgtcagacatttattcgcaaatatttattg

SEQ ID NO: 105215 - DNA, 1487 bp, Homo sapiens
cccctttcccccactgctggcaaccactaatctattttgtctgttctaaattttgtgcagaaaatgtgatttcatcaagaaagatgttttcagatgcgtgtacaaacttgtgacctcagtgtttatactgagacatgtcagattagctcatatttattttaattataatggtcatattgtattccagataaaatgaaagatgccatcatagctaaattggctaatcaggctgcagattattttggtgatgctttcaaacagtgtcaatacaaagatactctccccaaggtcagttattgtttttataaacacttgcttactttgcatgtgaaatatttagacttttttgtgtataagaagcaagttgaaacttataaagaaatttgaagttttaatagagttatctgaagtatatagtagaaatagtttttttttttttttaatttaagatgcatgaacaattcttttatgtttaggggatgcctttgtctttaccttttactaaacttgtttttccaagctagaactctttctggaaaatgttgaccatctgttttcaatacttttatcaaatcaaggcattgtgtagttctgaatcattggtgatttggtacaagcatgtatacttgagcatgttgatgattcacacttttaattattgtcctgttttcttaaagatgagccttaaagcgcaaaaacagacataaagaaaaaaggaaaagaaaacttaacaaattcatctgatactttgattagaattcagttttgccaacagggataaaaaattgggctgctaatggacagctaaggaaagcaaccatcttaaaccacatatcacaggaagtataatgttttaatgtaaacctttctgaagtgacaattgtaaagactattcagtgatgatcatttgttaatgacaaagcaaatcactagtaaatttggaatgattaataaagaaaacttaaagattgagtgaaatatatgtttcaactacttccttcagaaatgttcaaggaattagtttcatcatatggtatctgttacatgattttttttggtaggggaatttattgatttgtaagtcatattcaggaatctttgtacattaaaaaattgcagacaacttgggggtgaagtaaaaatgcacataagtgcattaacagtacttattactcagaaaatgatcaataaggaattaatgtgacgattcctggggatttaagatacaccaagagcctagtagaaatttgcccaggattcttgggtattaacagccttcctcttaaaaagagacttgggatctcctctcatgtttttttcatctgaaagacctcatgttcagctgcacagtgttccgttacatcctgttgggccattagttcagtcctgtcatggagagaagaaagtcacctacaaagacttggaagctacctctgcagcattcctggtattccttgaaaatctcctgtttcagaaccaagttgctc

SEQ ID NO: 105216 - DNA, 1037 bp, Homo sapiens
aattcgcttatatttctttttaccaatttgtttttgagggaacagtgatttttaagttttttcagatgcataattccttttggtacttaacttcataataatcactgaataaagttaccttgatataaatacagtaggtaaaatgtaaaaccctctgaagagagggtgaaaatactgcaaagccttccaaatagagaggatagtaaaatgccattttaatttggtttaaaatgctttgtttaaataggtaagctgagaaaaccctccagagagcctttagaaattcttttaagggtttctgaagtatgcttgcatttctgtagtgaatttgaaaacctaatccttccacttaaataggtttaatgttattaaacaattgacttttctctaggaattaggaaggttttcatgatcatgaatcttttaacttgttacattttttatgataatgttctgtaaaaatgcttttattatttttattttctttaggagtcttagatcatatttaatattaagttgttgggcctagtaaattgtataaatgtatctcatgcagatctcagttcttcggctctaactatcattgacaaattagctttagatcacattactctctggattaaaaaattgttcttgttccttacttgtatttgttctttgcttatagttttacaatgagttgactgaaatcctggtcaggttccagaacaaatgcagtgatatagtttttgcacggaagacagaaagagatgaactcttaaagtaagtctgttttgtgtaccaaattgtacttaaagaattttcttttaaaaaatcatgtagagacttttggtatgaacttggtagtatgagatagcaattttcctcttctcatggaagaaggaactagatagagtattttacaaagcaacaagtaaacagctgcataatctgggaatgaaaggatgaaaagaagcagaaactctagatgcaggaagtacagtgaggtcacagaaatgataaaaacagttcaggtggcagatctcaggaagtgccag

SEQ ID NO: 105217 - DNA, 1058 bp, Homo sapiens
ttttataagcagttatttacttaagaagtagttttgttttttttttttgatgaatgtatactagttttctttatgtctggagtgactggggcccttcttgagagggaaggttggatgcggacagtgtggggctttgctgttaattgttaaatcagggcaaaaggtactgtctcagatgttttgggacatgtcatatttacttctttgtgtacgttaatcagtgcagtgaaaagatgattgacatcatgtattacatggagtgcattttaccttaggtattgtttagtgtgattttgggataaatttcaatttactgttagaggagacagaattttctaatatttaatactaaattgtaatagtattttcagcaatatatctttcatgagtttatcttagtgacaggtgatgtgttatcttttaatataaaatatttcaacgccacatttctttgaatatcttcaggaagtttttatctagaaatttgcataatggtttgcataaaaggttagccttttcacctgttttattttgtataaacactgatatagtgattaaaacattagctacataactatgagtcactgtagttttctgataacttttagatagatgatgttaggagttttttaaatccagggactaccttttattagagggtgggcagtcttttaggattacttgcccagtttgacacgtttcttactctagctgtaactgtgatctctgaaaatgtttactttttcccccagtcttcagaaatataaaaaagatacaacttcattttattaaacaataggaagaaagaggatttagattctagtcaagaataaaaatgtagtatattttgtttttttcagtttttgttatattgataaataattatacatattatggggtacatgtgatactttgatcatgaatacaatgtgtaataatcaaatcagggtaattaggatattcatcacatatttgtggggcacatgtgatattttgatacatgaatacaatgcataataatcaaatcaaggcaattaggatattcatctcaaacgttt

SEQ ID NO: 105218 - DNA, 1051 bp, Homo sapiens
ctgaaaggtagtttatattcatttggtttacagacttggaatcccaaggacatgggtttgagtctcagcttgtccactcaccagctgtgagttcagataccagtgtgtgcctaagggtactccaggatccagctccaaagttacagacttcctggtcatatcatagctttagccagccattccctaaatcaggagtcaacacatttttcctggaaagggccagatagtaaatattttaggctttgcagtccatatggtctctgtcgtgactacccaacccccctctttgtagcacaaaggcatccatcgacaatgagcaaacgaatgagtttggctctgtgtggggaggtccagtattggacctaacggctgggaccagtgtgtacctagggacaccctggctcttgagctagactggcttctcccttttcagaggaaattttgtctcaggtttcattgacctgccctgttgtgggccttggttggagtccctgaagacatcctaataaactgccttatctttaaatctggaggagccagggttggggatcttggctgcttcctccctagaatgttccaggcttcttattaggttggtgcaacagttattgcggttttgccattgaaagcaatggcaaacaccgcaattatttgtgcattaatctaatatttaaacttggtctttagggtacagctctacaaacccagtaaagtggtagcttttgctaagttgctaaaaagcaaggtgttattagcccccgcaaagggggctgtgggacaaagaagatccacttccctgtttaagcagtagcatgaccatacagcctcaaccatacctggccttatggctgccatagctaccaaaggtaaaaagttgtcactgtaggcaaaggatcatctgttgttgtcatctgtgcattttcttggcccagagaggacgccatacgtactccaggaaataaaaggaaatttacattttaaggtatttcacattttaaggaaagacaggagccaataaaatgaaacattaaacgaatcacctagtgggcag

SEQ ID NO: 105219 - DNA, 1029 bp, Homo sapiens
ccgtataaatatttgtgtatcaattgtgcagggagtggggggcaggcactgttccagtgatgtgttggtggcctgaacatcttttttccctctgtgatataatgccacttgtcatttataattaaagctatcacttcacaactaacaaagtcattctgaccagcaagagacgactggaaggagtactcttccctacagaacaccaaactggcactgagctgtttgtgatcattgttttcattgtcttcctgtggttattatgttcattattaataatgatgatcatgatcattaggcctaggaagaaaataatgataaaatgtctgtaattacacattataaatacaacatgtttttattattatgttgtatagtataaattataatcattataatcactataacaatatgaacttctgcttgagtttgtcttctatatgatcaaagcatttgaagacatgatctcgttagccttcatgacattctgtcagaaggagagcaagtttcaaattacaaacctgtgtgttggagtaaatatggactgaagggggtgttgtgaagaactccagaaacccaaaacaaaatgcagccaaataaacagtgagtagacacacagcaggaagatgtgtctgacatgccataaagtctgaaatgaaaaggatttctgaaagttcagttctcttattttcactgtgcattttgtctctgccatttcccagttgtgtgaccttgagaaatttgctttgcctctctgagcacggtgattaatagtgctttattttcctattgcaattagaggcagtacctatgttctgttcctccccccactttcagtttaatgaaatgactcaatgcagcctgaaataaggtcccagcctgggaacttttgggaggaactgaatattcaacccagcacctggcacggagcttggtgcatggttggtttgtgcttaatgaatgtcagctgaatgactaaagatataaaaggagattgctttatttaacttatagacaggggaaattttaagt

SEQ ID NO: 105220 - DNA, 1052 bp, Homo sapiens
agttttctttttcaggactttctgatttttctctttactagtaatgcaatttcttcaatagaaatggtttaatatataagttacacccacatatacttattaattatatattatatatatattctcagtgagttcagcagtttgtggcttttaaggaatctctatttcatctaaattgtcaaatttatatgattagacttatttataatattttcttatcaaccttttaatgtccatgaggtctctagtgatatcctacttcacacataagcagggcttttgtgaggtttctgcaggacttttctgcaagtctatgagtcagttgtgaaggaagattcagatcttccttgttgtacacagtaaataacacatggtaaatatctccaatgctgggagcaggcacaccaactgccaagcacctactacaaataggtagtatcacattagatgtagaactgtggcacaagatcaatctgtaggtggacatatactttcccatggttctttacaaggcatgttgagcatctttgatgagtttgtcaacttctgtcaataataccattttaaaatatctgacagtttgtttcaagttgctgtgactgagccactgttttcaacatcttctgaattactacctcatcaatatttccagcatcactgggattaacttcaaggtggtaattacttgcaatggtgctaatttcaatttttttagatggagtcctgatggtctggtatttaattctcaatttttccactccaacaccataaagttgatgtagaacacacatagcacttgtcttttttccagaacctgatggtccatacacttaaaggtgaggaaactcaccaccctgcaccaggttgtatagctgggctgcctgctccctgtgatactccatccatcccaaggattagggctggtacttgtctacccagaggctcatgaaagcttgagttcctggggtctgataaatgaaagtcccacatacatgtctgtctttttaataataaccattccggccagtgtgagatggtatctcattgtggtt

SEQ ID NO: 105221 - DNA, 1040 bp, Homo sapiens
tgctcataaactacacacattgctgaatctgtaattcatagaaacatatcatggtgaccatcttgtaaatgccaatgccaagctaccagtccctttcattacatgccgtaattatggattaaatgatttcataaacatattggttgtttcaaagttggcatgaggctgtcttagagcccctgcaatctgtcatcactgttaatgagatatcaaccttcttgtaacccaagcaaaaaaaaaaaaaaaattctctttgaatgtcagccaggggagaaaaaaccctccagaacttctgcaaactctgcaacctcctctcaaacaccatatccagaaagtcttcaggaaaagggccagtgacatgatcaaatgacaagggcaacatctgtgcaatataaaatgtaggcattgatgatgtctgggattctttctttcctcacagcagcaaggaccaccttaaacaggtgaagctctttgaagaggcttcttaattttcactgaagaccttctaatagtaaagaataaactcatacactcaaggatcttggaggcatggcttctagatcttactatgatttcaaaatgtcctagaaatcttgtataatatcttttgatttttattatacaccttgcatcctattttacaatatgtctaggcttaatttagtatttaggaagctttggagatctattggaagatggcagataggaggaagaactagcttgcagatcccacttggacagacaaagcagtgtgcggagactcacatagtgaacttttgctctaagaatgacaccaacataccaggaaaactgagagaacccataaccctttgaaggaactgtatcaccactgcagattccttgagacattgaaaaatggtgagttggcttgctttctcagtggggaggctggtggcctgcagcaagttctcagccctggtcactggctgccctactagactcagtgctgttgtgggggcatggtgggagtgagactagcctttaggactgcaggacacatggaagcacagcaaggcctg

SEQ ID NO: 105222 - DNA, 1116 bp, Homo sapiens
cttatcacctttatcctgcttataatctactttgtgctgctccacttactcctctccagctgttgtccacccttctctgtcctgctctgggccccagcaggctggactttgtggaatgcatttcccaggttcgtttgccctctggcttctgattggatttgacaaatggagttaccagcaagcaactgaagggcagagggaagaaattatgtgtttattccctggctccatccccactggacaatagttagacatggtctctgtttttctacccaaggtcacattgccttttgggaaggtcctctccagcagctatagctcttgccaacttcacatcaccactaaccctttgcctgtcaggaaaggcaatgtcttcccactgattttgatcctatagtgccttgctactctttgttagtgcccttcaccctatctacatctttgcaaacacctcttcgttaaattctcctaaattataattgcttgcaccatctgttccctgcaggactctgaccaatccaccactgttaagataaactgagcacaaagccacttcaacaaagtatttgagtagcaaacaacaacttttttcatatgttcatggagcaagctccaagttagaatgaatatctgtctccacattgcatactaggcttcctaattaatctatcgcatcatttccaatttgtattatgaaagcttgtgctaaacagaaactttaaagagatctgtgttgtgagatcctgccacagacggcagagtctgcataaaagaagagctattccaacataaaaacagaataggggtggcagagaggccccactggagggagccagccttcagcaggtggtgtcagggagggtcagaaccaattgcgagaggttaatttgggttgctctgaatggccgaccccaagaagatagttcaggataggtgatgcccacaagtaattgggcagaggaggattctcatggtgattaattaaagtcttggcccctgactcctgtaaactcacaaggaaaattaaatttcccactagattcctcccctgcctggggacagaaaagcccgttgttcagcccctcaggatgcaggcaggcaaaagaattattacaa

SEQ ID NO: 105223 - DNA, 1041 bp, Homo sapiens
gtcctttctagttcacctctggaactcagctttgttcagaaattttgatgcaatcataaggtaggtttggagtaattcagtactagtgatagttatagtaaaagtgtatgactggtttaatttttaaaaataaatcacagcaattgtgtaagatgtaatctttgggataaactgagtacacggggtctgtctgtactcttccagtgaatcttccactgtaactttcagtgagtctataattacttcagaattaactcttaaaataattatagcaaaaacaggaaaaaaaattatggctgattcaaaggtcatcctatacagatggcatgctcacttcctgcttaggtgggaaagaggtggagtttctcatagcctcactggagcctcacttacctgtgctgtggccacagtgagctcctggtatcctgttctcagctgtgctatgcttctctaaaatttagtttttgtgtttttccaaaattagagtaagcccattgaagtgtgtcactttgtagctatagacaaatggctcatcatctttgtcctcaatgttatctttagctcctcaacggagagctgaagcagctgtacaccgccatcacacgggctcgggtcaacctctggatctttgatgaaaaccgagagaaacgggctcccgcattcaaatatttcattagaagagattttgtccaagttgtaaagacagatgaaaataaaggtaagatcctgttaaaatactcttaactgatggaggaatcgtgtttctctcaactgttcttatggtcaggaataaaaggtgtggtattttgaaagtgctttctttcttttccacaatcttctgagaaatggaagttgttacacatttgccaaggtgcatgggaaagtgtagctgtagtgggattgggaaggttaactccttcagggaagatcttttatttgtcctttaaaagtggggattatggacagggctagaggaaataggcccttttgggagaatacaaagtgctatgagtgtttgtacagctgattaacagtatctat

SEQ ID NO: 105224 - DNA, 1094 bp, Homo sapiens
caaggccatctgcaatgcctacaaccggggcttgtcctgtgtcctgcggaagaagctgaaaggtatcaataaaggccaagtgtcagctaacatgaaaattcaaaagcgtatacctcgctgctatgtggaggacacagaggccgagaagggcagggagcatgtcaatcctgagtactttcccccagccagtgcagtggagacagaatataacatcatgaagttccacagcttcagcaccaacatggcctttaacatcctcaatgacacgacagccacagtggagtaccccttccgggtgggtgagcttgagtacgcggtgatcgacctcaatcccaggccactggagcccatcatccttattgggcgaagtggcactgggaagacaacctgctgcttgtacagattgtggaagaaattccacgtttactgggaaaaagctgagcaggcaggaagcccattgctggccaaacaggtctggctgaagagaaggttggaagtggaacccggaaaagagagtccaggtggggaggaagaggaggaggaagaggacgaggaagaggaagattctattgaagtggaaacagtagaaagcatagatgagcaggagtatgaagcctgcgcaggaggagccggtgtggagccagcaggggacggccaagctgcagaagtatgtgcaccagaacatccccaccagctggagcatttacatcagatctttgtgaccaagaaccatgtgctgtgccaggaggtacaaaggaatttcattgagctttccaagtccaccaaggccactagtcattacaaaccactggaccccaacattcacaaactccaggacctgagggacgagaactttcctctgtttgtcacttccaagcagctgcttcttctgcttgatgcttctctgcccaaaccattttttctgagaaacgaagatggaagcttgaaaagaaccatcataggatggtctgcacaggaagagtcaaccattcctagttggcaagaggatgaagaggaggctgaggtggatggggactacagtgaggaggataaagctgtagaaatgcgtacgggtgacagtgacccccgggtgt

SEQ ID NO: 105225 - DNA, 1048 bp, Homo sapiens
ttagcagcatccctggcttccacctgctagctgccagtgacactcccctagctgtgacaataaaaaatgtctctatacattgccaaatgtcccttggggagtaaatcaccattggttgagaaccactgagctctttaatggatttcagattttttgggggagttcagcattctgagatgcccctggctggcatcactctcaaaccccagggtctgctgtcccctaagaagagtggctcagtgctcacagggttttgtttgtgtctttcagctgacattggttttagcttcctcagccatctgttggatctgttttggtccaaccccactgaattcgactacctcaaccccaatgtccaggacagcaatgggaacacgctgatgcacatcctcttccagaagggcatgctaaagcgcgtgaagaagctgttagacctgctggtgaagtttgacatcaacttcaatctgaagaacaaagagggcaaagatgcacggcaccggattaagaagaacgactctctgctcttggcctggaacaaagctctgatggagaacaggaggaggagccggcaggactctgctgcccacctggggaagctctcaaagtccactgcccctggtcacacatctcagctcaagtcccagggttcattcaagtcagtgccatgtggtgccactgccagaacactgcctgaaggaagtgcagtccctgacagctgggagactctcccaggtacccaggtgaccaggaaggagcctggagctctcaggccctgctcgctgagagactgccttatgcaggacatcacagttttgattcagcaggttgaagtggatccgtctttcccagaggactgtcttcagagctctgagcctctggaggcaggagctggcaaagaaggaaagaaagatgacaagccgactctgggtgcaggggcccctgactgtagtgaggtgggggaaggacatgctcaggtgggccttggggccttgcagcttgtgcctgatgataacagggggaaggagggcaatgatgatcaggatgactg

SEQ ID NO: 105226 - DNA, 1027 bp, Homo sapiens
tgaaattctgtgattccaagtgctagggtagatctgtgagcaggaggccttaggcctcattagcaggaagatagtttaatttactgcactcagggaaagaaccttgtcctctcttcccagtgtggggtggatatgaatagagctccatggcctaggcagagaatgagagaatgggagacaggcaactcctaatagattattatcccagccagtcaagggagggcccaggaatccagcccaagtggcaggtccaacatcctacctgcagtgaggctctggtaattcccaaatactgcagacagaagcatcttttaaaaggccagcaatctgcccactagaatgctgaacttatcatgtggggttgagtgtgggcagcgaggcttgtttagggcaaaaagttaagaatgggcatcacagaggttgcagtgagctgagattgcaccactgcactctagccagggcaacaagagtgagactctgtctcaaaaaaaaaaaaagaatgggtatcaatctgaaagaaactagaagtgagatgtggccatgggctcagttcctgtggtcctaagtccactggcaaaagccatacatgagagaggctggagctgagactgggtctccagtcatggtcataacagagccgggaattcttagatctgttagcatacctgaatgatctcagtaggggcttctcaagatgtgctgtgagacctgtgaaaactggcttaacttctctgggatttagtctcttcagcaactttagatagggtcagtagtttaacaactgggtctctgaaaagaaaaggtcccgatttgtagcatttgctaactttggtagtataaatactctcaccatggccaatttccagctactaatatgacatacaagacttggagttaggaggagatgtgcatcatcaactcagtagctgataggagccggctgcagcacaccattgacagggtctaatgggctccaagtacttggggcttttaaaacgctgatgtgaggaataattgattgggatgg

SEQ ID NO: 105227 - DNA, 1101 bp, Homo sapiens
tctgcatcttttaaatgtcactgttctgtcagaagccaggccggagttatgggaattccaaacaactgcttcttgatggctgccccttaagataacctgggtggttttcattctgcccccaacctgaaagggggcagttaacaggacttcttaagatgatgcagccaatactttaccaaagtactcctttttggaaggtaaagaaattggcgtcgcccagtttctaaattttgaaaaacatatttatgggaaactttgtgtcatttcatatagtatgcgtttgttttgatatttacttattttttgaaattaataaccttggaagaggtgccaagttattctgagtcttgacctgtccccttggacattctcatccatgaatttgagaaatatggttggaggatcaccaggtgcaataggtcgatgggccaccaggtcagaagaatgtgtattgatgacaagagttggtagatctgggttccagtcttgtttcttgtcatgaactaactgcatgatatgccatgaaacctatcttcatttgtcatagtttctaatgttttgggtaacaatatttgtcacatttttcttaaaggaagtgagttttgtaacttaagcttccatttcctcctctataagtggagataataggcacttccttagtggtttatttgaggtattgaacataagcacatatcactgggcttggcaactagaaaggcaaagcgaatgttaattatcctgcctaactcttaggggattgattttatgatgaactgaaaataattgccacttcaaccaattataaaggacttcatactactttgaaaatgcctttctttagggtatctttaatttaccatttgtctatgtgtgaacttaattggaggaccttttcccaaatgctgtagactttccccacattaaaatccctaaattatgaaactttcttttaggtgactccattgttttgcaaagtttcttgccttgctttgatcatattttcacaactggattcccaacagaagtgtggcaatctgtaatagaaaagttggcaaagaaaggattatggcatgtaagtaaaaggagatggctctcacgggg

SEQ ID NO: 105228 - DNA, 1041 bp, Homo sapiens
aatacaggtatacacgagtacacccagctaatttttgtatttttatgtggagacagggtcttgctgtattccccaggctagtctcgaattcctggactcaagcagtccgcccgcctcgggctcccaaaatgttggtgttatacgtgtgagcctctgcacccggcggcaaaactggcttttaatcaaccttttggctaaaggatttctctttttatttatttgtaaaaggatttcccatttttatctttctttttgatattaaaatgttgcctcatcctacccagtaagtacttgaatttgaattctcttccttttcatttttgcctgcaaactgaccagtcttttctgagttcatctcttctgtacgttttgtcaagtgcagtgaacagcaactacaaaatattttgtttttctgtctttttctttagtaaagggtagatgatctgcctttcaggttatctcaaggggcagtttcacctttccataatataaattacccttgtgtaagttatttcttccatcttctgatagcaatttcctgaatgcctgccagctaaccattaagccagtgttcagtattttagcattttaaaaaacaagggaccaatttctgtgtcagcatgggctagcttgccattgaataacaaaggcaaaatctcactgtctcacacaacttttctattgcaacttgcctagggactttggtttagatcataggttggccatgatcaaactatggtccatgggcaaaatctgtctagctccttatttatctaaataaagttttactggaatatagccttgtccatttatttattatctgtggctactttggttctacaatggcacagctgagtagttgctacagagtgtgtacatctcacaaaacctaaaatacttattctgtggccctttacagagaaagttcaccaatttgtgctctaagttgccttcattctgggtctcaggctgacaaagcagataccatcaggagtgtgggtgctaactttgggaaatgaaaaaagagtatggcaaatcact

SEQ ID NO: 105229 - DNA, 1935 bp, Homo sapiens
tatatgtaagatagcacacaagtagaaatatttaaaagcagtcttattcacagattgcagtaattctgtatttctactaagataatctgctttgtgccaaaacagtaatttccaaacttctgttcaccatgaaaaggcaatcttaaagttcattatgtaaaactaattataaacaggacccaatttatattcatagatcctctcaagtattatacaatttaaaaactcttgttccaaagtcctgtcttaactattgaaacaccttaatctgtggttactaatccagcaaattcaaggaaccaggctatgactaagaatttaggtggaattgatgtctgggcaattaaaataaatggcataagagcttaaaaaccaaagttgtgccagtggctttcaactagaggcagtaacctgtcattccagaggatgctgagaaatgtgtaggggcacttttttggttgtcatatttactaggggcttctgttggcatttaagcctaaagacactcacccctgcagtgcatgggacagcctggcacaatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcaccatagcacttgtaaatcaggaattaataattgaatcagatttaagggctctgtcctgttatacatatttaaggcagaaaaaaagttacatgtcgattaggtacttatcaagaatggtcaagctgagattttggttaatagagtaagcttacatatctagagaaacaacatagtggaaaaccgaaaaaaaaaaacagaaaaatctaccggtaatttcccaatagctttgaatattcacagcagagctttattacttgagagaaagactggaagacctgaaagccacttctgctttctaaccccagttccttaaatattgaaatcttgtacattttgtgaaattccagtatgttttgcttaaggtgttaataaaattagtttgcatcatgtagtcattgagtgagggggagatataagccaaggattttaaattgacccttagctatagagaatttgctataagctagtcttgtttgtaaaaaaaaaaaaaaaaaaagaaaaagaaaaaagtgtattttactgttttctgtattaagtaattctgtaactgcatggcagtctttttttttttaaataaatatagttgttactggtcctgttgtagcagtgaatatagttaaaatacgtacattaaaaaaaaaattattaggtccttaccagttactgtcctatagctcattcctactagttttcttgacagatttgtattcccagtgtcccgtattgccactcaaattgctctactatgctaagtccttgttaatagtcttaccctccttgaaacacttgaacacttgatgactttagctttgaggagataccatctccaggtgtgctttcttagtctttgcaggcacctcttcccttcaatatctgttcttcgtatttttaaaaaaatttgttttagactgccttgttctgtgtcagctcgctagctgatctcatttccttccatggtttccttaccatttatatgcaaatgactgtcagattcatatctcctttctagatcttccctaattgatgtatctaattgctaacaaatgctctttgctgtctcaggcactacatgtcattgatcttgcccccaatcctgctcctcctctcatgtttcctctttgactaaatggcattaccactaccaaccattcatttgtcctttttaccaattctccaatgctgccattttaattcaggccatcaaccta

SEQ ID NO: 105230 - DNA, 1101 bp, Homo sapiens
gacatgaaaattgcttgaacccgggaggcggaggttgcagtgagctgagatctcgccactgcacttcagcctgggtgacagagcaagactctgtctcaaaggaggttgcagtgagctgagatctcgccactgcacttcagcctgggtgacagagcaagactctgtctcaaaaaaaaaaaaaacaaaaaccaagaaaagaaaaaaaaactcttctaagaggatttttttttcctggattaaatcaagaaaatgggaattcaaagagatttggaaaaatgagtaacatgattatttactcatctttttggtatctaacagaaagaagatctggatattgtatgtgaaaggttcactactagtaaactgcagtcctttgaggatttagccagtatttctacctatggctttcgaggtgaggtaagctaaagattcaagaaatgtgtaaaatatcctcctgtgatgacattgtctgtcatttgttagtatgtatttctcaacatagataaataaggtttggtaccttttacttgttaaatgtatgcaaatctgagcaaacttaatgaactttaactttcaaagactgagaattgttcataaataaactattttacctgcagagacctctgatatatgtttcttgatggaagtacccagtaccacctatgaagttttcttgtcaaaaaatcaaatgtgaatctgatcattacttagatctaagtaccaatatatgaaaaatataggagacaaggaagcatggtaaatgatactgagattgggagactacatggaaaaagacttgttcccttcaacagatagacagcagggaaaaaagaatagagaaaggagtaaagaacctgtagattaaaagacatttaagggacatatgaaccaggtccagtgtatagatcttacctaaatcctgatggagcaaactataaaaaaatttttttgagacaaatgtttgaatacaggttgactatttgatggcattaaggagaaattatgaattatcttggtataagaatattgtcatgggtttttttttttgagtccttacctgttaagatacatactaaaatatttgtgggtaaaattatatga

SEQ ID NO: 105231 - DNA, 1216 bp, Homo sapiens
tggtgatgcatatctgtagtcttagctactccggaggtgggaagattgcttgagcccagcagtttgaggctgcagtgagctgtgattacaccactgtactccaaccttaaaataaataaataaataagggaaaatatcttcaacaaaggatagttctgtctgtttctcagtcttcctcaacagataaatgtgtgaagtaatggaaggtggagatttcagattacacaacattaatgctaagggcgtttgactctgtgtgaattctaattgccctagatctagacgggctgatactattagaatcccctgtcactaactgaagacagagttgtaagttaatgccttcctagatagcctagattgtggtatgctgctgcatgctaaaatggctccccttccatagcaggatgaaatagagtcattatcttggcaaccagcccctgccaatgtgctctcagtctgcctttccagccccttctctctacctattcccagctgccatgtattctaaagcctctatgctttcatttttgtttttgccttcctggatggtctttcctgctgtctccacctgaaactattcctctctaaagaacagatgaattgccatctctctgggatgcttttacccaccctcactcccacctcaggctgaatggacccttctctagatcgcttagcatattgttctacagttaggtaaaaagtctacctatcactagatcaagagctttgtttttttttattaatttaattttcttttttttttttcttttttttttgagacagagtctcgctctgtcgcccaggctggagtgcagtgcacaatcttggctcactgcaagctccgcctcccaggttcacaccattctcctgcctcagcctcccgagtagccgggactacaggcgcccaccaccacgcccagctaattttttgtatttttagtagagacggggtttcaccatgttagttagccaggatggtctcgatctcctgacctcgtgatccacccacctcggcctcccaaagcactgggattacaggcatgagccaccgcgccgagccccaagacctttctttattaccagggcttccacagacctgacacatggtagttcctcaataaataattgcagaattactgaaaaattttactgttaacttaggcagtggtaaaaccattgtttggtagctcagaactcagcaagtaaatag

SEQ ID NO: 105232 - DNA, 3501 bp, Homo sapiens
tgtaatcccagcactttgggaggtcgaggcgggtggatcacctgagatcaggagttcgataccagcctggccaacatggcgaaacgccatctctactaaaaatacaaaaaaaattagctgggcctggtggcaggcgcctataatcccagctactcgggaggctgaggcgggagaatcgcttgagtccaggaggcggaggttgcagtgagctgagatcgtgccattgcactccagcctgggcaacaagagcaaaactctgtctcaaaaataaataaaaataaataaaaaagagatagtggcgtgatatccttgattctatcagcaacctataaaagtagagaggagtctgtgttttgattcagtcacctttagcatttttatttccatgaagtttctgctggtttatttttctgtgggtaaaatattaataggctgtatggagatatttttctttatatgtacctttgtttagattactcaactccactaatttatttaactaaaagggggctctgacatctagtgtgtgtttttggcaactcttttcttactcttttgtttttcttttccaggtattcagtacacaatgcaggcattagtttctcagttaaaaaagtaagttcttggtttatgggggatggttttgttttatgaaaagaaaaaaggggatttttaatagtttgctggtggagataaggttatgatgtttcagtctcagccatgagacaataaatccttgtgtcttctgctgtttgtttatcagcaaggagagacagtagctgatgttaggacactacccaatgcctcaaccgtggacaatattcgctccatctttggaaatgctgttagtcggtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgttctttcaaggtcttagtcttgaaaatatttatagtgtagtagaactattttatcctccaatgctccttcttttccttgtatttccattatcatcactttaggatttcacttatttatcattcaacatttattaattgcctctcatattccaggctttgtgctagaagttagggatataaagacaaataagatatttcctgcccttaaagactagattcgtgttgctaagtcttcattatcaagaaaagcataagtggggaaaagtgcttgcattatggattcctcatagttgctcccctctgcatgtaaaaatcaccatttccatcatagattcctagcggtctcaggactttataaagcccaaagtgcctatgtcataatatgaggaaaaatactgagacccttccatatatgggaggtatatggatgagacagctcctgacttcacttttcccagaaatctgaaaagcagcagcagtcattccagagcccagtttctactttgaagggcagattatttattctttgagctaacctgactgaggaacaattagtttgcttttaatttactattttctttttcttttcttttcttttttgagacagagtctcactctgttgcctaggctggagtgcagtggctcaaacttggctcactgcaagctccgcctcccgggttcacgccattctcctgcctcagcctcccgagtagctgggactacaggcgcctgtcaccacacccagctaattttttgtattttttagtagagacggggtttcatcgtgttagccaggatgatctcgatctccagacctcgtgatccacccacctcggcctcccaaagtgctgggattacaggcgtgagccaccgtgcccagccactattttctttctaattgttaatgaattaattttttaaaactgtgctcctagagcgaagggagagctctgtttacagtgtaacttttcagagcttctttaactagattttaagatcagaattagttgttgtgaaatcttagggactgtacaagattagaaatcctctatagcagcatttcccaaagcaggcttccagaacactagcctcatgaggcattttgggaaaaaagagtttgctggttcagtgtgtatgggcagtgccacaagccgtaccctccgttgaagacactcattccacacattactgcataaaaagcttccaccagccattcggcaaacttattgagtgtctgctatttcctgggtattgtgctatatggtagggttatagtagtgaacaaagaagaaatgatgcctgctctcagctgactttgcagttggaaagacacatgaaataattacgccattcattagcagattgtgctagatgcctcactggaaaaataaaggacatgatggaaaactctgtagggtcagagaaagggatcattagagaaggttctttgaagaaatattttttgaaatatgaaggataaataggaattaactaggtaccaataggttaggagtagagctttccagacagagggactagttcttgggaaggtctccagacagaaataagtgtggcttgtctgaggacctcttattcgcctattaaccttccctccccagtaaacactcctgggaacaacacacattgtagaaccacgttgtggtgctgttcagtatagcaagtaattcagcagagataagttcttggaatctcatctttgggatttagttactaagatacattcaagtttgagcaaaataaggtctcagagcttggattcattgttctgttccagcaattagagcagtacctggcacatagcacaagtgcttgaaaacactgactgagtagggtaggtgggtgagtgggtgggtgggtgggtgggtggatggatggatgggaggatgggtgggtgaatgggtgaacagacaaatggatggatgaatggacaggcacaggaggacctcaaatggaccaagtcttcggggccctcatttcacaaagttagtttatgggaaggaaccttgtgtttttaaattctgattcttttgtaatgtttgagttttgagtattttcaaaagcttcagaatctcttttctaatagagaactgatagaaattggatgtgaggataaaaccctagccttcaaaatgaatggttacatatccaatgcaaactactcagtgaagaagtgcatcttcttactcttcatcaaccgtaagttaaaaagaaccacatgggaaatccactcacaggaaacacccacagggaattttatgggaccatggaaaaatttctgatccataggtttgattaaacatggagaaacctcatggcaaagtttggttttattgggaagcatgtataatttttgtcctaagtctgtgctcagccctcccacatgtgctcattgctggttga

SEQ ID NO: 105233 - DNA, 2498 bp, Homo sapiens
agtaatcccaaacacagtctgaattttttgttttccatccagaaataagatgaatctttccatttccgtgttttcagttttcatcatttttatcctataggttacttatctttattttaaagcatttcataataattttatagtttttgttttgtttgcttgtttgctgttggaaatggaatattccctccttccatttagactgctaaccagctgtaaatgtttcaaaatatgcatgttttacagcagttgttcaaagcaatacaggaacagtaaggacagagccagtcattttacaaccacattctgttaaactgatgtctattagcagggtttttcctattttattaggaaggacttacacctgatatataacaaagcttgttttaatcaaggctcagaaaatgtttttcattagtttttttcctaaccatgaagaataactgctttgtaacacacatgctggctataaagcagacaaaaaattcactgtaggtgctgcctgactggcctctgtccgtgtttctgttggggctgcttaccacagcctctgcattatcattagctagtgtgttcacaataccaagttcccagtagcaaagaaaggtcaagctcttacgcatgccattcatttatctacactgtgcaggcgcactcaggtggcagggacaaagaccactcctttggcgcatctcaagttcagaattctcagtagaggggctccagctgtccttttgtcaggtgcccatgcctgctccaggcctgtgtggtcaggacacgtgttacagagtacagtgacattaatgatggggccatggatatggtcagcactcagaggatgttagtctcttcattgataaagtcacaaccacttttcctgttggaaataaaaagatttgacgtatccttgtctacagcaacacaggacaacagataatcagcaggtcatctaaatctgttcagagagaaaggagagctgtttcctgaaaatacatcttcccctgattttagtcttatttttttctgcctttattgctttctaccctcttcaaaccagcctcatttcctaaattaccttgaatatgcattgacacttgtactgcctgaaattctggaaaactcagtatggctactccaccgtcagaacttcctgagcaaagttagttgctctctcggctcactgttttgttttgttttgttttcctgcctcaggtttatttgtacaaatagcacaggaggaccagccccatgcagatggtagcccaggggcgggggtagggggtcacaccagtccttctgtcctcatgttggcagagatatctactctgaagcctttgtaggggcctgggcacctttgggagcctgagctggaactgaaggtggagctgcagcctgggccttggtttgatccttggccttggcctttggccggcacagcctgagccccttggcaatacgggcacgagcacgcttcccaagcttgggatgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggcccttcttgttgtgcttcttggcaaagtgcatgttcctcaggaacttggggtccacccccttaagagattcgtatctttgtgatcggggtttcttgataccatttctgtgccattttcgggactggttgtgtgtggtgtggttcttggacttcgccatgtctacaccttaagccgcggctcccgaagcacctagaaccggaagagttggctcactatttagcacacacacacgtctataatagtgctggccacttggggttggaattagtttatttatcagcatgttgtctcccagcacttggtgtgtgtgatatgcagtatgtatttgcagaatgaaaagtctgagggctgacatcatatttcccactgtgcccagaaagagcacagttagtccacatgagctaatgggggcaaagggaagtgaggagggagaatgtactgccttatcatgttttctattacttggctgaagtaaaacagtcccaagccgatagtaagatagtgggctggaaagtggcgacaggtaaaggtgcacctttcttcctggggatgtgatgtgcatatcactacagaaatgtctttcctgaggtgatttcatgactttgtgtgaatgtacacctgtgacctcacccctcaggacagttttgaactggttgctttctttttattgtttagatcgtctggtagaatcaacttccttgagaaaagccatagaaacagtgtatgcagcctatttgcccaaaaacacacacccattcctgtacctcaggtaatgtagcaccaaactcctcaaccaagactcacaaggaacagatgttctatcaggctctcctctttgaaagagatgagcatgctaatagtacaatc

SEQ ID NO: 105234 - DNA, 1122 bp, Homo sapiens
tatagtccagagctgacttatggaggatttctttctattatttctgggtctgctactaatttgtctatttcatatcctaattatccttgttttcattttgattgaaagggggagagcatagaaattgtggtaaaaggtagttttattttttatttgagatggagtcttgctctgtcacccaggctggagtgcagtggcacaatctcatctcattgcaacctccacctcccgcgttcaagcaattctcctgcctcagcctcccgagtagctgggattacaggtgtgcaccaccacgcccagctaatttttgtatttttagtagagatggattttaccatgttggccagtctggtcttgaactcccgacctcaggtgatcctctcactttggcctcccaaagtgttaggattacaggcctcagccactgcacccagcctaaagttagttttagattaagtgttttcatgttttcccttgcaaagtaataaactggtcaagttatcaccttgttccatctccatattaatcagggtccaaacaggagatagaaaccatgcaacaatttgagtagttgaataaagaattataaacaggagattagagtaataggggattagatagtaagaggtgaagagataggaacagcagatataaagaacaaccatttcctcctatggctgagataccatcccctcaccacactcccccacctactcactgagatgcagaccttattgaagagaatgtaactggcttgctgcgaggtaaagtcaatgaggcgctccccagtaccactctgaggggatgctggggaaaactgcccatgagaagagggcacatgctgctggccacttgtgctaaagaacttgaagtctgataggagtgcaccctaacctggcatagaaaccctttcttcctgctgagtccctctagcaccttatactggcaaagctttacattgcaaacctccattatcacagagcaagcaatgaaagatggactcagagctgaggcgataaattgatagctagcatagcctctaaactgacttttatgactacattttatggatagaaagtgttcttatatatattgtttctttacataataggggacttattc

SEQ ID NO: 105235 - DNA, 1050 bp, Homo sapiens
atcatgttggccaggatggtctcgatctcctgaccttgtgatccacccgcctcggcctccccaaatgctgggattacaggcgtgagccaccacgcccggccacttggcatgaatttaattcccgccataaacctgtgagataggtaattctgttatatccactttacaaatgaagagactgaggcaaagaaagatgatgtaacttacgcaaagctacacagctcttaagtagcagtgccaatatttgaacacactcagactcgatcctgaggttttgaccactgtgtcatctggcctcaaatcttctggccaccacatacaccatatgtgggctttttctccccctcccactatctaaggtaattgttctctcttattttcctgacagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccaggtcagggcgcttctcatccagctacttctctggggcctttgaaatgtgcccggccagacgtgagagcccagatttttgcctgttatttaggaactttctttgcaagtattacctggatagttttaacattttcttctttgaacctagttataaaggtattgtgctgttgttcctaggcttagagtcataaggcctgagctcacttcctcactttgcctccatctggaaccttagaccaacttcctaggaaaacgagctgtctgaaaacagaatagggtgcctcttcaatgtgctcttcactggagatgttcaggaggaggctactcccacctacacagggtgcagtggagggtctgggccccagggaggcagcaggaagagtggaaagagcggaggctctactgttggacagacctgggttaccagccgtgtgactagccttccctggcctccatatccccctcagtaatgaaggaatgtgtcatccccaaatccagggacagttaca

SEQ ID NO: 105236 - DNA, 1033 bp, Homo sapiens
ggtaatctgcttgtctcggcctcccaaagtgctgggattacaggcgtgaattactgcgcccggctgccttttatttctttctcttgactgactgcactggctagagcctccaatacaatgttgaatagaagtggtaagaatgggccaggcatggtggctcatgcctctaatcctagcactttgggagagtatggtgggcaggttacttgaggccaggagtttgagatcagcctggcgaacatggtgaaactctgtctctattaaaaatacaaaatatagttgggtgtggcagttcacgtctgtaatcccagctacttgggtggctgaggcatgagaatcacttgaacccaggaggcggaggttgcagtgagccaagaatgcaccactgcactccagcctgggcaacacacacacacacgaaaaacgaagtggtaaggatggaaatccttctcttcttcctgatctaagggggaaaggggaaagttacaaaacattcagtatgctgttagccatataggtttttttgtagatgcccattatgaggttgaggaagttccctctgttccttatttgctacagattttatttaggattggatgttgaatttttttcaaatgctttttttgcatctactgagataatcatatgatttttcttttatagtttgttaatatagtgaattacattgattttcttatgttaaaccaatctttgcattcctgggatgaactctgcttggttataatatataatcctttttatttattatgggatttgatttgctaaaatttttattataattattttatctgtgctcatgattgttactagtttatagttttcttttagtctttggtttttgtatcagggtaatgctggcctcatagaatgagttggtaagtatcccctccttttccattttctgaaagagttttgtgtagaattgatgttaaaattattgcttaatgtttggcagaactcaacagtgaagccatctgggcttggagattttcttcatgggaaggtttttaac

SEQ ID NO: 105237 - DNA, 1043 bp, Homo sapiens
aattaaaccaaaataggtataagaaagattaaaagtcagagcagatatcaatgaaatagaaaatagaaaaatctatgaaaccaaaagttagttctttgagaagatcaataaaattgataaacctctagccagactgaccaagttaaaaagaaaagcctgaaattaccaatattaggaatgagagaggttatgtcaccaagagatccatagataataaaagaataagaaatattataaataactttatgtcagtaaatttaaaaatttagattaaatgcgacaaatttcttcaaagaaacaaaataccaaagcttacctaagaagaaacagataacctgaatagctctatactattaaagaaatagaatttgcagttaaaaaccttcccatgaagaaaatctccaagcccagatggcttcactgttgagttctgccaaacattaagcaataattttaacatcaattctacacaaaactctttcagaaaatggaaaaggaggggatacttaccaactcattctatgaggccagcattaccctgatacaaaaaccaaagactaaaagaaaactataaactagtaacaatcatgagcacagataaaataattataataaaaattttagcaaatcaaatcccataataaataaaaaggattatatattataaccaagcagagttcatcccaggaatgcaaagattggtttaacataagaaaatcaatgtaattcactatattaacaaactataaaagaaaaatcatatgattatctcagtagatgcaaaaaaagcatttgaaaaaaattcaacatccaatcctaaataaaatctgtagcaaataaggaacagagggaacttcctcaacctcataatgggcatctacaaaaaaacctatatggctaacagcatactgaatgttttgtaactttcccctttcccccttagatcaggaagaagagaaggatttccatccttaccacttcgtttttcgtgtgtgtgtgtgttgcccaggctggagtgcagtggtgcattcttggctcactgc

SEQ ID NO: 105238 - DNA, 1074 bp, Homo sapiens
caatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgtgacagccattcttatacttctgttgtattcttcaaataaaatttccagccgggtgcggtggctcatggctgtaatcccagcactttgggaggctgaggtgggcagataacttggggtcaggagttcaaaaccagctggccaacatgatgaaaccccgtctctactaaaaaaatagaaaaattagccaggcgtggtggcgggtacctgtaatccaagctgctcaggaggctgaggcagaagaatcacttaaacccaagaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccatt

SEQ ID NO: 105239 - DNA, 1032 bp, Homo sapiens
ttttaagtgtttaggtctgcccccagtgcccagcccaatcaagtaacgtggtcacccagagtggcagataggagcacaaggcctgggaaagcactggagaaatgggatttgtttaaactatgacagcattatttcttgttcccttgtcctttttcctgcaagcaggaagggaacctgattggattaccccttctgattgacaactatgtgccccctttggagggactgcctatcttcattcttcgactagccactgaggtcagtgatcaagcagatactaagcatttcggtacatgcatgtgtgctggagggaaagggcaaatgaccaccctttgatctggaatgataaagatgataagggtgggatagctgaaggcctgctctcatccccactaatattcattcccagcaatattcagcagtcccatttacagttttaacgcctaaagtatcacatttcgttttttagctttaagtagtctgtgatctccgtttagaatgagaatgtttaaattcgtacctattttgaggtattgaatttctttggaccaggtgaattgggacgaagaaaaggaatgttttgaaagcctcagtaaagaatgcgctatgttctattccatccggaagcagtacatatctgaggagtcgaccctctcaggccagcaggtacagtggtgatgcacactggcaccccaggactaggacaggacctcatacaatctttaggagatgaaacttgcccatctctaaaatttcgggatttctttgtacccaacaaggttcaaacacaacagtcagcttttattcatgatttttacttccatctgctgatgtagaacatacctccagagtgacctcagaaattgtcaaatgtgaaaacacaagccatcacagtgagaaatgggaggttgagttagattgtctaaggctggagagtccatatactcccactgttagctctgaagtgtgtagccagtcttcagattctgggtcagttgcctcagtctctcttagcttttgccttactcttta

SEQ ID NO: 105240 - DNA, 1033 bp, Homo sapiens
atatcagtcaggatcagacatgatgttagctcctgctacaataaaaccattttctccctgaatgaaaacaaaggttccacaggagacagtcccacagagcagtggcttcttttcctccctttaaaacctcatgttggctggacacagtggctcacacctgtaatcccagcattttaggaggctgaggtgggaagatggcttaagcccaggagtttgaggctgtagagctatgatcacaccactgcccttcagcctgggtgacagagcaagaccttgtctctaaataaacaaacaaacaaaaaatcctcttgtgttcaggcctgtgggatcccctgagaggctagcccacaagatccacttcaaaagccctagataacaccaagtctttccagacccagtgcacatcccatcagccaggacaccagtgtatgttgggatgcaaacagggaggcttatgacatctaatgtgttttccagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataatttcttatttaattttattatgtatatattgtgtcagttcagatgccaaaaagaggtcttgaacatgtcacaggctctgatggcactgaccatggagaaagcttgatttgatcatctggtgtctacaataaccaaagctaattattaaggaaaaaaacttgaagaaagaaaatagtccttacttcatctataatg

SEQ ID NO: 105241 - DNA, 1050 bp, Homo sapiens
gcaagactccgtctcaaaacaaaaaaacaaaaacctcattatagatgaagtaaggactattttctttcttcaagtttttttccttaataattagctttggttattgtagacaccagatgatcaaatcaagctttctccatggtcagtgccatcagagcctgtgacatgttcaagacctctttttggcatctgaactgacacaatatatacataataaaattaaataagaaattatgttaagacacatctatttatttataatcaatccactgtgtataaaggaatactatcagaaggcaagtataagtcttaagtgctaccaacacttatgttggtacactttgtatatcacactttgatacaacactttgtatcggaatacagagaaagaagaacacatcccacagtgcataaataaccatatttaacacctctcaaagactttgtatagatcaggcaggttagcaagctgcaggatatttccatcttctgtgaaatgtttaggaggcagaatgtgtgagcgcaaggctttatagacaatgtgttccacagtccacttccaggagtttggaatggagccaggcacttcactctggaaaacacattagatgtcataagcctccctgtttgcatcccaacatacactggtgtcctggctgatgggatgtgcactgggtctggaaagacttggtgttatctagggcttttgaagtggatcttgtgggctagcctctcaggggatcccacaggcctgaacacaagaggattttttgtttgtttgtttatttagagacaaggtcttgctctgtcacccaggctgaagggcagtggtgtgatcatagctctacagcctcaaactcctgggcttaagccatcttcccacctcagcctcctaaaatgctgggattacaggtgtgagccactgtgtccagccaacatgaggttttaaagggaggaaaagaagccactgctctgtgggactgtctcctgtggaacctttgttttcattcagggagaaaatggttttattgtagcaggagctaacatcat

SEQ ID NO: 105242 - DNA, 1056 bp, Homo sapiens
agttgcactccatgattttaaaaaaacctcttggacagggtacctctaaaggtgaaactcaagtctttaaaagttctacattccagattgtttttccttgagaaggagacaaaagaagagggatgtggttgccatgatttgttttaaagtctcctataacaaaatgaacatgtcagtagccaattgtggttggcaaaagggtgtatttaatagaatctgcaggcagatttccaatctgcctgccctgccctaccctccccctttgggtttgtttgaggtttcattccacaaataagcagcagataaaatactttacaaggtacagcacagttgtattgaagaaaaaaaggacccaactcttactttaggagtattaggcctggacttcccctgccccatgcaataaagcaagttttatatacactccccatatttttttctaacattttcttatataaatttaaatattttacaaaaaaaggcttttttcctccaaacatataaatctgagtgaaacatagattccccacccgagaacttgtttcttcactaaaatataaatgttgtctgatattaagggtaaatgtcttttgaccactggagatcactgaagtctgaattgcaccgtggagaaggcacttgtgttttctgaggtctccagcaagtatctcagtgagcactcatagaattgctgtctgtcctccagaacccgtgccaaggcctccgagtgcccagttactgaggcagctggggaaaaacgttgagtaaacatgattctacaattacggagataaaaaataaaaacagcatggactggttctaccctagaatcaaactacaacaaaatccaaagtgttcattcatgtagattcaaaatgacttcattctgtcataaattataaaatacaaaggtggctgttttaatgacaaaactcaaaacagtactaaaaggggtttgtgtcaatggacaaaagtcagtccctctaggtagggccccaaggagcatcacccaggttgaagggtggttttcctactgctgggccagaagtgctgtcc

SEQ ID NO: 105243 - DNA, 1100 bp, Homo sapiens
gtctattctattcattttacccgaattattccagtttttctcatttttctacttctgacctcataataaaatgatcactgcagtcacactaattcccatagtaggaagatttcagcaggaatttgtagttagcctttgttagtgattatgtgtaattctcggacagaggagattttcatttttccaataagaatagtgacttttctgataactaatattaaaatcttgtttattccatggacttttcatctaaaccttctgagataggctgccaagaaaagacatgttggggccaggcgtggtggcccgcacccataatcccagcatttggagaggctgaggtggtggattgcttgagctcagaagtttgagaccagcctgggcaatgtggtgaaaacccgtctcttcaaaaaaaaaaaaaagagaaaagactttttgggttaaggcttattaatactaacttttgatattggtattatcttttctgttggacatcagttaggacacttgtgacatttcctggtgaatattttgttcaagaatgtcattttggtgttggcggtagatgagaacagggacatgggaaaaggcaggctgactagttaggaagctactacagtggtgagcctgaaccagttcagtagctgtcagcagtcttagagagagggtagggaatagatctgagagattgtccttaagcagcaaatttaaaaggaaacagatttagggggaatgggctggcatttatgtgtgaatacttcctagagtaggtaggttgttgtatagctggtatttgcagaaggtaaagtacccaggcaggaggtgtagaacaaagtgagctttgcaggactgtgggaaagctggcaaagacaaaagcaagcagcttccctggaccagaaggccaggagtggagcaactcttggttctggatggtgccttgcctattatgagagtgttttggaatgggatttcaaaacacacatgaagttactgagataagagacttaaacttttgaaaacaggaagggaaaggtggtttggagagtgagaaggaagaagtacatttggataatcaatagattgctgaggataacaattta

SEQ ID NO: 105244 - DNA, 1132 bp, Homo sapiens
tttagttctgggaaaatttcttgaatgattttgttactgatttttttcccctcccatatgctgtgttctctattttggaactcctattcagtcattcaacaaatgttgagtgagattctactatttaacatgcactattctaggcactgggatatttcagtgaataaattagtttagaaaaaaaaaattcctgcctgagaggcattctagtaggaagacatcagacaatattatatgatatgttagaaggtttgtgtgaatgcatttattatatgtgtttctctggctacttacagcagcataggggcaggcatggagtgggtagagagctagattttactaggacagtattaatggggcaggagaggtgagggagtatgtaagaaaatgattataatgatggaccttgaaattaaactggatgaagaggattcgggagatattcaggaacacatcaaggtatagtagaaagaagatgtaatctgtagattagtggtaccagtgtggttgaagggttgttggaattcgggtctagagagaatgacctggaaagatgaggaatagtggttagagagaggatacatggaactaaattgtgtagggattacaattgtctaatgatgagatctggtatatgactgtgggagtgagtagctgagggcaagaagggatagatagcaagatccttggaagggaggtgggttagtccattttttgcttcgctataaaggaatacctgaggctgggtaatttataaagaaaagatgtttgactgggcacagcagctcatgcctgtaatcccagcacttttggaggctgaggcaggtggttgaggtcaggagttgagaccagcctggccaacatggtgaaaccccaactctactaaaaatatacaaaaattagccgggcatggtggtgggtgcctgtagtcccagctacttgggaagctgaggcaggagggaggtggaggctgcagtgagccaagattgcgccactgcactccagccttgggtggcagagtgagactttgtctcaaaaaaaaaaaaaaggaaaaaagaaaaagaaaaagaaaagaggtttaaactggctcatggttctgcaagctgtagaggaagtatgttgtcagcatctg

SEQ ID NO: 105245 - DNA, 1126 bp, Homo sapiens
gtttgaaaaatttttaattgtttatgtactatatcatcacatatttagtttatgatctttttcatttgttttagatgtaaggctacgaaaacttgctggagagaaggaagaactactgtcacaggtaaaggcattcttattggagtgtaatataattttaacaaagttacatggtaaaatactggctaattgaaatgttcattaaaaaaatatgcttctttcaaacatcagtactcaagtgagatatgaaggatagataattcatattttacctctttgttattttctgttcttaaaacatttttttaaggacacatagtttaaggagtcatatagttttttacaaagcttgttatgaacacagcagtcccctgccctggctcctctgacctcgcccctgaccatttctgttaaatacttttagctgattcttgtgtactgtccttgtatctctgtataacatacttatgttgcatcttgattgttctgcttcaggcattctatattgacatccttttatggaagatgaggatttagctgtttttcatcctttgtccctgccacacacatacttattttccactcttatatcctcctaataaaggaacagtgtaattccagcctgcttgtgtcattaggaccctctaaacactactcacacagtggagccaggttgcattctaggatcatctccctcagaactattagtttcctctaaagttaatgttatggtttttctttgtatttgcttggttttctatcatcaatttagccacagaatctccaagagtagattaatcccactcagtattttcagatgcatctggtgttatttcagttccagtttgttgaatcttggtgcatctgacttgtccctttctaaactagtgacttgccctctcggtacatagatgtggtcacccttcattggcatctggagattttctttgcatgtgatttaggttgggttccctttttccggtgtctcatgcctttctccttatttattctcttattttggtacatcttccagtagcttcctgagaagagggtttgtggattgttaatttttcatgaccttgcaggcctgaagatgtcttcattctaccctctcacttgattaaaa

SEQ ID NO: 105246 - DNA, 1029 bp, Homo sapiens
tagaaagtggcaaaattcaaatgcgtatgaagttcacctgtgtaaagagaggctgtattctgtggtatcactgcgttctgaacaccagtctgttattaaaattataagagtaaaatttctgaaaatattgatgattcttcattttatgacccttacagatatatgttgttgcaattcttttcatctttcagaggctatgttgctgcttaattttgttttcttggggaacagagagcacatattgttcttataaaggcattatcggcttattattgtcttcctgtttcacatgcatgttactaaacaaggagttccccaaaccgcttgtattttatgaaaatgcatctttatgtgtttgtggcagtgctataatttcctgttatattgcatgtattcaattaacattttagatatcagactgatgacttaactctcatttaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggtaatgcttatcttgtattttctcttggggcagaaaataaaagcctgccacttacaaagtgatggaagattgcagcatacttatttaggaatgatgtttcagtcaaaactgaatggcccaaggaaattgacagaacaccatgagatatcaggccctggatgactctttttttatttaaaaaaatattttcttgaggaaaagcttatgtcttctgttaagtttctgaaaatagaatacaactcaagttttagcttcattttctatctcttaattgggactgtaattacagtgttacttatttcttctggttacaagtgactggaactcccgcaaagctccaaagactctcaataggatgattcattttttttctatgaacttctgaacggttcaagagaatccattttctaaataatt

SEQ ID NO: 105247 - DNA, 1026 bp, Homo sapiens
agtaaccaagtcattgaaagaaaactttgttcatattcatttattatatttttaaaaaacttttgcatgaatcattaaaatttgccacctcttattaatttactgtatattttactagttctaggtgaagcattgtgctaaaaaaattttaagtgatttataaaatattaaaagttgtatgattttaaatattataatttatatagctttttcctccatatatagccctgtccccatttgctacactgttattaacagaatttaatgccaagaaaatatttaacattagattgattactctagaccttcccccagtcccactatcccctgacctatttgcccttttcagtggttgggagtgggagttatgtttttgtactttgatttctctgcttttagtctggaatatacaaaagtgagtcacatttcatctgaatcctttgcgatttaagatacgtttgtgcatggttttatgcaatggttcattcctatgtcctgcaggatatctatgaccttaaggaccagatacaggatgtagaagggagatacatgcaggggcttaaagaactaaaggtatcagggcccattctgcagcccaagcatgctctgtatgcagaagtgttggcaatggtggctttgcaagttctgttaaccaactgcacatagctttactaacagtgtttgtctttcaagcatgtgcttaacctgcagtgcataggaatggtgaactttcaatctctgcttatgtttaaatgtgtagtacagtttttgaatattccgcagaagatatcatttacagttttttttttttcttttttatttttcttgtacagacaggatcttactgtgttgcccaggctggtctcaaattcctgggctcaagccatcctcctgccttggcctctcaaagtgctgggattacaggcatgagccacctcgcccagcctcctttacagttttaaaaccttgtaaaatacatgcatatccgtggtgtcttagccatacaaaattaaattggtcaaacac

SEQ ID NO: 105248 - DNA, 1083 bp, Homo sapiens
gctgcaaatagtatcttcacctttatcaactcaacagagtattagagaaagaagagattgataagcagttcagaaattaaaaaggggaagtgctgattagcatatcagttataaaattctaaaactgctttaagttaatctgatgtgctcacttaagtattgtttacaggatagcaaagataaacttagaaaataaccctcataaaaacgattttctttttggttattacgaattatagattttgataaggtatttgtgtcatgaaattttgcttagtatgcttgggcccttctctgtatacctggatacctgcaaagccaatctaaattgaccattgattacacatggtaacttcttcatctgaaacccacatcttcccccaaccaccctgccctgtttttagtttccacagcaaacatatttttaaagaaatgagacttagaagggtcatatttctctttctagccttcatctcgaaattctgcctcagcaacaacccctctaagtggaaactcatccagacgaggaagtggggacaccagcagcttaatagatccagacacttcattaagtgaattgcgggtaaactgaagtttttggttttctttttaaaagcagttttttgacttggtaatatactggaacttttaacctttaatgtgacttagtagaaagaaggaatatgatttctttttaaaaaataagtactgtacaaaagtgtgactcaagtgtttcagagcttgaaaggaaggagattagatagttcttttttctgtcctctttcctgtaaatttaatggtgttggaatttctgctaatttacaaatgccaaaaaaaacccactttgtaatgtatgtaaaagtaattctctcagaaacaactggccatgttttaaatggaaaatatgtgagtgtacaaagaactagattgtgggaattattagtcttttgagccttgatggtattcagctgcttgaatatagttatctctcagtttttcatagtaatagaagtgtaataatatttgggtaacagaaatacctgagataatgaaaagcttatttgactcattaagtctccatcc

SEQ ID NO: 105249 - DNA, 1015 bp, Homo sapiens
agagcttacattatagaaagagagcagacaataaataaatggataaataccgtagtgtcagggagtgataaatgctatgaagaaagatgaagtaatttctcaaatctctgagacttggtaaggggaaaaagaagatgtagaacatatatgggacacttactagaatttttttaaagactttgtggttggttgctattagagactggtggtcagggtatggcatggtagggagagagccctactcatactcttttgtgctgtttgattttttttttttttttggtcatgtgcatgtattactgagaaaacaaaaaatccttgatgtgggggaaaatattttggtgacatatttaacatgctttaatctaatctgaacttttttggctgagtgtactagtctttatctgtgtgtcctgtgtcctaataatgtttagaaataaaagtttttcgcttttggttttatcagacttttctttttgatatgtacaagctttttttgtattaacatttgcagtgctaaaactttatatgtagccttctttaatgtgttttaaataccttaaacagaaaatttacccaaaagttctaaacttttgagtaaacatagattgcttactcagtgtctcccttaggataaaaattaaagttgctgacattttatcttatgttaaactggaattttaatttcatttttaatatgtttatttttaggcttcaaacatcattgaacttggaaaactcaagatcacttttttcctcccaaaaaaagtcaacttgctaagcatctttactgatttttatctttgttcttttctagttggatgaaaaatctgacaaacagtatgctgaaaattatacaagagtgagtatgtaaattcctaagggaaattctcaaggtcaattaaacttgctatctgtaacttgttcattatttattttacaacaattggtctgatgtagctgctcttcctcccttcatctatttcctgtccttgaccctccaaaattccttcgg

SEQ ID NO: 105250 - DNA, 2227 bp, Homo sapiens
tttaccaacgatgacactgcaagcattgtgtcttctgatcgtgccagtcgtggacgaagggagagtgtggtgagcatgatttgcatgcaaagaaataagatgagttttaaatgacagcaatgcatgatcacatgaagtctgttggaaagtgaagtttgcatttgacaaaaagagcattttcctcaaatttagttatataaatattttgccttataaaacatgttgagaacacatattctctgtgggctgtgcaagctttcattaataatttgcctttttacatctcttaggagtgaatcattatttgaaaagtttttactttttcttctttgttgctgttttatgcacatacatgtgtgtgcagttcaccaaagacaaatttcttcagcaaaattaatgtttccatattgtataaaactcataactatggattacaaatcatgttaccattaattgctttctatattgttgtatttagatttaaccagtgtttatccacctgttaagacctgtaatccagtcagggtggctcatgcctataatcccagctacttgggagactgaggtgggaggattgcttgagcccaggagtttgaggctgcagtgagctatgattgcatcactgcactccagtgtgggtagcaaagtgagactgtgcctctcaaaagaaaaaaaaaaaaagacttgtgaacttaagaattgctaatgacaaaatttaaaaattctagtcttagacattcaattggataataattgtagaggcaacaaatagctatgttagaatacaaataatataatttcaggttattctttaatgaagctttaaattttacagaaaactgatgacatttttgttatatttaagaaattgatttggaaaatacattgttccggatggtatgtcagcttagagctagaataaagagcataagaggctgtaattcctttaagaaaaataggccatttaacatgagttatgtgaaagattataaacccgagttttcatagagaaggggaacattaaatgttggagagatttgttaccatacattcatttatttaattaaagccgttttagttccttagcaaagcaactaatgctcacgctcacaactgaaggagaaataatatgccacaacacctaaaaacaccttggaacgcagtggagtggaaagggcagggactttaaataatgatgcttgggcttgtatccacttctactacctgttagtgtgtaaatggcagtgtctttatttgtacattggggatgttaatactatctttgtaggtaggtttaatatatggattaaatggaatactatatagaaaatgcctatcaaaattctcaaataggtgccaataaatattaatatctataaatgcaatcattattattattattgtgaataaaaataccattgcttgattttatcagtccttagcaaaacttcatacttgtaagcctgttttatctctgtggatgggcttctgaattcccttccttgagaagtattttaaagcaaggcaaacagtcagctgaagtaaggaatagatgatgaatgaggttaaaaaaaaatcacttattttaaaattaaataaatgtttgtggagtacctgttgtattcaaagccctgtgttaagtgctaggaatactattttaagccagtcagactagatttctgactttatggaatttatatcctcgtgaaagagatggaaaataagctagtaaagaaacaaaaagaaagaaatgtcagggactgtgaagagaacagataatgtgatagggaacctggaggggtctatgtgtgtgggttaccctttggatggggtgattagagatgcttctctgagaaactgacctttgagctgagacctgaaatgtgaggagccagttgcttgaagagctgggaggggagcgttctaggccagtgccaaggcctaaggtgagggagaactggtgtgtttggggaactaaaaagaggccggtatagtttatttccttcattattttgtcttacatttcctggtctttgggaatataaaaaaaggggaactgtgtaaactgagaaaaggtgcagtaaacaccctgcaaataattctgcattcagcatatatattcttaacagagttgatagctataatgaattataaattttgagaattatagtagaggtatatactgacctagaaatgcctctgttcagggtgataaatatcttaaaca

SEQ ID NO: 105251 - DNA, 1083 bp, Homo sapiens
agtgctggtggggtcaatgtcatggtgctaactctatggcttgacagcttttctccaaaatagttaaggacacatgattttagtgtcatgtatactgcagaatgtgctgcctgtgcttaaaatatacaactttagggtattaaaaatgaacatattcctttcacagagggctgttggtagcccttgcttagaatcagtttttttttatctagagaagatagatttgcttgagtcctaccacactcacatacttttgtgagatggctgcttatggaaaggatattgtttttctttgggacagttatgatcttggcctctgatactaggatctaataaagcaagctgactagaaaagtaaaagcagtagctctgtgtaatgtgtgagctgtgaatttgttgctttcaagctgtttgttgtgttgtggcctgttctagtggactgggatcctgaggttttataacttaattttattgtagtagtaggcaaaatgctctttgtacctcagtttcctttcctgctctgtttcctcttttgagaagataaatgtgtacacgttaattctcccagtttcataacatgatggtgaaagaaaatactgtaaccaggggtgttttttaaaaaatgaagtgcaaggttgatagcaatttttgcatataaatgagtattaccgccttcagggttttcattctgggaggctatacacttatatcattctccaaaacttttttggtactgagtattgtgaaaacattaagtcattttcaaaacaaccttgaagctaaatagctaagtgatatttcctttgttccttaggcatcattgtacaatggtggattatataacccttatggtcctcgaactgtaagtctaaataggggaaggtggtgaagaggagggaaatgtgggtgggcacagtttactttcaaagaaaaagtcaaaaattaataaaaaagaaaaatatacaaagaaaaagtcatttaatctgacctggaattactctctaagctgtgatcaagtcattgagctagccagttgtgactctcacccaagctgtgataaaatgcctgctggaaatcatgatt

SEQ ID NO: 105252 - DNA, 1016 bp, Homo sapiens
catttagattatataattcattatatttcctttatcacataattatctatttgaccctctaaccatcaattcatcttagtttttgatacatttcaaaataagttgtaagcatccatatacttcagagtgggtacccttttaaaaaagcttacatataaaaatgtaaacacgtggcatgagaagaatgtaattatttaatgttagaatctcttgtttttttaaaggcatttgacacatcatacatttaagacacattaagtgtatggcacacagtacatttaaaataattttgtttaaaaaacctgcacacgcaacttaagtactcttatttttcatctctgattgggtttggtgaaaacttgaaaagtatgtcctcagatgacatcaggaaaagcaagatttaattcctttaaaaacatgctgtgttcttttagtgcatggattcattgactagtacaatttatctaattcaactaaggcactttgtccatggcttgttttgaagaacaggttttctaatctatttggaaaagagtgtttgtagagataacttggagcttatttatctggttctccaaaaatcagtctaagccaattaggagttggtcataaaatcactgaaaatatcataagaactgggtgagtgggatgtggccactgttttccacactcccggtaccatgaccctctttccctcagtgttttcttacttgccattccatatcctaacaataatgctcgaagaccaatgggacataaacatatttataattcatagaaaactgttccagctgtttcttatcccttacaattaatattcaaaacaatttctaattacttaagtttttcttatttcttgtgtttcttaactaccttaagcactcaggaattgctaatgaattatggagtataaaatcataaacttaagtcctctgcattcatgatggtgagaccaattcatctttgtttttgtttttgcttatttattttgtttttgtctcttagcagtcttcttc

SEQ ID NO: 105253 - DNA, 1074 bp, Homo sapiens
actgcagcctagaactcctggactcctgccacagtctcctgagtaggtaggaccacaggcatgtaccactacacccagctaatttggggttgggggaacaggtagagacaatgtcttgctatgttgtccaggatggtcttgaactcttggcctcaagtgatcctcctgcctcaacctcctgaaatgctgggattacaggcatgagacaccactcctggctaagggtataggtaacaagataattcatttccttctatagtcttccttacctaaaggtcaaaaagcaatcttttggaacaattaaaacaggactgagagaacaaagaacatgacattaaactgtcccagacagtactcttaacccaaattagtgaatccacagtatgtaatgctcaggaggaaaacaaccaacatggtatggattgcccagcataccataaatggtcaccttataaaagggtcccttgaagacaggattgtctcaatacctaacttttcctaggagtacacagccaagtacatatggggaaattaaggctagcaatactactaaataggtaaattggtagataagaaatctaatctaggtacgtactacttgcctgaaataagagagtgtggctagaagtgccctacctatcaagagccaaaggcaacagactgctctaggtaaaccatctcacatatatatagctgtattcccaatcaatgattaaaaactcattttacttttttttttttgaatatgcatctttttatacattactctgaatattttaagagatgtctatgtaatttagaaactcaggcaacctattgacaaaatattaacccaagaaaaacaagctataacttaaattccttggttaatgacataccataaaaaactaaccaaatcaaaccaaaatgtttggacataactgatgtcttaggtgtcctctaacactactggatgttttctatctagcaacttcacacctgccagctttgtgacatatgacataaaacacaatttgggcttgtgctcaacatgaagacaagtttctaacagtgttagaatgacaatgagtatat

SEQ ID NO: 105254 - DNA, 1165 bp, Homo sapiens
aggctggtctcgaacttttggtctcaagtgatcctcccaccttggcctcccaaagtgatgggattacatatgtgagccatcatgcccagctggtagtaatatatcttttcttaaaatgatgagccacccacctaacatatactcattgtcattctaacactgttagaaacttgtcttcatgttgagcacaagcccaaattgtgttttatgtcatatgtcacaaagctggcaggtgtgaagttgctagatagaaaacatccagtagtgttagaggacacctaagacatcagttatgtccaaacattttggtttgatttggttagttttttatggtatgtcattaaccaaggaatttaagttatagcttgtttttcttgggttaatattttgtcaataggttgcctgagtttctaaattacatagacatctcttaaaatattcagagtaatgtataaaaagatgcatattcaaaaaaaaaaaagtaaaatgagtttttaatcattgattgggaatacagctatatatatgtgagatggtttacctagagcagtctgttgcctttggctcttgataggtagggcacttctagccacactctcttatttcaggcaagtagtacgtacctagattagatttcttatctaccaatttacctatttagtagtattgctagccttaatttccccatatgtacttggctgtgtactcctaggaaaagttaggtattgagacaatcctgtcttcaagggacccttttataaggtgaccatttatggtatgctgggcaatccataccatgttggttgttttcctcctgagcattacatactgtggattcactaatttgggttaagagtactgtctgggacagtttaatgtcatgttctttgttctctcagtcctgttttaattgttccaaaagattgctttttgacctttaggtaaggaagactatagaaggaaatgaattatcttgttacctatacccttagccaggagtggtgtctcatgcctgtaatcccagcatttcaggaggttgaggcaggaggatcacttgaggccaagagttcaagaccatcctggacaacatagcaagacattgtctctacctgttcccccaaccccaaattagctgggtgtagtggtacatgcctgtggtcctacc

SEQ ID NO: 105255 - DNA, 1641 bp, Homo sapiens
tacccaaataatattgtgagttctaagttttcatcaaattatttgcttttaaaataatttttccattaagctgaattgttagacaacttttgtcctctgtagatggcctaaacactgacctaaatttccttgtggtttgctatataattttggagttatgcatttctcagccagttatttttaaaaacttaaggccgtgtactaagaggtctaatactttttgaacgtagtatttgatgtttgaacattagcagtacctgaatgtgaggtggatatatttatggtcttatgctgcattcttaggactttaggtttctccttttgtccaattaactttcatatactatctttttgaaaggtggcttaccagaagctatatgggctggaaatgttggtgtcagtgctatagacattatgtataaaaataaaaacagcaaaggtagttcaagactgtgaatggtaggattgggggagggaagattaaatcaaagttaggaatttagaattgaaacaatctgtgtctattagttttgtataatgattggattattaatagtgcagaacattagtagctgcttggtcattgctttatacattgaaatacaagaagacagtaaggtaaagatccaaaattagaaaatgaagtgatcttggccaggcacggtggctcacgcctttcatcccagcactttgggaggctgatgcagcagaatcacccaggagtttgagatcagcctgggcaaagtagtgagaccttgtatctactaaaaataaataaatacaaataaaataaattagctgggtgtggtgctgcatgcctgtggtctcagccagttgggaggctgaggtgggagctgtccgggaagtcgaggctgcagtgagcgttgattgtgccacagcataaaaacgaagaaaaagtgatcttgattgaatcagagcagtagggatacattgccttttctcattggtggagatttttactgttgcatgtatttagttactatttatataccagtagccttggtataattttaatgaatttaatttttaaaatatacttacaattttgtgttttattatttactattacactgtttaattctattgaagaacccatcaaaggatataactgggacactttggagtagagccagtacacccaaaaggaaagacactatggtgtgtagcccaggaaaatgtgtggtattagtgttatgcattcacttttgactttcagtgtccttgatatttgagtaataggtacattctaatagagattgacacttgctgaactttgttcactgtatgtactttctttctagtttgtttcctaatgaaaactttcaggcaagtttgacagttaaaatttctttaaaagattacaatagcaaattttggatttttttttaacttttaaagttaaaaaaaattttcttttttctctatggttatagcatcaaaaatttggaaatgagcccttactattttcacttttacctcctttgatgaatctttcttttctttacaacaatataaaggccaacttttacttattggggtgactttttttgtttgcccattgttctagtagaaattggtatgcccaaattatggattttcctaccagatagattcaacatt

SEQ ID NO: 105256 - DNA, 1018 bp, Homo sapiens
ttttatttttatacataatgtctatagcactgacaccaacatttccagcccatatagcttctggtaagccacctttcaaaaagatagtatatgaaagttaattggacaaaaggagaaacctaaagtcctaagaatgcagcataagaccataaatatatccacctcacattcaggtactgctaatgttcaaacatcaaatactacgttcaaaaagtattagacctcttagtacacggccttaagtttttaaaaataactggctgagaaatgcataactccaaaattatatagcaaaccacaaggaaatttaggtcagtgtttaggccatctacagaggacaaaagttgtctaacaattcagcttaatggaaaaattattttaaaagcaaataatttgatgaaaacttagaactcacaatattatttgggtaaaacagaaaaagttttatctcaattatatttcttttaaatgaaattagtagtgagccttcagacttgtttccaggaaagtctaaacatttaaactgtgttagatgtgcactcacagagagtaatgtactagaatctcctctaggatgtaaaacttttattaatttttacatttatacattgacgtttttaaatactgggagttttattctatcccatagtaacaaattttcaaaatcaacataatgaaattaaatactggagttatatcttaaatttgtttaatgatacaaatgccataaaaataaaatcatcctgattatatacattctggtatatagttattatcggtttaactgcagattccttttttgtttgcagatttgttttaaaggcccccaaatgttcaaattttgctggttctacctttaagttaaacaaatatataatcaaatttcctaaggccacatacaaatttataaataaccggcttaataacaactgtgtgaaaatacacactgcgaacattataatgaaaagcaaatgaaaaagccataaatacaagaagaggattattttcacagcctttg

SEQ ID NO: 105257 - DNA, 1019 bp, Homo sapiens
tttggtgtgagttggttgaaggtaaacaaaataaataaaaagaaaaagaaaaaaagaaaaaaattaaactgattcttctgctcatttatctttgtctctctggctgctttatctgtgagcccataaggagaagttggcatgtaatagttacaatacaaaatataaatggctaatgtttatagtaaaataaatgatgcatacacacacaatccacaataggattgtcagttactagaaggaaggaaattttcctatatttgtaatttcccctaattataatacctttttttgggtgggagtgtgatgttgggacatgaatagggaatgaaaaggaaggaagctcagaaatgagtccaactttgagtgcatactgtatatcagcactgtgctagggctttttacataggtttttatttcacattataagacagtattactgtctcaattttatagacatgtttataaagaattggtgaagtaaataacttgcatagtcattggcagaaccagtatttgaaggtatgagagagtgccacacctggtaatgtgctggaaggtgaaaggaccaggaagaaaaggacccacaccttcctgggcctcccattagtgttagtttagtcaactttccatgaacccaatgattctatttttaaactgggtgtctttcttaatcagtggtgattctgaaagagtaaatgcatgtcttgaagagtaaatacggtttttgaagttccttctaatttgaaactgaaggaatgactttggtgtcaacttagtaacaaatactatttgttgacagaaaagatggccaggtatattcatgggactgtggttttcttttaatagaaccattcatcctcccttcaggtgaacgtttaaaaacaaagagtatatttcattttcattaaatgtatcaaaacagcattttgaacaaatacatgtctttttttttttaaggcgttgtactgtttgtccagtctttagtgctttagtgctaataaggacttttgggataatga

SEQ ID NO: 105258 - DNA, 1132 bp, Homo sapiens
atgctaatctctgtatctttccaattttagtatatgtgctgccatagcgagcacagcttcaatttttaatagcaagttggatcaggattgtgggagaaaattctagcttgggcatagagatttacagactaacagtatggcccaggagagaatatagaatgaaaagagcaagaggtgaagcttgaaaactttggttatattaacatttaagatgctagcagggaaaaatgtgcttatgaaggatgctgaaggagagagatgagagaataaagaggaaaaccaggagacactagtattggagaaagctaagagatgagagttttaagaaagaatatgtgtttagtgatattgaaagtccagaaaagacagatgagataagaatagaaaaattctattgggtttggtagttagaggtcattagtgacttttgtgatgaacaatttcaataaggtgatatgagcagaagccagattgcagtcatttgaagagagtgagaagtgaagagggaggtgtgagaaagcttagctgtaaagagaagatagggtagaattggaccagggtgagattttttgcttgccttttaaagatcagagagactttgaacctagttatgatgaagagagtgaaccaatagaagtagagagcaaagacccagaagagagatcagatagttgggacaaagtcctggggaggacatcataaaatggagggtgtgtatgtgtgtgagtgtgtgtgacggggcttgggagggtttgactttcaacaacagaagaggcagctcttcagtagaaccacagggaaagtaagaaagaagggaagactgggaagtctgttagtggctttggagggtgtgaagcgaatgccttcttcagaccttaaaatgccttctgtcatgaaaacattggcacaggaggggaaatactaaaagtgtcagaactggaataatgaaagaagtgctgaactgataaggtcttgcagagaaactttttccattgataattcagatcatttacattatatatcttggaaataccttcctgttttgttgttgttttttaaataggctacacattgattggtacccattttgtttttaaaaaccttgtatggttcattgtgcagagcctctcct

SEQ ID NO: 105259 - DNA, 1424 bp, Homo sapiens
ccggggctcacacaatccgcccacctcggcctctggtcccaaagtgctagaattacaagcgtgagctaccatgctcggccaacccaacgtctttgccctatacaatgaaaatacaaaatacaaaatgagaacacaaaaaataaagcattacattgtaaaaatttaatttaattggtccaaaatatacttaaataaaatatgcatttcaataaaaatgtctacagtgaaagactttatgcattctgggaaacttcataacatgtagatagggccaacattcacagaggataagggcatttgtatccaatcacaatttgtagcaggtttcttattccaatctgcaagttacactgaacacatcatgagcatcacttcgggagaaaaccaattttgttggggaaaagaataagaaagctccagcctcaattttgagttcattacaacttctcaagagtatcaccaacagcctaaacagtacgagttcaaaaaagtaaacatgttaaggtgatatagtttagatgtctcttccaaatatcatgttgagatgtaatccccagtgttggaggtgaggcctggtgggaggtatttgggtcatcggggtggatccctcacgacgtggtgctttcaacacaacagtaagttctcgtgagatctggctgtcccccttgcgctctcgtttccactctcgccatatgatgtgcctgctcctgcttcaccttccaccatgagtaaaagctccctgaggcctccccagaagccaagtagatgccagtgccatgcttctacagcctgccaaaccataagccaattaaacctcttttctttataaatcacccagtcttgggcatttatagcaatgcaagaacagcctaaaacataagacaagcagataactctttagaaacctaaatacgttttcttgctgtctttatgttgaattctccatctacaacgggcagtcatgaagatggtcttcgtcaggacaacatggtcacaggactgggacaatccaggggaatgagagggagagtcaggggacaggggagagaaggcaatgcctcttgctgctttttcacattagagacaaactgtaacacacagtccatgggcctgcaatcttctccttttatcatctggcattaacacttgatgtagtcatcgactttattcaagaagtcctccttgtcctacaaatgatgttctgcagcttcaacattcagtggatcgtcaaaattcagaagattagtaaacaaataatttaatctccaaataacatcctttaatgatctcgtgggagcccagccagtgctgtcaatcgaatgtcctcagtaaactttagacatatttcccctatctctgatgttagggtaccagatcctggtcaggcatttcactttggaaggcaccacattgtatgcatcagg

SEQ ID NO: 105260 - DNA, 1096 bp, Homo sapiens
gaacctgccacctggagtcgatgtagctatgaggggccgtgtctcaccaccactgcccaggccaggcatggtgttgggcgccaggcctgcctcacctgtcttggggtgcccagggtaaaggcaggagtagcgctgacacctgtaagcaaactgaagtgcgatgacagtctcgaagggtctgggacgtcagccatagcatccggccccagtcagagggttctgtgagagacaagttgattgttaaagaggttgcagagcttgagcttatttaccttgtacatgtcaagagtatttcctgatctaaaaagcttcattgctttctgctgactgtaaccccagacgagggttactactagggtggaaaatttcagctcgaaactggacttcctgatgcatacaatgtggtgccttccaaagtgaaatgcctgaccaggatctggtaccctaacatcagagataggggaaatatgtctaaagtttactgaggacattcgattgacagcactggctgggctcccacgagatcattaaaggatgttatttggagattaaattatttgtttactaatcttctgaattttgacgatccactgaatgttgaagctgcagaacatcatttgtaggacaaggaggacttcttgaataaagtcgatgactacatcaagtgttaatgccagatgataaaaggagaagattgcaggcccatggactgtgtgttacagtttgtctctaatgtgaaaaagcagcaagaggcattgccttctctcccctgtcccctgactctccctctcattcccctggattgtcccagtcctgtgaccatgttgtcctgacgaagaccatcttcatgactgcccgttgtagatggagaattcaacataaagacagcaagaaaacgtatttaggtttctaaagagttatctgcttgtcttatgttttaggctgttcttgcattgctataaatgcccaagactgggtgatttataaagaaaagaggtttaattggcttatggtttggcaggctgtagaagcatggcactggcatctacttggcttctggggaggcctcagggagcttttactcatggtggaaggt

SEQ ID NO: 105261 - DNA, 1057 bp, Homo sapiens
cccaagctggagtgctgtggcgcaatcttggctcactacaacctccgcctcctaggttcaagtgattttcctgcctcagcctctagagtagctgggattacagacatgcaccaccctgctcggctaatttttgtatttttgatagagacagggtttcaccatgttggccaggctgcccagctatagtaattttaaatggttaagtagaatttctgctgatggcagctttctgaggctaatattataatacacacagattgctgtgggtagcatagtgaaaagaagtaggagttttagtaattagtataaaattaaatattctaaaatttattggaataatttggtagtgggaagaggtatttggtgactaatttctctgttaaaagtgaatatataaatgagcatgaaaattgcacaaagaaataccttaagttattatgtttttgtttacttcagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggtatgtttggtaaatcccctctcaacactgagttgcacagatgtattgtaaaaatgccgatttgacagagatatagacgtttactcattgaactagtttcagatgtttattatgagcaagatgttatagctagtctctaaaatagtgtgttagaataaaatatagttggatattatcaacagaaatcaaatatagagatgaatctctgaacaacacattttatttgagacagtagaattgtaatttgggcatacacacagactgcattggtctttggtatgtccaaagaacaaagaaaagattgaggtttttattagagaaatgttatgcattgttttgaaagaaaatgcattggcactagcgaagtttttgggagctggcatgctctgatttgtgagtgactgtggtaggtaaaactagtcttagagttatagcagttcgtttccgcagctacta

SEQ ID NO: 105262 - DNA, 1048 bp, Homo sapiens
cacatatgtctaggagaaatatattgtatctttcattcttatctttggcatatgaagatctttttgtatttagcacatatttcttacttttttaaaaaagaccgcatgccttgctagtgtagatgaaccataatttattcattttccgtaatttattttaccattttctattgacagatatttaggttgtttttagccttctacaaacactgctgtaatgaacaatacatatataagtctttgcattagttagtatctatacagaatgtattttcaaagtgtgactgtaagattgagactgaagttatgaaaagttaaaactatttcaatcccatgttggctttatttataatagaatttaacttatttcttgggcttgtggaaggggaaaggagctcttaattactttgtattctttatccatctctccatttaaaaaatattgcaaattattttataaggtacttaaaaacatttgagtgtcaggtgattaattttatttgtattggtaaaagtagaaatattgtggtttgaagactggtactgtcatatagaagcatttatatttgataatagttaaatggctacatcttaagtaggttgattgtttcagaattttatgaccagtatcaattaaaagcattgtgtatagtttaaattcttgccctgcataagtcggctactatattattagtcaggaaagaagtaaataatctacctccttttttcctttaccttccacatcctaatctatacataataaaataaacctctatggagtttgagatccaaaaatccttttgcaaactagagtgctatttgatggattactttctcaaggcaggaaggaggtacagattcaatctttattctgcaaagtttttgtaaacagaataaaggaggcttaggtttgatgttatataggttacttgtggccaggaggaggttcaggattctttgcctttttgaaatgagagagacactagagagaaaaaaaaaaaattacatactgaagggctatagtttgatgaagtcggaactcatgagt

SEQ ID NO: 105263 - DNA, 1519 bp, Homo sapiens
aaaaaaaaagaaaaaaaaaaccccaaaaaaacaaatgtttaaatgagcttcccaaactctgtggacaggtgtcttgtgagcttagatcctcataactgtcagtgaggctggtcaggttgtgggaacagcccaagtccctgggtctgttgactctagtcttgagcagccactccagttaatcccaaattctctagaaatacataattttctataagtgccatgaagtaggggtaaaatattgggaggcatcagtctaaacagcactgtacagaacatatccagtgatctttaaagaatatcattggccgcgggcttcgtttgtgaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcagttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgtggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccagtgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgagttagactttgtttttgacctaacatcccttccttaaatg

SEQ ID NO: 105264 - DNA, 1071 bp, Homo sapiens
gtatgcactgttacagatggtgtatggagatggtcactaccttcaaggatctcacagtttagtggatgaatcctcacaatacacctgtgaggtcggctgggaaagtactgtgtttttctttcttccagatgtgcaaactgaaggaaagtgacttactgaagggcattctacctctaggtgacagacctgggacctgcaccccagtcctctgactccaggtccaacactgtttcagcaataaccaagtgttttgtttttcagaaaacaatgtattatgtaaaatgtcaggaatataaattcaacttgttagaacttttattagattattgctggtgatggggtaatggaagtctaaatgtatgtattttaatccacacattctgttgggttttggttgcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgaggtaggagcatgacctttttgcctgtacaaaaatttcttccccttgttctctcattcatattactgtattgctttactcctgtgattggctaaactgttaattctctggatatatcctggttactaatggtatgtagtctgtggcattatctagttaaagactctcaatatctagttaagtaaagacagaggccctttggcaagactcagtaaaattttggagaagattgttgtctgtagccttctggttcttatattctgttcccctctcctttcgtagtccctctgttcaaggtcacttggacacccagtgtggagttcatcttctggctcatatcctctcctttattcctctct

SEQ ID NO: 105265 - DNA, 1005 bp, Homo sapiens
ctctgtcgcccaggctggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatagtaagatatttctaagccttccttttaaataattctgcatatgaacaaaatattaagcttgttttaccattattggaggttttgataaagagaaagtgaatgagatcccagagattttacctctgttaaggatgagcttccttgagttacagatctcggtagtgtttaagaagttaggatttacagcatgcctctctcaagcatgttttctagtgtctcagtctacaggttgcttccttgttttagtggtaaagacatatctaaccttctatgctttccttctgctttttaaatacctgcagacatctgtttcttatcattatatcagggtccaaatgcaagcatcctctcttctataataactatttcctgtggctgctgcttgtgaagcttttgattaagtatgtagggataagaaactattatattcagggtgacccaccttggccccactatgtcatcctgtttgcttgtgtttctatgcattggctatggaaatttcccactaggtattccaggtgataattcagagctaaggagaaatatccattccctttcaaatggtgccatcagtttgctgtgttttaaaataaaatatagttggccaggcgtggtggctcacgcctgtaatcccagcactttgggaggccaaggcgggtggatcacctgaggtcaggagttcgagatgagcctggccaacatgatgaaaccctgtctctactaaaaa

SEQ ID NO: 105266 - DNA, 1077 bp, Homo sapiens
ttaacaaaactagtgttattttgagaagtttgaaataggtagctttaggacaaatcaaagtaagtttaatgttttaggtattctaactgtgtaatttatcagtccaagatacagatttaaaaagtatagatagccttaaaagggtcaggtaaattaataaatctataaatagtaattgagaaaaactagtataattgtgggaggaggcaaagaagaaaaacaagggagtatagattaggatgatatcatcaatatagccgtattgtcccatagaatattctttgttgttattgtcaatgacagactattgcgtgaattaacaatcagaattaatcatataggaatttcctgtattatattactaaagttttattcttattgctatcatgtttgatttctagtctctcgcaatttttttatatagccaaattactgaatttttgtggtatgaaagaaagattatatcatttaccacaattcccaaataaattctttaaaacatttctaaacatgactttgaaaaccaggctaatttacttttgttatactgacaagaccaagcattggcctcaataatacaaataattacagatgtcctttattaatgaaaatttgtacaacttcttttggattaataacgtagaaaaatgtatacccactttggaagttatagagaaggaacaaaaccttaactcctggtctgcccaagattctgctttcctagttggactgggaatgtgttagtactcagaaaagtatgcatggggattaggcgtatgcaacaaaggggttgtaggaagtgagagaatgatagctagggtatcctcttttgtttctcctgccttatattaatagaaagaaagtgcttttagcagctaaaagcacctttgcttttgctagaggggcaaataatacggcatttctacccaaaagatttttctgttaagctaatatctttttgcttaacatttcttttttacttgtcttgtgttttgggaataaatgaagggtgttgataggtatcttgtatttctggtgagaaattaaatgcccatgttttatacagttaatgattag

SEQ ID NO: 105267 - DNA, 1073 bp, Homo sapiens
gggagaccaagcctcactctattacccaggctggagtgcagtggcaagcctcaactcactgcaacctcttcctcccgggttcaagtgattcccctgcctcagcttcccaagtagctgggaccacagatgcctgccaccacgcctggctcatttttgtatatttagtagagacggggtttcaccatttgttggccaggctggtctcgaactcctgacctcaagtgatccaccctcctcggcctcccacagtgtgggattacaggtgtgagccaccgcacccggcctgtcttaagtgattatttattttctccacattattatcagtgcagccatcattacagctctggaaagtacacttttttcttcttggatcttcatattctttaaggaacaaaatcatttgttgatgcaaatgttttaaataatgttaatgttttacatactaattattctctaattattgttgctgataccttaaggggaatgcaaatctgtattcaacatgtttttaaattttgaaaactttgtattttttgttttatactgaaaattacctgtaaatcattttatgttttaggagctccaaatggaccagcaggcaaagaaacatctgcaagaggagtttgatgcatctttagaggagaaagatcagtatatcagtgttctccaaactcaggtaaaagagtaaaagaaaaagtgtggaattttttggataaagaaaaatagagggggtttgatttggatatctgcaaggttgcaaaagttttttcttttttaagacctatttttaaaactttttgctttcctcaattttttttatttttaattttttttgagacagagtcttgctctttcaccctggctatagtgcagtggcgtgatcatagcttaactgcaatctcaaattcctgggctctagcaatcctccagcctctgcctccagagtggctgggaatacaggcatatgccaccacgcccagctaatttttaaattttttgtagagatggggtctcactatgtcgcccaggctggtctcaaacccctgggctcaagcgatccttccgccttggcc

SEQ ID NO: 105268 - DNA, 1454 bp, Homo sapiens
ggtgttgccagctgatccatcaagtgcagggtctgcaaaatatctcaagcagtgatattaggagcagtttagtggtggtcagaatcttgtagccttcagctgcatgactcctaaatgataatttctaatcttttggctaatttgttagtcctacaaaggcaatctagtctccaggcaagaagggggtttgtttgggaaatggcttttattgtctttgttttagactataaactataaactaagttctcccaaagttagttcagcctacacccaggaacgaacaatgacagcttaaaggttagaaccaagatggagtcggttagattagatctctttgactgtctcagtcataattttccaaaggcagtttcatattccttactgatgggcccttcttatgttgctttattgttagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggtaaaagagcagatgagttttgttctaatttaatctataaagttagatccacaggctccacagcatggcttgtacctccgggagaggagagtggatggaaagggcatttttgtttgccctggcctacataacaccaaaccttgagacttactgtgtacttttttccttctgcactgtaacatgtatataaattagataaatgtttagagttctcaaatgagaagaagctttattagagatggaaatgaatttaaaaattttttttaggaccttcatatggccgagaagactaaacttatcactcagttgcgtgatgcaaagaacttaattgaacagcttgaacaagataaggtaaaacaacaaaacctatgatactaaaatttgtcaagaggccccaacatttacttttggaaacagttggaaacattcatgcttgtttctgttttctaaaaattattgcagctttttccatgaaaaatctttaatttctagatttttgtaactactagcattagttttgtgtcatgtaaaactgattctctgatttcttgatcccagtcagcattatgatttgtagactagaataactgttgcaaaggaagtttatatttatagtacataactactttacagagaaaagttatttatagttaaggcattataaatgtgaatgatatcagtatgttctttcagataatatggaaacagattaatctctcagataagttgcctaacaaataaataaggggctgggcacagtggctcatgcctttaatctcagcactttgggaggctgaggcgggaggattgcttgaagccagaagttcaagatcaacctgggcagtaaagca

SEQ ID NO: 105269 - DNA, 1959 bp, Homo sapiens
aagtattgaaataattgttatgctgtacttagcaagaaatatcattttttctgccttttattttttgttttttaatttttaatttttttttgagacggagtctcactctgtcacccaggctggagtgcaatggcgtgatctcagctcacttcaacctctgccccctgggttcaagcaattctcctgcctcagcctcctgagtagctgggattacaggcatataccaccatgcctggctaatttttgtatttttagtagagacagggtttcgccatgttggccaggctggtctcgaactcctgatctcaggtgatccaccctccttggcctcccaaagtgctgggattatggacatgagtcaccatgcaccatgcccggcctttttctgccttttaaattaagttttatctgtgctgttgatgatgcagttttgttatgcaaatgttttagagtcttcacttctattcagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctggtaagaacttgagggttacttgttttatgttggaactcaaaagttatttaaagtgcttgaccagtatttttaaaaatgagttaaatattgataaaaattcttaactatagaggctcctaataagacacccatctgctcattagaggaggcagaggttggcaaactgtggcctgtgggccagatccagcccacagcctatttatgtacagcccttaggctaaggatgatttttacatttttaaatacttgaacaaaagaaaaatatatgacagagaccatatgtggtctacaaaacctaaaatatttatcatctggccccttacagaaaatgtgtgctgacagagtatcaaaattcagatttaaaattgtagaacttcccagtaggtacagcatggtacttattaaataattgctaccttatagatgctttagggtaaacaaaaagtctaagttatagtctgcttttaaagagaataatgaacacttcagtgttaatagcatgttttgacacaataaatgctgggctataaagtatagaaaccagcatagtattcaacaaggtacaaaatcgactaaagctaggaaaggagggatgtttgaaagaggagagagcaggatgaactgtgccttcacatcagtgaagatgtgagttttgaattggacctcaaataatcaatagaatgggcctaacaagagaggtgtgggcagcacacatttcagatgctacaatgccgtaaacaggcacagtgatcatagtgggtgtgtgaatcagctgaaaaccattcttgctgaagtgggaaatgcagttggattgtaaaggaactgactattgaaatcttaaaaggtaggtagctgagtttagactttgatatacagagtaacaggaaaccagtaataggaaggcataatgtgatgggagctagggttttatgtagaaaagaaatgaaataggaagtcaaacttagaagcaaagacagaaatccagtttgagggactgtgagctttagccgccttgctaggatggtggttctgggaaggagaagaaaggtagaatctgtagaatttggtatctgatcaactcagggaggcagaagaaaagtaaggactctaaattgactccaaagttttaagcttaggacacttaatgaatagtagtgtggaattagaataggaaatctaaatggggaagttgagaattggagtgaaatgatgggttttttagatacactgaatttgacccagtcatgagcttttcaaatggaattgagttgcaggaatttggaaataagaaattggaacatctttcaggagtcatcagcctaggatcgaagcctgtggttaa

SEQ ID NO: 105270 - DNA, 1029 bp, Homo sapiens
atactactgctagccattacttactttagtaatgctctgctctaagggctttgcttgtatttacttgtattgcatcctcacaagtgtatgaaataatactattatcttcattttacaaataagcaaacctaagaacatagaagttaagtaatttacctacatttatgcacagagaataagtatatactcaagatttaatccaggcattgtgactcagagtctgtgctcttaaccatatagaggtcttgagtttggcaatgagacataaatgagaaaaaaaaagttacctcatgaagtcataggaattgtggatagttttttgggggaatataagatatgtttcaagaaatggagaaggtaagatgaagactttgaaaaggtccttgaatttggcaaggatttgatttggaggatgcagttttgagaaatgattttataaaccagattttaaggtgttaaggaggggactgggtctctagacagagaaatagttgactatttcataagtatctccccatcttcttggacttattttatggataaagtgactggggaatttagttaatgaatttgttctcatcaaacctaagaaaacttccctttagagagagtagatggcatctttcagaatataatctttgaagactgacttgaagcagtttgagtgttgtaagacattggttcaacaggtttgctttcagtgaacagaaaatctaatgcatagcctcagcttctcatatcaagcctttccatttttagaactgctttctgttgactgttgtagccagtagagagaaaatgttggtcaggggattacatttcttttaaaattcagtgtacttaatgaggagatagaaactgattaataaatatcaagttgaaaagggtaaatgatgaaaaggtagacaaaatatatagttcatttacatgcggataaaattttctggtatatgttccagttaaacctttagtagaacagctttccttcccttgcttgcttctccaaaacacaggtatattttgtctttc

SEQ ID NO: 105271 - DNA, 1055 bp, Homo sapiens
aaaattatatttgtagtcataataattgagggctatgatgcaaagttgtaacaaactgtctctacattgaagataatgccttttacatctataatgaaagctagttttgcacacaaactgtatttcatttaatagtcttagttgagtctaaacagaactgttcaagtaggaagtgattcttagttcaaatgtaaaggtatatgccaattgaaagaaaacttccaattaagtactaaacataagaaaaggtcaatgtaaaggaagtaggatttctataaatagtctggctattggaaaattcaattgctctattaaatatttgttttattctttgttagatttaaaattcaaaggctaaatataagaactggccatgtgaaggaaacattaatatcattacagcttgctattaggattttagaagtagatatgtctacataaaactcttatctagaaaataaactctccaaatgcattttcaactgtgaagaaatttaattctgatattgctggtaattcttgatgtgaatattagtagacaaatcactaattcctttggctcacttattctggatgtcaaaatcagctcaagaacgttccccactacttttcttgggaaacagtctcttaagctgctcctcatatttttttctagatgaattgtggtgcctttcatatgttggaggacagaggaaatctgaatgtctttgattttaaacagaatgattgtttattttctttgttttatttttctgtttttgcatgctggcataaaaagaataattctgttataaaatactgagactgtgaatacagtggtgtaccgatttcaggatggtgtatcaacctgcagttcttaaatagtctcctctctagtagaaatgttaggcatagtttttgacgtatgagagcatagcattcttgttttgttaaaaatatgtattttagtggataaagaaaacaaaaaataagtttattggttataagcgcttctgtaattgttgatagtgtttctttctagttgttacttaagaacagatggtcatatcttctat

SEQ ID NO: 105272 - DNA, 1302 bp, Homo sapiens
ttaattattgtaataatacggcacattcaattttgtatgttcttctcccccatttagcattatgttattgacacttttacgtgttgctaaagttaatatattttaatggctgtgtcaaagtgcatgtacatcatttacttggttatcatttccttattgtttatcatctagattattatatatttttgttatactattgtgacaattttgagatatagcttattagatctttgaattttatcttaggataaattcttaaccatagacttttagtcttttttgttagctacttttaagtgatttaaatatatatagccattaaaaaagtaacccatgccacaatgttaatcctccctcccattaaaatgttttttcctacaattatgcaacatgaataaagtattttgcttagattagggaagtttctagagtatagtaacttttgtaaaccccgtttccctttcatgtaccttgtctttgctgaagttacttgttttatatgattggtggcatttaaaaacttggactaactcataacattctttgcttttttattgtcatgttgtgtttgtgcaggaaatatgttttttattcatttgtatagtataggtctgatacaccaaaagaaattcattagaacatatttatttgatgtttgaaggactctttaaaatagtttatctgtttaaataatgtgtaagatttatgcatttttatataacaaaccaaaatcacatgtgtatttaactgctttgttagttgctgataatttatgtaacaaaattttcttggagtcttaagtctcacaaaacatcttatttttgtgcatccacacatgccaataagtgaatcatggtgcctttcccaagccttgtatgaacaggactggggtaagggctattttttttcttatcatgggtacttagaataagctttacaaagaaaattccatgtttctcaggcaaaaaaaaaaaagtatgaatgaaagtagattttaagtatgccatgttagataaataatacgtacgtattttggcactaaatgaataactgctggaaaaatttattttaagtggcttttaaaatgcaattatttatgtctccaacaatgtcactattacttgaaaccatcagtaatttaaaaacacgtttctttggtgcgggattatatttctaatttaatcaatgtacttagctttagcttaatatttttcaacattagcctgatgttttcaaggtatttgatagataaatatgtatgtaaagtgtacatgaaaatttggggctgggcgcggtggctca

SEQ ID NO: 105273 - DNA, 1856 bp, Homo sapiens
tataggccgggcgtgatggctcatgcctgtaatgccagcactttgggaggccgaggcgggcggattacctgaggtcaggagtttgagaccagcctggccaacatggtgaaccccgtctctactaaaaatacaaaaattagctgggcatggtggcacacgcctgtaatcccagctattctggaggctgaggcaggagaattgcttgagcctgggaggcggaggttgcagtgagccaagattgtgccattgcactccagcctggctgacagagcgagactcttgtctcaaaacaaacaaacaacaacaacaaaaaacaaacaaaaaaaaccagttataaatccattacatgttagcataaatactttttcattctacctatattttccaaaataaggtttagtgtgaagaatggccttgttttacatttttgttatctcattgcttggcttaataaaatgcagctggattttcatgcctgtttctgcatttaatccgttgtgatgtattattttggttgaaatatgggaagaaaatctactcttacatagacacgtatttggaaaagggagaatctcacagatcctctgaaagggtctcaagaccccaggatctttggaccacatattgagaactgctgctgtagactttgattttatttgccaaagaggcttgatgattcagtgggaattctgataaaattctttttgttgctttttctgttaatttgcatttcattcattttgtagtgcatttcattcactcattttgtttgtttgtttttgctgggataaagacaggcattggcttacttactcattcttcatgtcattaaccagcttgttaggatcatcagttaatctagaggttaacagccttttcacacttctgcatttttgtttatttcctacactgggagtagaagtgggtcttgttaaccatatagtgaagtgttctctggggcagtgtaacaaaatagtaatgctgcatgaaacctcagaattctggcatttcttattataattgattaggatactcaggatgaggagtatcctaagaagtgctggagtagcaaaaacaatgccacattcttcctagctgtatctaaggattagttattttattcccttttcttactacttcagctatctttttgtgaaatattttctttgtcacttaatacctagcatatgcttggcagttggtaaacagctgctaagtatgtatttgatgactgaatggttggattattgagctacagattgtcaacctttctcatttaacccttatagagagcatttgtccatttttataattcccatggatgtgagtgaacctcatctgaactggaaagtgaggagctagcaataaagggtctgccctgcattttacttaactgacagaggatcatacttacagttcattaaagattgacctaaaagtatttttaaagtgtgtgtgtgtgtgtgtttttttttttaaataaaaattgcctgagatacattgaattttgctttggaagaacacagtgtgttcttgcaacattctgcggcagttcgtgcttagccttcctattgatgtgtgccgtgactgtggttttcccatgcactcttgcatgttggcagaagacttgtcagctgtgactgatgcacgctttatttctccccactcacttatcttttgttgggaatttgaaagataaattgtctagacattttgaacatacttttttagtacttacattaaaatcctagtttcactttggaaagggtagggaattcacttttagaatattagtaggctgtgggcaccatttctaggggttacaaggtcaggtgagatgtttctgggtagtaagt

SEQ ID NO: 105274 - DNA, 1026 bp, Homo sapiens
ttatttggttccctgacatggtactggaaagtgggagagagggttaaatttagatgaaaagaactgtgaaaccaaatccatcctactttcattgttgtatgatggataataaattgacttggacaaacttttagtggattaaacactaaaattcgactgtatatagaagaatatcctgaaatttactgactagattagaaaacttaattagcagaaaattatatctaaacaggaacttgtggcatggattttttgttgtttgaaaaggtgagaacattacatttatttttttatactgtgctggattctggaatttaaaaaatgaaaacagaaaattcactagtattgactacatagttttgttttattttacttaattgacaaaaggttttcatttaaactcttattttgctgaaagggtatcaaaactgtcttcagtttctccagagcctgattgaagatatttctgtgaattactcagaaatgctgagatgcaattttatatgctggataataatgaaaaggggctgatgacacctaagcattaaaagacattgtcataaccttttttcattcctccagcgtttaaaccttcaacacaaactaattaggcagtaagcactttgtttcagaatctttcccataattagtcactttacttgactgatttttttaagtgagggaactaatttcttgttagtagtaagcgttcattatttccgtattttctgtatgcttaacgttagaatttatagtaaaagaatatgtaaaacaaagataccatttttgtttccaacatatttgtatctaaggattatcatcttggggtttgcaggcaaatgccagtaaagttagaataggaatcttttttttttttttttgagagacagggtctcacttgtcacctaggctggagtgcagtggcacaatcactgctcactgaagccttgacctcccagacttaagtgatcctcccacctcagctgctcagagtagctcagactacaggtacaagccacggctcct

SEQ ID NO: 105275 - DNA, 1086 bp, Homo sapiens
gtagatgcctagaagtggaatattaactcaagcaaagattacatgtatttttaattgttgcctagttgctgtgaggtctgtggaagacaatttataccctgacaagcaatgtattagaatatatttccccccaataaagatggcattatctaactttatctttccaagtttatgttaaaaaaattaatatatataactcttagcagtatgataaatatttttttctatttatttggcgaaatccttgactcacttttctattgggctgttggtcttttatggatttgtagaagctctttgtttatagtgagaattaggcctttgcacatacgtccttttagccaaataattttctcagtttgttatttgttgactttatttacaacttgttttcgtagaaaattttttttttccttgtagttgaatttataaggcttttctttaaatgctatgtggatttttttttttaatttaaaaacacatgttcggtcctgagatcagtttttaaaaatttgattttttcttctggcacttttatggtttcattttttttttactgttaacatctttgatccaactgaaacttatttagtgtaaggagtgaggtaaggattcaacttaaatttttcccagatggctaccaaatggtctccaaatcatttatttagtaatccacatttctccttctgatatgccatattatcttttttttgtagagacggggtctgcctgttttgtccaggccagtcttgaactcctgggctcaagcaatcctcctgccttggcctcccaaagtgctgggattacaggcataagccaccatgccccacccatattatctttaatacacactaaattattaaagtattaaatgtgagtttttctttctgcattctctgtgctgttctattgctttgtctgaccatgtgcagctgtttaattttataatatgctgtttggtagcttcttattattactcttattttttgaaatagtgttggttattcttgcatgtttattttgtccagtgggctcccccattctgtttttttttaatatatattaactttttagatttatataatg

SEQ ID NO: 105276 - DNA, 1080 bp, Homo sapiens
cattggtctcccaaagtgttgggattacaggcgtaagccaccgcgcttggccacactttctttttaaaacatttaaaaaattttaacaatttctttcaatatttatatttctctttcattgttgatgttcagtataaccaacacactttcattaagcagtttgtttatccatccctcccacctggcagtaggctatgattagggacaaaaaaaggaaaagatagattaattgaagcagtgactgcataattcaagaagagagtgcataattcaagaagaatgtcgaaaatctcatcagactgagtgtacccagagctcaaggctgagaaaattttggctgacttgcattttacagaagaagaaataaaaatggccaagtaatttttattttaagtggaataatttcagtactaattttcagtccatacgatggcttaaaaaagagttaaattaaaaaacttcctgagctaacaaaaacaaccagaaagcagattgagatttttgttgaaagattttttaaaatagcataatttgaaagtttaaaacaaaaaatatttttcttcacttatgaaagccttttatataagttgccataaaaaagtgttagtgacaaaaatgtaatttgtttttgtatgaaattattatccgtaagataatatgtgtaactcaaaaatgctttccgtgtaaaaggataataaatagtattttagattttaatcttctttcttacgtgtattgttgttttcactcttagttgcatctggggccccgagaatttctagcagcagtgattcttgaaatgagttaacaagttctctacccagctctgtgggggcacatggatttacagtatgattgggtgtctgtggtcatgaaatttacacatatatgggcacatatttgttttctttgttgatccagaaaagaattaaagcattttacaagaattcttaaactgtaacagtacaacataaattaaaaatgggggcaagaaagttaaggaacaaagtgggaaataaatagtgctaaaaatgcctgtcataaggacctactctgagttttcatgctggggtaactgac

SEQ ID NO: 105277 - DNA, 5055 bp, Homo sapiens
ggagtctcgctttgttgcccaggctggagtgtagtggcatgatctcggctcactgcagcctctgcctcctgggttcaagggattccccaacctcagcctcccgagtagctgggactacagccgcatgctaccatgcccggctaatttttgtatgttttggtagagacagggctttgccatgttggtcaggctgggtctcaaactcccggcttcaagtgatctgctcacctcggcctcccaaactgttggactgtgccttgccataatcttttctttgttatatgattcctttagtaattgagcatagattctttgtcttttctagtgtttggtatgataattttgatcttcaggtaggtggtagacatcatgtctgtgtatcattgttagtagacaagtacgtactttaataaaaatgcatctgtttttaattaacagagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaagtaagttttatttcagcttgaatatttttatggcagtccttcttaattaagtctcctttttttgtgcctaatacagttattttaaattatttggataagtttcaccaacccaaaatattaaacataaatccaatatgttaaatatgaggagaaataaaaacaatttagggcaagtggcagtgttattccatgtccatttaggagagaaaaaccttttcttgcatataagattctggttattagggacatatccaagtaattattttctttttgttttgttgtttttagtattagcattattattatataacatagatgtgttttgaaaaaaaaattaaagtggaaaacaaaaattctctggtccccaggaccactactt

SEQ ID NO: 105278 - DNA, 2692 bp, Homo sapiens
tgaccataaaagaaactatcagtaagtaaaattaagttccataaggaacaattatatcagcagaggctataatttaagcttatcatttttgcagtggtggtaagtgcattaagtcattaaactggggaagaaataatccttgcccaataacattctctaatgggaacctgccctgcttggcaatgacttaccttaaggagagagggagcaggtaaaacaatctgaaagtattagctaattaattaccttgtaaagacacttttgctcagggagaggatacatttgatcactgttgagctagatgtctcattaaacatcttaaaatgcttatataaaattaaatttcatcaaaattaattggaatgagagttgttactgaaattgagatacaaatattaactcttgactaatgtgttttcttgtgtgtgttcatttttatttattagataaggcccaggaggtggaggctgaacttttagaaagccatcaagaagagacaaatcagttacttaaaaaaattgctgagaaagatgatgatctaaaacgaacagccaaaagatatgaagaaatccttgatgtttgtaccttatttcttctctctcacttttgaaatttagctgtaatagatttcatggtagtgccaaagatttccttttcaaatgtgttttttgaacgaaaagggtttttttttttgactcaatattattcaaattagtactgttatatgcagatttataaagttgagttgatttctgccaggattgtagtttcctgatgagattctgctaactaggcagcacagtccccttgctagtattgaagcaacagtagatactaaaaggaagaatagattctttcccatctgcctcacagattctgactgaactgtgaggggaaccagactaagaatcaagaccctgtgcttcggtgaagtctaagtaatgggatagtgagtgtgtatttaaatgtggctgcttaacttagctggaatctttctgggagggacaatcaactttactcttatctctacccagtgtgtggaggttgattggtctcaagagaagaaagctgggaaaaaatggaatgcataagccaaatcttttatatttagtggaaggttatttcaaaatacttactctactaatgccatgttgcaattcacagaatatgccactaatgcattgccattagcaaaataagataagccatgaagatacaccatgaagataaatcataaatgctagttagtactttggactaacatttgaaaatgttttcaaatgtaatacaatataaattgttcttggttgggttacagattctgtagttgctctaagccttatttcactatatgctaagaatcttttggtgattaagaattcataaatcaaagaatcatacctcagctgactatgtcagcagaagtctgagtcgggaacagattctaataattattttaaatgtaattgaaatggctagaattccaagatataacacatgcctataaatgccaccttttataattcttgagctttatatgtcattatgaaaagatttaaataatttcacattttcttatacttccatagaggatatatgtgctaaatgaaaaaaaaaaagtattatttcttgaatgcctagagagtgttggaagatacagtaaagctagtttagttctactttttttttttctgtttttgtttttcagaaggaaaagccagttcagtgtagttaagtaatttccctaaaactacatagtggtagagcagtgattcttcattagctttacacattttataaaaaaagacttcttcctaagaaaggaacttagagaaggcagttatttatcatggataattaagtcagggagattcatttgcagggagtaaattgtgccatagctctagaattcccttttgtgaactatttctttgtctcgggatgtgtggggtagcagatggtagacttttctagactcatgacagaccttttaggtagaagggtgagggaacagagagacaggttaccgtataccctttgacatggttcctccttaaaaatctgctgtattttagggaagttaatgaaattgtccttcaagcttcaggctttgagtagtacagcaagtggacaggaagtggagggtgggcaagggagtggcatggactcttttccaagttccttcctgtgccttggaccagcactgccactggaaatataatgcaagccggccaggcacggtggctcatgcctgtaattccagcactttgggaggccaaggcgggtggatcacctgaagtcaggagttcaagaccagcctggccaacatggtgaaactccatctctactaaaaataaaaaaaattagccaggtgtggtggcatgtgcttgtaatcccagctactcagaggaggatgaggcaggagaatcgcttgaacctggaaggtggaagttgcagtgagccgagattgtgccactgcactccagcctgggcgacagagtgagactccgtctcaaaaaaaaaaaaaaaaaaatgcaagccacaaatatgagccatattgtaatttaaagttttctagtagccacatttaaaaaaaaaggaaacaggtgaacttaattttaataatatatgctaccaatgcgatataaccaaaatactatcatttcaacatgtagtcaatattaaaaatata

SEQ ID NO: 105279 - DNA, 1306 bp, Homo sapiens
gtcgtgagaatctggcccagtgcctggcacatacgagcacttgataaatttgaaggaggcaacacatggtaggcagggaagaattcatttgggagaagggcatggtgacttgcaagttggagactcacaagtaggggtgcttaccaaatagcctaatcccaatctcagagcagtctcacttgcagagtagctcgtaaggctatattagatacaaaattggtttctttttaacattgactgtattttagtgattttgttttggcataataactagtcttcaaaacataacctgttatgtatatacataaagattcaacttagtttttcttagtgtttttacttcaaagcaacaatatactttttttttaaatcttaaaataagactagaaggcttttataaaggaaattacataactgttccttaaattagaaatgacacatcaaagattcttttctaattattgggggggcttgctttagattagtatcccacagatgtcaaaggaaatgtcagacatagctaattgtcatattagaaactgagcctgactaaataagtagctatagaggttattctttcaaacaaggctaaaccacattgacacagccatacaagaaatgtcaacaaaccaagacagagaacagtgatgcatttacaacaattttcggttgatggtgttttagaggtggaggccaaattcacgtgtgcctcggtgggaagatatctaagatatctaaggatatctagtagagatctctgctgtacttatgttgagaaaagggatttgtttttgcaattaagtctaagaaaatttcatgacaagtggtatttaaaattagattttctaaatgtcgtatgattcattgccttattttgtgccatagggcctaactatgtttgcatttgtttttgagaatggtgtttctgtttttggtaagtcaatgtctattaaatcagatacctgtttgtggttatttttcctgttaagtctcttgctcagcaaacacttgccctcattactcaaatcagatcaatattccaattccaaatattattttagcacaaaggttattgcagggtttataagaataaagagaagtctgggttgccctgtacaataaatcatggcaatgaccaagacaaatgagggaatgtaaggatggaaaacagccttttaccagggcagtcaagacaagagaggacaatttgtatgccaaattttataagtaggaatattggatcagtaagtcacatattgctctttctaattcagcctcgtctgttttttgcagtttgagacaaagg

SEQ ID NO: 105280 - DNA, 1994 bp, Homo sapiens
tgccatctggttgggtagtgctctgtataaaaatacctactactttattttaatgactattttctagaaatcaaattccaatatagaaaatgctgaagtcttaaaacacaggatacgtattgtagttctatcacaattctgttatatatctaattgttgcttaaacctgggaaccctagtttaaggggaaataaacagcttgatgagctttttgggatgaggagagagggagtgagggtgagaaaaatgatatcctaggaataatgagcattggaaagggcttggagtttaaagtgaggcatgaaggaaagtgtttagagcacaataatgaattaaaataaaaacagtagtgtgtgtctcaaaaacttaaatgtttatttccctacagaggtagttttctctataccatgttgcctctccagagtgcttttttgatgtgtttgtttactaatgcttcttttttttcttttcctttttttctttttttttaaatcctaaaggctcgtgaagaagaaatgactgcaaaagtaagggacctgcagactcaacttgaggagctgcagaagaaataccagcaaaagctagagcaggaggagaaccctggcaatgataatgtgagaggagtttgagtttgctgcacatgtttcttgaaaacattgtcatttctgtgatttgactagcctactaacatacatacatatttatctcatttaatcctaatgaaaaccctttgagatttttacctccgttttatagacagataaactaaatgttcaaagagattaaataaaatgttcaagctcacacaataagtgttgtggtgaggatttaagccaaatctactagacctcaaagcctaggcattttgttattaccagtgcttctccatcttttccatggaaacaatagcagaggaaagtgaatcttataaccctggagcatagctaaaaatggtccattgtaaatgtgatacttttagatttttggatttttgtgctaaaaattcacgttaattttatatcctactctataatacatccttagttgtagtcacataaaagtggtgtttttagttgtatatcattaagaaaaacaatttctatctttgttttggccagtggaccagatgcaaatacaatgcaatgatttgggaaaattggactgaattcaaagagaactggcctgaagatctaagcttttttttttttttttctttttaagtcctaatccttaagtaaaattgacactatgaaaggtagaccatgtttactccatggcttcttgtcctgctgtgcacctcagcagcacacacccacagttggggaaggctggcactgtacgtttctactgcctaaaatgttctcactcatccaggatggtcttttcatagcccagtcatgggggtaatgggaaagtgggtggtcactatgactttatcctggagaggattcgttacagaatgtcagttaccaggtaacaattttttacaccaccagttacatggatgacttacccgcagtgcagagaaagagcctctataaagagctttgctactctgtgtcacttggtaggcatatgtcaggtgtaagcactgagcaagctgagaggaccattttctgtttctttaatagctaagttagttctgtttaaattttctttactttctttttttctttttttgccatttagtcatgtagtcatgacttgagtattccaggtgctattatatattacttcttttgagaaaatacatgtatttaactgtctaacatgagcgtttccttagtatcaaagtattaatattgcatatagtaacattttaacttgtgtcaggatgccatagaatattgaaacattatgaaataagaaggacttctgagtcctttaccttgtgtcctaagaaaggtaagaaaatagccttaatttggccgggagaggtagctcatgcctgtaatcccagcactttgggaggccgaggtgggcagatcacctga

SEQ ID NO: 105281 - DNA, 1052 bp, Homo sapiens
gcctgaccaacatggagaaaccccatctctgctaaaaatacaaaaaaaaaaaaaaattagctgggcatggtggcgcatgcctgtggtcccagctacttgggaggctgaggcaggagaatcgcttgaacccgggaaggaggttgcagtgagccgagatcgtgccattgcactccaccctgggcaacaagaagagcaaaagaaagagagaaagagagagagagagaaagagaaagagaaagaaagagagaaagagagagaaagaaaacttaatttttatttctactcaacatttttttttctcctttattcttcataaatttgtatccttctggagcatcttctggtgcttctgtatatcttaaattgcaatatgtatttagagtataatattttgtaaaacaaaacagaacatttgtttagaagcacatatttaaagttgccttacctcaagtctgaccactcccttgagactcttaaccctgacttcctttttccttatatctttatattgctttgttttactgtttcttatagctattattgtatacactcatgttttttctttccattttttcaggtaacaattatggagctacaggtaaggctagttcttctttttttttttttcttttttttctttgagacagattctcactctgttgcccaggctgttgcccaggctggagtgcagtgatgcaatcttggctcactgcaacctctgcctcctgagttcaggtattctcatgccttagtctcccaaatagctgggactacaggtatgtgccaccacgcccggccaattttttttttaatttttgtatttttagtagagatggggttttgccatgttggccaggctggtctcaaactcctgagctcaggcagttcccctgcctcggctttccaaagtgctaggattacaggccccagccaagactagttattctttgaatttgtctgaaagtcatgcattttaggggtattcagtgttataagttaaaacttaaaaagactaacaaaaatttccaagcagtgcagaaatgtgtctgggc

SEQ ID NO: 105282 - DNA, 1188 bp, Homo sapiens
attattgatggacaatatatgtaagtcagtttaaataggaccatgtgtgtacaccttcaaggatgcacagtacacccataccaggatatgtggtatatgatctttagtaaagtctttttctaaactctgggagaaatagtggctcaaatcagcaggctaagtttgaaggctaaatctcctgggattttcccagttcttttaaaattcatacagacaaaaatcttgataattgttagaactgagtgatggatgggtatatgagcattaattgtactatattttcttggaatatgtttgaaatttttcataatatttctaaaatttcataaagataggtcccaatgtgactttatttttttgtttcactagtgatttagcttttcccatctattctcaagattactgctttaaaattcttaagatcaaatcttgaaaactgccctagcataacagtttttgtattagttatttttactgtgggaatatacacattaaaagttaacattttaatcattttagagtacacagttcattgacatttagttcatttacagtgttgtgaaaccatcactgttacccagttccagaatatttcatcaccccaagaggaaactccatacccattaagcagtcactccccattacctcctccccgtaacacctagcaaccactaatctgcttcctgtctctatggatttgcctattctgggtatttcatataaatggaataataacaatacttgaccttttatgttaggcttttttttttttttttttgagttggagtctgtctctgtcatccaggctggagtgtagtggcacgatctaggctcactgcaagctccgcctcccggattcacaccattctcctgcctcagcctgctgagtagctgggactacaggtgcctgccaccacgcccggctaatttttttgtatttttagtagagacggggtttcaccatgttagccaggatggtttcgatctcctgacctcatgatctgcctgcctcagcctcccaaagtgctgggattacaggcatgagccaccgtgcccggcctgtgtcgggctttttttcagcttagcgtgatgtttcaagattcatccatcttaatagcatatatcagtatttaatttcttgttatggctgaataatataccatcgtatggatatactacattttgttt

SEQ ID NO: 105283 - DNA, 1046 bp, Homo sapiens
gaaacatcttttcattggcttgttggccatttatatgtcttctttagagcaatgtctactcaagtcctttgtccattttttagttggattgtcttgttgagttgtaaatgctctttatatgtactagagacaagtcccttatcagatatttgatttgcaaatattttctcccattctgtagcttgtctttttacttcattgatagtgtctgttgatgtacaaaagtttctaattttagcaaagtgtaatttatgtatttttttcttttattctgtgttcttttggtatcatatctaagaaatctttagttttagttttttttttcgcagaaacaattcttgctctaaaccatttgtcttaattttatttgcctatattctgtcttcagcattaaaaaaccttgtggtgacagcaatctttctttttcttacatacagtttccctgtgaatcttatatggtctgattatttgttatttttagattcacaatttagaagaccgtttgaagaaatatgaaaagaatgtatatgcaacaactgtggggacaccttacaaaggtaaggatgatctcgtgtcatgttattaactgttatcttttattggtggatttgtgcatgatttttatttttgtttttgctaatttatatttttttctcattttaaaatttttaatgattttattttttcttaattgacaaatgcatatatgtatagtgtgcaacatgctattttgagttatagattcattgtggaatggttaaactaagtgcattacctgacatactaccttttttgtgtgtgtgtgatgagaacactttaaaatctactcttttcacagttttcaagaatacaataaattgggtggggaataatacaatacattaactgtagtcaaccgtattttacaatagatctcttgaacttattcttccttattgaactgaaattttgtatcctttggacagcatctcccaccccccacagtcccttataaccaccagtttacccggcttgagttcagctttttagattccacatgtaagtga

SEQ ID NO: 105284 - DNA, 1026 bp, Homo sapiens
agtctccattgtttcacatcctcaccagtgctttgtattgtctgacttttaagattctgctcatcagacatatgtaaatgacacataacacagtttgttttcacagaacaaatggttatttaaattctaaacccaaagtaatgtacaattacaataaaaggccagaagaaagaggaggaaggaaaaagatgtgagaaataaaattgttatagtaattcttgttttcgcttccaagcataaaatagtaattggaatgtttagtgtgcatgtgtgtatacaatgcaatatgatacaatataaaagcatgcctctctttgttccattggttgttttttaaatctatttttataagtaataagtagtttacctggttttgtctttacagtttgatctatttttttatttggcaggtggcaatttgtaccatacggatgtctcactctttggagaacctaccgaatttgagtatttgcgaaaagtgctttttgagtatatgatgggtcgtgagactaaggtataaatcatgtctcgtgatttggtgtgtggcttaattttaaaagaaatatgttccacttttaatacacatgtgaatgccatatgtttactattagcaaatcagacatgctaatagtaggtaatagataattattttattgctcttagtttacaaagtgaattggtggatcttgcttatatttattacatttataaaacattaattttgaaaatactattgggtaacactgaacgctaaacattaaaatttcattaacataagaataatttgtgaaccatgtggctttttttcttcttcatatctttaagttagaagaatagatttcattttcaaggagactttaggatattatggataatattggaaatagtcataattattagctacctagagagatttagaaacattatgctttatagttactgtaagaaaatccttctgcacttgtggaatatcgatcatttaaaaattaccccatgtaagtaataatgcttggctaatttgttttc

SEQ ID NO: 105285 - DNA, 2718 bp, Homo sapiens
ggagttgctgagtcataggatactaagcaggttcaagcactgatttggcaaatatatttaaaacctaaaaagcaaatatcttaaaataatattataaaaggaaatatcttaaaagaatatgataaatgtatagattggagattcagctaaataccaggagtgggttagaagtcatttgaatccttaatatctgtagaaatcacatttcattatatcaagttaaagtaatatctaatattgtgaacaggtatcacagaagggagatattaaatcacagcaattcagtgtctttttttttcctcaatgccatttttcaaaaagttcaagggtagctaaaactaattttctccttatcttttaaaaacaaaactaacgaaatacagctttctcttattatgtccctatgggacatacactatctcacctcaaatacagggtatattatgtccctgtggggggatatttgaggtgggatagatagtttaaagttaccttgttattgtattgggggtggggaggagaggcatatctttaaaaaacaaaaagcttctcagaactttagctaccttggctcattagtgaatctaaagctatgatgcaaggttgttactaaataatttatttagctttttcttgatctgtaaaatggagagacagactgccttaacctgtttcttctgaaggttatgaatgtatgtgagatgagatagctacggagcttaactaccctgaagaaagacctagcataagcataagcataagaggcttatggggcagtaccagttcatccaagtctaagcttgtgcttcagggctctgcagttaatcttagagtgtgacttgggaagtagctgaaagggatgtcccatggcacaagcagccccatctaataagctggctgggaatttgtgttgaggagtagtgctctctctcctctttatcttcagcgtcgattctccttttctggctctaaaaatgaagagtagtctatcattctgccatcacattttataggcaaatagaaaattggtactaggtatttacttttaagttgctgcacatttattgagcatggccctttatcaccatggtagatagcaagatgacatttgataccatctctaactttaaggcgttcactgtgcagtaaggaagggaactgttctcattaaccataatgtgatgatgaatgcagtaagtgctgtaagacagaaacagagtcctcatatttacctgtgagaagatcaaggagaacatcatggaggaggtggtgtgtatactgggatttaagaggagatgttagattttgatagataagcccagatggtggaggggtagcccagacaggtttcaggcaggaaacatagtgtgggtttttgaaatcacaagtagcctggtccaactaaaacgctggattgatgaaggggaagtaatttaacttaaggctgcacagagaatgcagggccttgaatgttttcagagttttacctgtaggtattgggagggggtagccctgaaaattttcaagtagggatttacaagatcagagctgtttttagacatgtcttttgtgggtttgcccaatttctatacattaacaaagaatttgaaatggagaccaggttgcggttttagaataagtcggagtatgttgtgctctttgtgatttgattaccatctgcagttgtttcttgtctagcaggattcatatgtcttctcacctgtgtttcttcgtctgcttttgtacacagtgttctttattttatgaggcagatgactttttaaaagaagactatatatagtacatacgttcttgtagtatggagttaagtaagttcccttccttccttctgtccgtatactttctttttcttgggttttgatcctccatgctaatgctgaacctgaaattcagcctgttctccttttcaacataaagtgtttctcatcctaagctttattgaagatgcctctccctaaggaatacctggcaggagagatcacttgtaaatcaggtggctcatttgaacttttccttacttcccagggcctgaggatattgtatgtagagtagacagtctgatatcttttccaaggtgtggcaaagagcctgggcttctccattaaagtgttttctggcaagccagggatgagctttaactcttcactgggtaatgagctgcagattcactgatgaatttagaggtgggtttaccatttaatgttgtctagaaacacgaagagacaactagccacagctatattttttccccaaacatgcttgtgcatgcatgtatatgttgtttcttagtaaatataaatggactttttggtacttggagctttatgtggtgttgatattagagaaatgcttcctataattctgaatccctgaattttagattttttggtacttataaaaaaacctttatagatagtataccagaaactgcttcaggttattattaaaaagaaaaaactgaaatggttactacttcatatttctctttccatttcatgccacatgtttacaggcataccttggaggtattacgggttcagttctagaccactgcaataaatgaatatcacaataaagcaaatcacacaaattattttggtttcccagtgcatataaagttacatttatactatactgtagcctattaagtgttcaataggcattttgtctcaaaaaagtatataccttaatttaaaa

SEQ ID NO: 105286 - DNA, 1607 bp, Homo sapiens
taatgaccttccccagatcacttccactcttctcccttcccccatatgcaaagtctatgtaactatgatcaaggaatgttagagtcagttttctgggctaccctcccatccacggtaggaatctttagaatactaccacctgattttgtatgtaagcactgaagttgttatcctacttatttcataagtggtatcttctttcctctctgtctccctcaaaacatctcatcttgatacaaaatagggagtttcaacctttgaggagaattttccaggagcttatgggtgacagtctgacttacggtatatttatttagatgtgcacaatttatgatcttgttttgcaagccatgtgtaatgtttcgattcatcatgttttctaccaaataaaacatcttgtgtttatttaaaatgtaatttgtatttctattaggttgatgtgctgcatgtcttgaaaaatacctactgagcatgttcatgttcatgcagtagccgtgtttatgagatatatgatgtgatttagttaaagctgaacatggggggtatttaaaatctgattatttagaacatatgttttggcaatacatcacttactagatagatttctgcaaataagccttttaaaatgaatatgtaataaagttttatttaaataaaggggccaagagcattagaattttatatagcttcatgctattgtaaatgcatcttgttaaaataatatgtgtagacattgtaaggagtccttttaaattgaaattctagtgttgttatttccttgactaataccttcacatcatacttctttgttcgtggctttcattgagagcactaaagaatcccaccagcagaacatgtcagaatgggttgagactttatatgcttcactgtctgttagtgatcatctcttgtttttcttgtagaccatggcaaaagttataaccaccgtactgaagttccctgatgatcagactcagaaaattttggaaagagaagatgctcggctgatggtaagttctggaagtgggctctagatagaagatgatttcccatctgtttatattctgtctcatttataaggacttttgagttggtaaaataaattttaagatttcaaatctttattatatcacagcctgaaaaatgagagtgaatttacactaagaaatttaaccaagggtaaatgtgaatggatgccctcaagggaaggaagagtctaatttaataccatataagagcttgacacccgtatgtatgctatatgacatttccagaacttgggctgtttatggaaaggatggaaaagacatttgttctggtatatccagtaataattttttaaaccaaattatatcatcatgttagatgatttatatattacagttctttattgcattccagttgatttccaaatacattaattctgggtgaaagaatttaagcattcttgagcttttgataccttatgggggcaatcagacaaacaatgaattatttttaaaaacatagtgtgaagtcagctgtaattgaaaaatgaaagaaacacacactttgtaaattataaaaaattctccatgccaaagttatttttgccctgggccagtaat

SEQ ID NO: 105287 - DNA, 1004 bp, Homo sapiens
gcaaactttacttctactgcattttctcaggatttgctatatagtgtaggctcatcctaagtcgctgctctagcaaatgtggtaggaaacattccccttcattccatatacacatgtagtctttggttgatttgctttgatgaaaaacaaatcgaattggtaaatgtaggtagtgaatcgataaaactcttaaagcagacaaaaaaggtttgtttttgttaagtttaacttaaaaaaaaagagtctttgaaaaacagactgttttcttcctgaatacagtggtattcattctaggtagggatgaaatggtagctgatttattcttcctgaaagaatcttcctttatcccagaggttgacctgcccagaaacaatgttctacttttctactattcctttaagcaaagtctcatccatcattatctcttgcttaatgaataagttcagtcaacagtcatctactcttctagttgttatgggaaatataggaaaatagaagatatggaagacattggttgttgaccttgtggaacttttaattttagggggaaggggtaatatccattcatacatgaataaaaagatatgcttaagtaatatgattcaaataataaaaatggtgcttaggaaatatgaaattttatgatgaacatgaaatgaggaagtccccaaaatacgatatgagatgacatgaattaatcaatttgagtcaacttttgtcaatttaaggagattcttgatacttgataatgtgactcatgattgtttcacgagtataagaaagttgaagcaagagttacctttgtcagagatttccatcattcataaaatgagcaataagaatcactgtctttgaacaagtctcttgaagaaatttcagctaatttcatatccctgtccattgagctgtagctcgctagaacaaaacacaggtatgaaaatgatttttctttttccaatagaaagtgcacatgatgaaatgtgtagaaaacaaaactttaggag

SEQ ID NO: 105288 - DNA, 1310 bp, Homo sapiens
tcttcaaattcatcatcattttcccgaaaactttttagggtaaattgagattatgtaaatcaaattttaatgtgtactttcatggaattatgaaagagatccttttgtaaagcaaataattgccccgtaattcagctggtaaatatgtacttaaaatatgcagtacacctttcattacgttgtttaagtcttcaaatgaaagttgcaagtaaaatctcagctacataatattatatttacctaggatatggggggaggtattacagattccttattccttgcctgtacacccttgatttggggagatttgagaaaaatttaagtacagtctgtaatcctatgaacttcatatacacatacaatctatgtgttatattaagtcttaaaactaacccaataagctttttttcttcctggctttgtagtttacttcacctcgcagtggtatcttctgagtaaaccatcagtctgtgcttagttaacatgtggtgagtgaagaacaatgtcttgtgtcttttgtgcaaaaatcaaatgtgttgcctgatactaaccattttgctggaattcttttgctcttgtttaataaatatatgattatgctatgggttaatataagtattttctgttcattctgttatatggatcgataatagttaaaaattactaccaccagtaagagttatataattttaggaaatttcatttctttaaagagtaattgaaagtttgaaaattgctctttgaaattttgttaaagaatccaaaaaagtatttatgtaacttattttcccttttgtttttaattttccaagaatgatctttgaaattatgattgtgagagagaaatgaaaaatcattttctagataaaaatgaagtggtatattccgtgagaattcaaaatcctgtaaagcctgagtcaaggccagtcagaaataatgaaaactagtaagatcaattttaaaatatagcttcattacttcctgaaatcagacagtttaacacaagacaacacatttgtcctgaggagaccgttaggcagcctactttaattgaatgtgattcttcctgattaacatattacagtgaaatgcaggcatatgaaatgtttcaacgcagttgactgtcttcatcatttaaaccctctcccctcatctctatgtatttttcatgctattaggttgatttagcaccctctgaaaatgtaccatacatctttacctcagcctttgctagaattttcacaaaatcaaaaacagatcacaattagtagggcttcactataattaaaataaatactctcagtgattgt

SEQ ID NO: 105289 - DNA, 1384 bp, Homo sapiens
ttttttcagaatggggtcttgctgtgttgaccaggctggtctcgaactcctggcctcaagtgattctcccatcttggcctctcaaagtgctgggattacagtcatgagctaccacacccagccttatttctgcctctttactgcagtctctagaccatggaatagaattttatttcaaacttgaaaaaacaaatatcccaaaaagtcaacctaaatgttttggatttttttgccccctttctttattctcttttcctttttcttttccagtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataacatttgtttattgtacttgttcctcagttgaaatctattttaaaatgtttaagaatgcatattctatttggatgaatttagtgaggaattatttgtcaatataactaaatgctgagcatttgaaaagaattttcacgttcaaatttggtatgaccaagttagaaggagcatggaaataaatactccatgatgtctgctttaggattctgacaacttgggaatgcctcctctctctggaatagaccatacttgaattattttttaacttggtgaaagagaaatttctgcacactgagagatgggtactgttcagagggcttcacacacccttcatattctaggaaatacaatactcaatatctaggtattatctaatctctgcctcaaggtagaatctcagttttccagccagtctggaccttagctcctgatgtatcttacatt

SEQ ID NO: 105290 - DNA, 1034 bp, Homo sapiens
agatgcatgctgaagtgtttctgtgggtagaaacatggttgaatatcagccattcctcccttccctgctgtctccacatcggttcagtcccttgggcctgtcagctctgaagccacccccgtcgcccatctccactgcccctcctggtccagacctgcatcatctctcacctggtgttcatttgcacttttgccctcctgcagtctccaccaagcagccaaatggtctttccaaactgtcacttggatcatgcttctcaactgtgtaagactctccaccacttcccattgcagatctgctgaagtcacagccattcctacgtccccctgtggtccaaccttggccgcctctttgatcttatctccttcccaccatggtcactccagaccggcctttctttctcttgagcctctgagcctttctcacgatgtatcctttacattctgctatcctttgaatcctcccagaaccctcttcccctcatgcttcaggccttcccgacctctggtggaaactatccttcccactcccagattctctattctataaccttgtttctttccttcccaatgctcaggactagctacaattctcatttgttgatatatttatttcctgtctcctagtaggctcccagtggcttgttcctgttcatgcagttttctgatgcccagaaaagtgcctgttatgaaggtgtggctttctggtccctctgctcctctcttctcccacagaaagaaacatctggcactgacaggagtctgctttgtgatcttttggggccaactttcctgctctcaactgctctctatccctttaggcctgtgctcatcgctggaagaacatctactatgaagccgaccacatcctaccccatggcttctgctacatcatcccctccaacctccaggccaaaggcaggacgctgatcccttgctatgaaggtgagcatggattgatttttcctcatccccctacccacctcatgccctaagcccgccttcccacctctatgcaccaccagctgaacattt

SEQ ID NO: 105291 - DNA, 1810 bp, Homo sapiens
cgggtggggctgggaggatgccggccgtagtgagagggctcttgtctgtgctctgttggctttaggcatctccacctccctgttttgtggtttaaactagacctactatggcttttaaggccaccattatttcctcaatgtggagaaactcagtaatgcaagttctctgttccacgttaggggtcacattatggttaaagacaatgggaagattttagagtttgacaggacctttcagataccacctagaacagcctcctgtctttcatgaggtccagagaggtgatggcctgagtttttctttctaatctgttattcacatgccacacaatggagaggcagagtagcttggtggccaatgcacagattctggacacagactgccggagttcaagtcccggctctgctacttcctcttattaacagtgtaatctcagatgggttatttaagttctctgtgcctaaccaacctcaagggtctatgaagaggactgagttaatgcttctaagtccttagaacagtgtctggcatatacttgctaatatatgctaagcatatatatactaatatgccatgtacaacatactgtattctgagcaagtgtttgttaatcatcatagggtgactgacttgtgtaccgggaatagaatccacttaatcttaagtacttgttagttgccagatagacaaaacccaagtgacacagttccagctaccaagaagctccccatctacaggggaaaacagagaggggacagggtgttttaaaagtgggagggccgtgtggagagagaatttcctgccagtgtgtactgctggagcccgtccccaagggcttgagctgcatccaagtgcaaggtggcattatttcattttacaattggaaaaactgaaacccacttaaagtctgcaggctgttgagactatggaagagagggatggtggaaattcgagactggtcatggtggtgggaacagggcaagggaggagggggacggctgcctctaaacccacttcttgtgggatggtggaaagaccgtgggaggggctgtgggttgaggacggctctgctgcacttctgcccctttagcctcaggcctgtcacttggcctctcagtgggagtcgatgctgtgatgcctccactgcatttaccgctttgggttatggtgaggagctcccgagaaaactcaggtgaaagtgctcagcaaggccacccattgttctataactgtggcctcatggtaagtctccatatgggccagctgtgctcctttacaacattggaaggtcggtttggttgcagagactctaaatatgtggggatctctccaaaatgtctcaagcttttgaattcttaaaaaattggtctctggtttggcactaggacatggcttctcaggtgcttcctgtttctggttggatgggaaaagctaccagaatatcctgttggaaccaggaaaaacagaggaaatgggaaataaaaatgaatttaggacataaactcatggagcatatccttcagtcagtttagtttgtgtttgtctgatgtgagaacatcattacctaccatatgttctttggttttatcagaatgtgtgagaaaacgagagctttggtgggacgatgtatagggaaaactacttgtaaattaaagggcaagcactataaaacattaattactattaaccaagctatgatattttaggactccgaaatgttaagtcaatgcatgtgataaaatcaagtacagagatttctttcatcctttgcccttgagaccactgaggcaagaagccggaacttagcag

SEQ ID NO: 105292 - DNA, 1035 bp, Homo sapiens
tagcatgcaaggatgttgtggtcacaataatccattatcttattcattcagctaaggtgcattgacctgttgagatgcagccatgcatcagatcctggggatttgatgggaaacctgacctagcctgtgaccttagattatagccagagagccatatgcaagtgaataataatgcaaccaatgtttggtaagctcctaccgcatgcctggcacagtgtgagcacttcatttgtgttcattctttgttattgttttctttctgtattaaggtagaatttgcatgcaataaaatgcaccaatttgagagtatgactccatgagttttgaccactgcatacgctgtgtgactaccaccccaccacaataaagaatacttctgtcaccccagagagtttccttgtgcctctggctggtcatacccctctcctgatagacaaccactgttctgacttctatcaccatagatccatcttgcccattctagaatttcacattggtgggaatatacagtatggactcttgtttctggcctcttttaatcagtgtgatgcatttgagattcgttcatgttggtgtgttgcttgtttttccccttactgagtagcactccattgactgaatatccttgagtttgttcatccatcctcttgttgacagaacacatgacaactcttagtcttcttaacaatccatgacataagtggggctgttatccccattttatgggtgaggagaccaaggacatgcagatcttattaatataaaagggaaggtgattccagatggtggtaggtgctgtgaggattctaaggcagggttacttggtcaggcagtggtgtcaaagtcagcaggaagggccaagcagagtgaggcctgagacttgttggaggtggcagggggaggtcaggggtgcccttggctgtggtggctctagagaagtgatggggcaaaagccagatggcagtgggtgggtgagagaagaaacaagaaggacagtgactcttgactgcttctccagaagcttggctgcaaagg

SEQ ID NO: 105293 - DNA, 1002 bp, Homo sapiens
tgttggatgctggttttcagaggtgatcaaaactttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaatagctaagaaaaaaacagttgcagggtttggcaaaaggggacgccaaccttagatatgaggtcttctgaaaacttttaaaatttgtttattttttgaatcagtagtgtgtatagttaaaatttttaaatggttataaaagttgtcaaagaaaggatgtctttcagctatcctatttttctcccaaaggcaaccacagttccattttcttaacgtgtctttcaaaagcttgtcaataaatatagaaatctgtgtgtgtacctccttttattttatgcaaatagtagtatactgtgtgcacactgtagtaaacttactttttcttttaaaacatccaacagcagaatggaggaacagattttggcaaatcgcacaaaatctagctgtaccagatgaaatacaactcagcaataacaatattatgttattatgatacacacaataacatgaatgacttttgaaagcattaaactgagtaaatgaagccagacacaaaaggctacctactggatgattcatttatatgacgttctggaaaaggccaactaaggagaaagcagattggtggttttcagcggccagggtttgggggaagggctgatgatgattgacttcaaagagggatgagacaactttctggggcgatgaacatattctaagatcgtggttgtagcggttgtatggttgcatttattaaaacttaacagagtgcacacctaaaattagtgaatgttatgtatgtaaattatatctcaatcaaacttattttgttaaaaaaagtttcgtggagattgttccatattggtgca

SEQ ID NO: 105294 - DNA, 1004 bp, Homo sapiens
ccagttttttacttaaacatgcttattagcctccattaagaaaaaggtaaccctgtgtatacctgtattaacacaatgctaactgctgcaacaaaccctcagttttcaattacttgacctactagatgtttgttcattgctcatgtgtcagtcaaataaggctattcctcgttgaaggtagcttcctccacgtggtgattctgggactgcagttgctttccattgctgctgctgcaattccttaggacctccaggatttctgcctcctgggggcaggaggagaaagaagcagtggagaaggcacacccaccccttaaacactccagcctagaaatgacccacatcccttctaccgactttccattggtgggaactagtcacatggccacagccggcctcagaggaggctgggaaatgtgggtccaggctgggcaccaccttgggaatgactccacatatcagtggtaggagatggagaggagggggtgtacttgggaaacggcgaggtcaagtcagcagggtggattgagaatatgtagggggacgaagccaggagtccaaggaccccttgggtttctggtttggagaacagggtggatggtgcctctgaaggcaatggagttaacaggaagatggacgatgctgagagggaaggctcatctgtcaagtgcccagcaggggtgggtgctgtaagaatgttttgtgaatgcaggaatgaggagaaacagtagtgaatgaacttgagtcccttctgccaaccccttgcagctatagtggagaaaaactgtttggtagctgtactccatagcctgaaaccatagcacctgatgaaattggaccaatctgttttcaaatacaaagctagtagttagaataaccagggggaaaaaagcataatcagtagccccatgtctttgcacaggctgccataaaaaaaggtacagttgtttctcagtatgcatgggagattggttccaggattcccaatggataccaaaattcat

SEQ ID NO: 105295 - DNA, 1050 bp, Homo sapiens
tcagtctttggattccctgccctaacacaaaatccatatttatctcaatgcaaaagagatgtggtcatcgaaacactgaatgcaaagggttagcagagtgagcacagatgttctcccatttgccaactggtttctaagaatatttggaggatgagtaaagtaatgtcttccatatgctcaagagaagatgatttagcaccatgcaaggtagagaaggagagcccccacccatcaacagaatgaccttggacaagacactagctgccctaggcctcaattacctcatttaaaatatgaaagtcataaaaccctacctcacgagggtgattgtgaggattatatgaggcaattcatgtagaaggtctttgtaaactgtgaaatgctctacgactgtcagccaggattagtagttaatgcacgtatttgtttattgtttcagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcaggtcagaaccttaaagctcatactcagcacccaaggtggcagctgcacagagcagaaataatggcccaaaagttgagagagccgtgggcctggctgctcaggagaccgcagccaggacacacctcctctctgggtctcccttttctgatctgcaaaatgataaaataaacagtcttaggggttacttgtgactactgtgggacttaaacactttcagacaattctcaggctgttagaagttacaatcccctcgagttcgtgaactggctggccacttggtccctgaacttgcctctgttcctagactgttttcagagcttagattggtggatagtaggtgcttaatgaatgttttattggtgggagaatgagtgaggtgaagaagcaagaatggtagcttgctgaattggcagttgagttacagaatgctcaacccaagagtccctggaaaccagagcactg

SEQ ID NO: 105296 - DNA, 1045 bp, Homo sapiens
ggtggaatacaaaatttgaatgggctggctcaaagctgaaagcaatagtgaaaacaaatggagaactcaccaccatttcctggacatgaaacatctctgcaccaccagatgagagtcgattagggaaagagatgctgacagatgaccctggaagggtgcttgggccagtgttgtagacctgtgggtgtggaacacacacagcaagtctcagtggaaaatagcagacctccatttcctgtcatgcaatatatattctaagattctttgaaatcacatacagaaactctaaggttcggatctggaaggtcacaacttgaagtaaagtgaactactgaatgacgggaaatttcaacaaaatagaaacacttctaacatgcatctaaaaatctcaaactttgaaactaccatattctctttcagcattttgtcttcttcctgctaaaacttttctttttacatgcataggaatttactcatagactattacacttggtgagaactcagacatcataatctagtccagtggttctcaaatttcagcaaaacatcagaaccatctgaggggcttgttaaaacacattttggtgggggggtatggagtgggggtcatgccgagtttctgactcagtaggtctagggtggggctggcagattcatatttataacatggtcccaggagatgctgctgctgctggtccaggaaccaccacttgagacccacagatctggtccaacctctttcctttgccagtttgaggtaactgaggccctcaaggaccaagtgggtcatcccaaaaccaagcgatcgaatatacagaaagggctgtttttactacatgagccagctgatttggtttccaggcaatctgcagctcatcacttgcacaactgtacccctcttctgtctcagcatttggttctataaaactttgcctctcttgttttccctagcatttctccattttctgtcttcagaagtcaatcatttcctgagaaatgaggaaaaagatggaggtcacagagaccagtaagagcaaggagggag

SEQ ID NO: 105297 - DNA, 1108 bp, Homo sapiens
aagttttgtattttttgtagagacggggtttcaccatgttggccaggctggtctcgaactccaggcctcaagcgatctgcctgccttggcctcccaaagtgctgggattacaggtgtgagccaccgtgtcttttccctaaaagtcactattacaaacaaaaattcgcctaactagaagttttgttctattttaaagtagatgaaacctcatctctctcccatagtgtcatagataaaatcacagttgaactcctttggggaagaggaggcaaacagaaaatgttggtgcagcatttatgtcagagtgtgcagtctgttgaggcagtgttgtaatgtgataaggggcttggtggaggggatttctttagggaaaaaaatttttttttctcaaaaggctaactatgacttttgagacttataaagtctcaaaagactttataagaggttaaaagggcaattgaaatgtaggattattttaaagacctacgtatttctagaacttcaactacagacctcttgttaactctgattcccatgtctacaacctaagaatgatacattatgtttagtgaatagtgattcggtatcacactgacagtacggtgcagtaacccaaagacctgttaattgatggtctaaactccagcctcatatttgacttatacgggaggtcttaatgtttccggcttattgccatattccatatgtaatttcctccattcctttcaaggggaaagccactgagtgttacccagctgccactgctgaccggttgcccacttcactgagggcctttgaagacagcggttggcggggacagtgttgaagtcctcttccctttacagaaccgtggctcttgaatgtccttctagagtagctcttggcattgctacctatggtcatttgctgctgccttgaggtccggagccaaaagtggttgttcccaaaagtgttgcataaacgtgaatcgtgacatggtactgaaagctgagcagagcagctggccatgccgccgcattcacagcaccacacaagcctgaaggtctgcatgctttatgcttgcaagatggccagcaccttcactaggcaaagagtagtaggtccctac

SEQ ID NO: 105298 - DNA, 1085 bp, Homo sapiens
tttaaaacaaaaacccaacagcactcctgggaacatcctgttttccatgcggaagcatagcagatccccagacgatccgtgtgctgtatgctacctgttgaaccctagcatggtggctttttaaaaggttatttatgacttttatttttgggtaaggcattatggccaggtgcatgcagttatgtctgggttacgtgtgaaacgtacatctggtgaactgtatacttggctcaaacttctcaaaatttagaggtgctggaaaggattgtcacttggagcctttagtagacaaaaggcagaaagtgagcatcatttcagaaatgctttagtatgcacacttttagctgatattttgatatatagaataataatatacacagtggagaatattcaaagagtggctgaagggagaatacagagccagtagggccaaaatgaaacttctaggatgtcttctgaattttcagcacatggggggaataagtgaacaaatttcccaacatcgtgcaatgctttatagcacaatgatctagatttcagactgtgttaaggttttttctttgttgatgttgttgttttaattctaatgtgcacggtgtgactggcagagtgagtttaaaagctttacgagtgattaattgcttggcaggcacccacgctatctgcatttccagaactttactgatgcatccatgtacatttccactgaggaattttggtgggtggggggaggttgtgctgcctcacaatgtcacgtgtattaaagtctaagcagtcacttctgattcacttgcactgtttgggaaatgtcaggtttacaaaaacatacatgtttggaataaaaaatggctgcaaacaattcagaagttcaatctgtaatttacttgctaataagaactttttaaagtgttgaagctagggtttcaatgtaatacaacatgagcattaaagagaacatcaaggtccatctaattcacatgaacaacccacctgatgtggctgaactgtctgcagtccttggcctccacacaagaggtaccacctcctctctgcatcaccctgactcccctggcccagggctacac

SEQ ID NO: 105299 - DNA, 1052 bp, Homo sapiens
aattttcagaactgaaggtcaagacactctattttgaaagatgttttcaatctagaggccaatacaatgaatggaaaaaattagccacacctaggcacattataatcgacatcccaaatgccagaaataatcataaaagcttttggagggggaaaacttgtcccaaacaaactgatgaaaatctgaatgctatcaggtttttaaacatcaatactgaaagctagaagacagaataaagtcagtaaaatttggagggtaagttattttccgtttagaattttatatacagttgaactttcaatcaagtgtaaagacagaacaaagacatttaaaaatctgcaaggactgaaaattttgcttcctgcggatttttttctaggaaacaaccagaataagtacttcatcaaaatgaggaaataaataaaaaacagagaaacagaacccaggagccagaaaaccaacacaggaaaacagccatgagaagcccagtggtgtaggcccagctacttgggaattcccaaatgatctgatataaccgaccatttggaaaatcacacatgtgcggatgcatgcacactcaacgtatgcgcgcacacccacacagagttaaggcaggatatttggaaaaatttgaatatagatgcatagaatattaagcaaatgaaataaagagggaatgttaactgtaagggagttgtacaagggaaaataaaacaaaacttagctttttaatgaacagttcttacaatatgtaagggaagggaaaatgtggtggtgcaaaagagctaaaatgtaaacagttaaacaggaaattaatagttgaaggataaaatagagaaatcaagaaatgacaatattagtatatttggttaaaaaaagctaaaagctttgaaagtgtttgcctcaaagtagtgggttttaaaattttttttcagcaatttgatttaaaccatgtgattttgtttgttttgataaaaaagtaaaagttaaaagtttgactgtgaatagaaaactcaaaccagtatcatccaagaagcttttgccaccacagg

SEQ ID NO: 105300 - DNA, 1055 bp, Homo sapiens
tgccaagtccatgtgcagttgcttctggctggtaccaggtcaccaggccagcctttactgccgctgccaccaggttactgacttattcaagcagttcatgcagtggctattacagtgtaagcagaaaataaccaagatggcactcccctcctcacaggatccctgctgcacactcttgtggcttcaggacttctccttcaacctgtccaaggctggaaggcaggatagtaaatcgtaacatgaagaattctataggataaagttggctctgtgggctggctgcctgtcagactgccagcagaacagagcagcctttcactgaaactttgaacttaattatgtgacatttgcacctgaagcagagaagcaagccagattgctgagaagagccaagctggttagggttcttttcttggctatttagcaccagttccctttgaggaagggtctgcacttggccccttcttaggcatccaggagaaggaggagtggggcactctatcaggcattgaggaaaggacccgcccagtggatggaagaccctagggtactgatctcacctgagatgagaaagaacttcacagtgtgaagagctgtacaagggagaactggctcaccaggaggtggtgacccattggatgataaatgggggcacctgtcaagggcaagaggtccccttcctactccctggctagagaactagcccaccccgggctcccaaagatcagtatctgtgagtgccagactgagactagaccctgggaatggcatagctcaccagagccttggtgttcagcctgtggctctctgctcagccccctttttatagagaaaacgtatgagtggccaggagtccctttcttcccacatggccaggatatatctccctgttgcatcagacagacctgatccaaatctctgctacttccttctctgatctgggaaagtcattttgctgcccatccttgcctcttaaatgcaatattacagcagcctcctaactggatttcctgcctctaggtctcctcatcatcaccctgtccatctttccaagt

SEQ ID NO: 105301 - DNA, 1137 bp, Homo sapiens
agtgaccctgtactgatgcctgttgctttataggtgaaaaggacagaatattttattgaatgggcagtacacatattcgtctgttcattcatttgttcagcagacacttaactgagcactgacgtcctacacctgggtaagggtgggagcacagtacggacagagacaaacacaagagggacaaagcaaggactcagtcccctccctcagtagctcacagtccagtggtagagaggatacatgttcacacgtacatgtttatagtagaatttagcagggtatgaataatcttgctaatgtaaagtgagctttcttcctggtttatatacaaatgaaaactaagaaagcatttgtatgtgctgtttaatatttatggcacatctttttccctaaagtgttaggcactttcgttgtaattatttagaaaattgtctgctgataaattgtcctaaattatatcccaatatagatgaataaatttagaccttattaggtcgatgtaatctagttggaaatgtagccttacagcaaatgccagaccataatgtgctgatatagttttactattaaacgtttccatttagtacacagtatcactcagtcatcaaatttttatttagaactttcagagggatataaaggaagcatcaggcagctgctgccctcagccacaaactatcagcaatgaaacattcattctttaattccttcaaccttaatttgagtatccaggcactgcggatatgagcatacatgtgttgaataatatataaataaataaagtgtaaaatttattgtgattgtgtttgacagcagatatcggagaaaattgctggatgagccaaggaccccaagggcgtagcaggatttagggaggagaagtatgggttaaagttttcgcaaagaatttccaagtttcgtagaactattaatagttcataaaagataagaacaagtaggggataaaggaagatctgaggggattctaagtgaggggagatggggagcagaggcaaggaggaaataggaaacatacagaaggctgccccaggaggggcatatgctaaataaacccagttacgtgcatgcttgctcactgaataagataacacacctcaggacctgggcctaaggtac

SEQ ID NO: 105302 - DNA, 1156 bp, Homo sapiens
gcttttccaacaatggtgtacaagagggcaccctaagaaattatctttgtgaggaacatgtaaaatgtcctgaggtccatattgatcttccttcctccacaacgagaaaataacaaaagtaaatatttggggccacgtttattttggtaagataagttccagtctggtttctaaaattagggattctgtggaatgcacgtggtttggggcatcctgccggagaactttgtctcagggatatgtagtttcttatgtgttgttgcttgcttggaaatgtgcatctaaaccttccctcacgtctgctcatctgtgcagacccagtgccgatggtaggaaagctctacccagctaattttggtaggctctcgctgtcctgccctcaccagcatgacctctccttagatgctgctctgagcctgctgtctgtccttcatacaccaccagacaggtcttccaagagcacagctctcatcctgtccctgtttctcctcaaagcattcactgaccaccccctccctcaactgctttcaggctagaggcccttccccactctggtctcacctagtgatacatcctctgccaccagccaaactgtcctccttattgcctcctgtaactttccatttctccctcataaacatccttccctgtcccctctgtccatccttccttgctcagttgtagttgcccccatcctctctccccacaacagaagtctgccctgcccagggaagccttgtttgacccctctgaatatttgcctgcaccatccatcactgtctctttccctcaatgtctagtgcaaaggaggtactcaggagacatttctgtgtagccctcccttttggcatcaggtttcccccttctagaagctgttcttttcctgtaaaaggcataccctccaagcattggttcctgggcttgtctttctcctctacccggactcattgagctttctgtagaatgtagcagtggcagcagctacccttctcctcccgctggggcttgttggaggctgtggggcctgcattcacagggccttgccttcacctatcatcttgggtagaataggaacaagcagggctgtcttcctgggcttgcaacgtatgccctgcagaggcctcaaacttgttttaatactctgctgttaccatcc

SEQ ID NO: 105303 - DNA, 1029 bp, Homo sapiens
aaataagttgctggtaacaatgttaattgatgacacctttctggaggaaaatttggcaatatcatcttaaagccttaaaaatatccctatttgttgatgcaggcagttcccctttatggacataattatgaatgtgcaaagatttaaccatgaggtaccatccagcatagattataataccgaaaaattataagcaacccgatgttcaacaacaggcagttggttaaaaaaactatagaataaatatgcaatcaaatagcatacagcccttcaaaatgatatgtcgtaaatattgctgatataaagaaatggatagagtgtctctcttgttctctcacacacatacacatacaagcatttataagactagaaggatggatgccgaaatatgaagaggttatctcctattgctcacactggtggaattatagctaggattttctccttccctctgtacttccctcagttttcataaaatcagcttaaattacttttatgatttaaaaaattattttaaaaccacatgtggatgtatagaagggaattctgggaagatgacagcctgagcagatggctctattaaaattccctcccaggataaacccaggtgggcctgctggtggagcctggaaagtgcattaaggcccccagttttcctgacaccttcagggtagagagcaggcacaggatttattctctctggtactcagtaagaagcagggaaccgccaacagaggaaaatgcttacgtgtccctgagtccttggacaaacactcgaatgtatagtcccatgaggtcaactagccagaaggagctggcggatcgccttggaaagagctcgcactgcccacacaatgtgtgtggtccttggaggggctgccctggtgagctggattgcttccagtgcttgtgccttggaggagccagtagtataggggctttcttagtctctgaggtttgttaacttgggctctgctgggccatgaaaacagcactccttgctgggccttgcagtactccctcatttgc

SEQ ID NO: 105304 - DNA, 1050 bp, Homo sapiens
attctcatttcagtaataactttattacggaatcaaaaggaagcatactgtaataaatacaatgtttttctttttttcactccaatgaatttattttatactgagattataaggaaactatagtcgtaaatattagatgcggttgcaagttcaaatagttctttgatttgaatttcagaagtttccgtatcccccactggcctagcttgatggtctaattaacttccttgtgtaattgctttcggctactctcctagcaggcaacaggaaaatgccacaagtcacccacttatggtggactctcgggaaaaagtgtccattttcaatgccagctgctccagactgatcttatcattcctgcatcgttttctccagagaatctttagcaaatacccaccccaaaagaaaaagggggaagggtgtgagttttcggatccgcaggctgctatgaataaagatgccgtagtcagttggcatgcgtcttcgttgcttctgattttttttccttatctgcataaagctcttccggaaataacttcatttatgaacaaattgggaatgttgtaggaaaactagctttagaggttgaagctggggggcttttgtcagattttccacagggatgatctaaccatcttccttgtcaagtccaaggtcttaaagggagcgtatctggcctgatatcccaggaaggagactttcctggtacttgagccacaacgggatgtcttttcttagcaatgtcagtagtctttggttcttgagtgcaaggtgtcagaactggagaaagcttgggaatcagctggtccagctgcctcattgtctagatggagaaactgaggctccgccagggaaggggttggttaaaggtcatacgatgggaagaattaaaatgaaaattccagtctcctgcctcctggcccagggctcttttcctgatacgcaagtcccttccctcccatgtccttgctttcttgcttattctccaggacatcctgccaggaaacagtcccggggagaggcagcttttttcctagtgtttccacactt

SEQ ID NO: 105305 - DNA, 1159 bp, Homo sapiens
cagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccc

SEQ ID NO: 105306 - DNA, 2270 bp, Homo sapiens
ctgtcagggtcagtgtgggaaaggacacccaggcattgtctcctgccatgcagaggtgaggtaagggaggcgtcatcatccccaatatacaggtgggaaaggcccgaagcttagaacaatgtcactgccaacacagggcctacctgggatttgaccagagtccgcctggctccaggctctgccacccacaggaagaagaaactacactgacagatgtgagacagtgtttccccttcagtctttgaacaggctttgtgttttctaaatgacactggataaaagggaattcattcaagagctccaaggcttccctttccgcccggcttctgttgccctggcctgagcagcgagcagctgggaggggactgaactgcccctaaccagggttgtggctggtggggttgggactagggctgggcatgtggctgggattgggcccatctcccaagtgtggtgggtttcaggggtccgtggggaaagggtcacctgcagatccttgtacaaagcccagcacaaggcccagaatgggcctggagctgagggtgggcccctggcctgcgtggatgaggaaggcctcagaggctggggagagctttccggttgggtacaggatgggtgggctggttcaggaagagcagccacctgtgcccattggtcccttattccccaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcaggtgtgccagcctgagggaggcagcactcaccttaaagcccaagggctgggctctgggagtgaaatgtgagagctgggccaggccctcactcactgcccccacctgcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggtaggtctcaccttgccactctggccacagcctgcccagttctgcatgggccatggcccccgcacacacttctaagcaccttctctttgggcctggggcctgcttatcatcccctagtttcccagagcttgtccaaggcccaggagctccaaggttggccccctgcctgagtttccctccccagtcccagagccagatgaggaatttgagttgaaagggagccaggggcttgcctggggctgcacactagcaaacctggtccccactttccacctccaaggcctgagcacccatgccccaaccactcagagatggggggaaaggtccatttaaaaagggtctgtccctgtcccagactgatgggattcctgcactccacacttagagggtcctgtactcctcatgtgaaatcaccagtgagggccttgatggcttcaagcaagggtccctgagctctgaggcaatatgtcccacactgggacaggaaggcgcccctgggagcccttgcccagcctgaggccttgctctcctataggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaaggtacccacagcactgaccacttgattcatgcccagatgtagtggtgccaggctgggggtgggtcctctccacagggcatgcagactttgagtccagcctcagataggccgatggggggaatggggaggggaagaagccacagggtcccctctagaacttggggaaagttacaaagtgacaggtggacctgagagtccgcaggtcagagccaggcccaggccgcctcccctccttactgcctggagcacagggcatgtcccttcccaggtctcttgggaaaaggggaggcctatgccagtttgctggagttttctctaatattcagcataaactatgactgaccctctaagcctgggggcctcctatcccatgctctggaccctgcgagggtcccagaccctgcgatccagatcaactggggacacaggcctgtagggtgaggaagatgccttgttcactggtgtcctgctgtcagcttag

SEQ ID NO: 105307 - DNA, 1166 bp, Homo sapiens
cgtcacagctgggtggggcgagagctttctccatgagcagagagggaccctgtacccagagcagagcggagtgctcggggagaaaccacggggctcagaggagggcccagggctcccactcctgagaagtggcttcccaggccctggggtggggcacttgtgccatgggctggggtgcccctctgggtggctcacagccttgctgtccgtgctggccaggctccctgaggaggtccccagcttccagccacgactgtttgagtgctccagccacatgggctgcctggtcctcgcagaagtggggttcttcagccaggaggacctggacaagtatgacatcatgttactggacacctggcaggaggtaaggtggccatccctgcctggtggggctgtgaacgggggtgtgtttctgtttgtgtaactgggtgtgtgtgtatctagccatctgcctctgtacacagggctgtgggtgagtctgaccctgtcactgagcaattgcattgcggtgcatatgagaccatggatgagtgtgcatcaccaggtggcagcagtgagactccgggagattaggagtgtgttggaactcaggggtaactgagaccatgtttgcagttgtgtgtggccctgtgtgccttatgatactatgtgtggctccagcgacagtgcctgcggccgagcatgtgtcggtgctgcatgagtgactgtgattggaatgcccaatcgcatcattcatgtgtgtggcttggtgtgagtgtttgccttcgtgcacctgtgtgtgacactttgtcagtgactgtgaggtcacgtgatgctagaactggccagaccagtggcaactggtgaaaatgtgtctgtgagcaagactatgactggctgtgggcgaatgatggatgggtgtgtttgtgggtctgtgtttctgcgcacagtggtataactggccgggtgtgcgtggctgtgtaaacaagtgctgttgtgtttgcatgcagctctgtgtctgacaacagtggatgacagtgtgtggctatggtttgctgtctggctgtgtggcgatggatgactgtgtgtctgtgtaagctgcaataatgtgtgttctctgcatctctgtggggccgtgtctacagcactgtttgaattggtgatgaagctgtgtgctcccatctact

SEQ ID NO: 105308 - DNA, 1059 bp, Homo sapiens
gcccaaccaggaaccaatcatctaccacggctatactttcacttccaagatcctcttctgcgatgtgctcagggccatccgggactatgccttcaaggtgggagtgcccctggcaggtgaggagtgggatgctaggggtggcccaccactcctaatgtgcccttgggcctccaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgaggtgtgtggtggggatgggggatccctgggggagggtggggagcctagccggggcgctaggtgtgtcttgaccagttgcccctccccacctagcaactgaaggggaagatcctgctgaaggggaagaagctcggggggctcctgccccctggaggggagggtggccctgaggccactgtggtgtcagacgaagacgaggctgctgagatggaggatgaggcagtgaggagccgtgtgcagcacaagcccaaggtttgagggggagctgtggggtggggcagcccgggccttccccatcccctcacccgtgggaggtctgccttgtctcagttctctgtggctgccactcagaccctctgccccgctctctctgtctgtctccctctgtctctctgcgcctgggtttctggctttctcagtgcctaccctaccccaaccactgaatctaacccgggcctccccgtgttccccaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggtgaggcctggctccccaccactcccctgctctgttacagagagaattggcagggcagggcttgggcctcaccaggaggcctccactgctgaccgaaccacac

SEQ ID NO: 105309 - DNA, 1028 bp, Homo sapiens
gacagggtgtcatctccccgttctctgtacctccagactggagccccctccagggcagggacccatcttctctgctctatcacatctcaaagctgggccaagaatgagtaaaaaaaaaagaagcaggagtagcatctgcttttcagccatctctcttgtttcttgaagaaggggtcctcaaagccccctgaaggaggtgccaagagggaaacaggaccagagaagggtagggatgccagagccctgtctctcatctgccggctttcataggaccagaaagtgtggagcagggccccggggctggctgaggcagccccttccctccggttcccttctttctggctgcagtctccccaggggtctcccagcccagtgcggccctgcgactgcaggtagcaggccctggtcaggctctcaccagtctcgctgggctcgtagcgctcaatgagggagagggccagcgcaggccctgccgcctcctcccgctgctggtgctgcaggaacgtcactaactgatccaccgacagagtctcccctgagcccgcggcctcggcgaaggtgcggtcgatctccacccgctgggtcagcatcttgtagaaggcctcaatctcctcgtcctccagggagtctgtctgggagtggtcacactcctgcagagccaggacagccgagtgggctcagagcaggccttgggccggggtcaagggccccatggacaggcagccccagcccccacttcctgcctcaccctgaagatcttccgggcatagctgtcgtccacctggatgttgagctccttcaggaagttctgcagctccttgaagctcatcttgttgtccttgtttttgtcagcttttcgcaagcaggagtgaatccagctgggcaagaagtaaggaaagaacccaggaaccctggaacctaccaaggtcccagccagagccatggatggctccagctgaagccacctatagccacagctccctgcaggcctgacttactacacatccatgtttcagtggcctcttcag

SEQ ID NO: 105310 - DNA, 1046 bp, Homo sapiens
tccccatttcacctcaacccccagccctagacagccactaatctactttctgcctctatacactttcctgttctgggcatgttacagaaacggaatcatggagtcttttgtgactggcttctttcatttagcgtgatgtttgcaatattcatccatgttgtagcctgtgtcagtacttcattccttccaattgtctagtaatatgctactgtatggatagaccacatgtatctcttcaccagatgatggacatttagattgtttccactttggggcttttatgaagaatgctgatattaacattcgtgtataagttttggtgtgtatatatgttttcatttctcttggagtagaatcgctgggtcatatggtaactatgtttaaccttttgagaaactgccaaactgttttccaaacaggctgcatcaatttacattcccaccagcagtatacgagggtttcagttttccatgtccttgacactacatttgtcttgattatagacaccctgtgggtatgaagtggtatctcattgtgattttgatttgcatttccctaatgattagtgatattgagcatttttccatgtacgtttatatatcttctttggagaaatatctattcaggtcctttgcccattttttggatcatttgtctttattattgagttgtaagagctctttatatattatagatacaagtcttttatgagatttatgcttgcaaataatttctccattctgtgggttgtcttttctctttcttgatgggtttttttaggctagaaaagtgaaacagtgagagtggagaaggaacaaagaaatctggaactgcttgtgatcaattagttgtaaacacccctgcactcagatcagcctcttgatattctttgaagcacaaaagtttttggttttgatgaagtgtaattcatatactttatttcttttgttgtttattttttttggcatcatattcacgaaagctttgcctaatccaaaattctgggattacagcagtgagccactgcgctgggcctgagttctcaa

SEQ ID NO: 105311 - DNA, 1009 bp, Homo sapiens
gatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgtgtgagtgccctggggtcacaggggaggggatagagtgtggaatctgctcagggctgggtaaatacaaaggtcagtcatggatcaaaaccacagatggggaaactgaggcctggcctggtggggcataggtcatttatataacctgggctggcagtggggaaactgaggctggctggggttggggagcagggccagttaaattgccatcgggaaattgaagcctagtctggactggagagggcagtcatggaacgaggaccgcagatggagatggcaaagcttttgagggatggggatacttaaccatgaccacagatggggacagccaggctcagaagcagggagggagttggacggtggcccaaggtccaggcagataaggtacttccggggttgagtggccaggtgggagctagggctgcaggaggcagctcctccctgggactggagccacaggaggggtgttagggcagagcaggactgggacacacagacagaggccactgctggggagcccttgtgggtctgagggcattctggaagcttctaaaaagaccaaggaacccaagtctcaggccacaaatggagagagcctcctgcaaggcctcagggagaagaaagctctgctcacttcactcagttctctccctttaagggagagaattccctaaagatcctgtaaagtgagatgtctccctctatgcctttacttggtggggaaattttagaccgatgctgtacagttgaacaatgatggaaatgttctatatctgcactgtccagcatgggagccactagccacttgtggctattgattgagaccttgaaatgtggctagtgtgactgccgaac

SEQ ID NO: 105312 - DNA, 1010 bp, Homo sapiens
tgactcagagctggcacatgcaaccaggttctgccagacatgagggctgggccccgccctgctcatagagaaacccggcggctgctcagagccgtgggtgagccctcactccagtcctctcctctcttcccctggctatcggcccctcctggctctcacaggctgggaggtgctctgctggttcctgctaggggtaagcctgtgtggtatgagtgaacttgtgtggaggggctggagctcagaggaggcaaagaggctttgtaccaagtcacgaagttgctggattccattccctttgccttcactccctctgccctcaactcccagggccgtctgtgggcccagccctggccaggtgcctaaattaccctcctcaaaacccagctctcagttgcctgtgcaagatgccctgagatcccggtgactcagagggctatttggcaggcttagtttgggtacacagagggcccacacatgccccaaagactagttctttaatgggggagtttctggcatctcactctcctgaccatgcccagtcttctatgtctgtgtgaggatggatggggtgatggagcttctgggatcactggagacagggaagagagacctagtgttggcaccagtgcctgcctcaagccacttcacttggtctctccaccactactttctctggaggcctgaggagggggtattatcacccaagaatgccaacgttcaggatggtcaggctccaagcgtgcttcagggctggccctttccagtccctcccccatgaaatgcaaacctagcccagcttgggtaggtgaggtgaatggggtttattctgccccctccctgtctttagagcctctgctccaggatatggggtgaaggggctgtttaaatcttgactttgcagcttcctgctgttaagactttggaaaagtgacttcgcttctctgagctcctcaatcaggagctataatcatccttagaactggcagaagtaatggatggcaagtacaggg

SEQ ID NO: 105313 - DNA, 1142 bp, Homo sapiens
atatggctgttcactgaggctctggaaatggatgagacaacccagaaatgtgcagagtgaggctaggacctggcagagctcaagggagcacagcataaagggaagccctccgagaagaagaaagagggcctctgaagcaggaggggaagtaggagacagggcggcgctgtctaccctcagcctgcctctgcacaccctggaagcccactgtgcagatatgggtgtgcgcacactcagcctcattccagttgcctcagagaccagaggaagttgatggtttccagtgaggtcctgacattcccaagaccttcccctacctaaccaactctgaaaatccaggatccaattgtcactgagaataagtcagaagaggaaattttacgttagaacctggagtgtcttacaattatggcaaccccatgggctcacctgagctgggacacaaaccctgagcttgcacaggaggacggagtctgtgtgtgtgggaaggggaggtgctcacaggaatgcatcagcctccaccagcatctcagcagtggggactaagagggaaagggaagtctggggacatttatggagcacgtgcatgcatgtatgtgaacacaacgtctggtgtggccatgcccatgtgagccacttgtgcagaggtgctgaatgtggtgtctctggtgggagtgcacccccgagtgttcatgcagggtatggcagggtcaggcatgcagtttgcgtctgggtacaagcacctgagggtggcgtgcaggggtgctgtctgtacacatgtgagggtgtgccatcgaggcaagggctgcagactcccccactgaccagcatgttctcctgtgcttggagcaccagctgcttgtccgctgaggctgtctcctcctcacactcctgcttctggccagggccaggagctctgtggtcctggctcgccccatcttgagaaacggagaagggcctggagaccataagccggaagtagtgtgggatctctgtagtgttggtcagcttcaggtggtgggtggtcaccagctcactcagcacctgggcagccacagaggtaggaggcagggaatgcatcttgtctctctcttcaaccccatggctctagggtagggctgggagggctgggggaggggatt

SEQ ID NO: 105314 - DNA, 1033 bp, Homo sapiens
tagccctgcccccaggagtgtttattgtgcagtgctctgtcctggggtgggggtcgaaatagagacagggctcagtactcgtggctgggccttgctggccaagtgccctgcctgtgactcccagaggcccactggtcttcctagggctccctggctatttcctagcacttgccaagtgttcagctatctctggaggagtcctgctagggcccagttcaccttaccttctcctcctcttcctcctccccagggtggagtccatgtccctggctgacagagggaaccctggaaatattacttcgcgcttgatggagaaggagaaggccagagattgcctgattcctatggggtgagtgctcccatagctctgtgtgcttgtgccctctctgcctggggcagggagccaaggaacttttatcatctctgtggctggtggtgccaagccttggcctccttcctttgggcatggtctgctccgcagggactttggggatgagacttgatgttgcccttgacttccatttcctgaaggccccaggtcctctctgtgcccccgagtttccaaacatcgcccaccttgtcactcccacactgaggtgctcagtcataggaaggacaatggtagctccactccaaagccttgggggcctagaaagttgagaaggcagtgggaagcttgtgacgacagaacatgctggtgaggggaattgggccctgtcaggtgcaacaagaaaagtatgtggcatttggccgggtgcgatggctcatgcctgtaatcccagcactttgggaggccgagatgggtggatcacaaggtcaggagatcgagaccatcctggctaacacagtgaaaccctgtctctactgaaaatacaaaaaattagccgggcgcggtggtgagcgcctgtagtcccagctacttgggaggctgaggcaggaaaatggcatgaacccaggaggcagaggttgcagtgagctgagatcgtgccactgcactccagcctgggtgacagagggagactctgtctcaaaa

SEQ ID NO: 105315 - DNA, 1051 bp, Homo sapiens
tgaccgcggagttaacagacagccgtccgcacacgcgcagaaccacatctcagcctccaaggcctcaactccgcccacagctctgcgaacagacgcgagcgaccctccaaaagtcccgtccacctccagcctcagccaaccacaaggagagtcggcctgggaacccgcccctccccgccaccgcctaccaagccctctataggagggcccacaggcaccgcccagccgagctttccactcaatgccccgcctaccttggcctaccgcagccaaccagaaggtgtatctttacgaatccccgcccagaaatgcagaccggaagtctttccaccttttgtagccaaacccgagacctgacccccaaatccctgtctcctgcccgcagccaaacggaaggctgggcagccaggaccgcttactgcttgggggctggagatggaagccgaggctctaattcctctacccacttcctaggaggctctgctatccctccggtcccagtacccgagctgggggacctaaatacttccgagacgcccgagtcctgctccgacgtggttgggctttcccattctttcgagaagacagggaatttgggcttccgggctggccgggagaacagattttacagacatgcggggtgtgacaagctctctaactggagaatgaacatttcacacttttaccagttttacacccaattggaatgattttattagtgcccatttcccgtgctaggctggggtctccaccaaggcagagaggtaccatgtatccggggagcctgcgacacccttgacacttagtagatgatcaataagtacttgtcgaatgagtaaatgaatgaaccagggctccccaggtcaggactgtgtccctaaacctaaagggcaaggccacgtgcccccttgactcccaatagcagggccatgtcttcacctgagaccctggagagtagtgctgggctttccacagacaccaaaggacagggtgccttgtgctccccaacctagtgtcatgacgtccccaaccatttcgagggcagggccac

SEQ ID NO: 105316 - DNA, 1042 bp, Homo sapiens
aattatttcacaaaaatggaatgaagtaatattttgcaaagaaaaaaaaatccctacacaaactataaaaaaaccctgtttattagttaatatcttttatagctataaaaccagatttcccaagatggttcttcaagggcaccttgaagcaaaaatatatgtcccaaaggaggcctcctggagtgttgtgccagggtgtgttaaatagtgtgcttctagtttgaaagattactagtgtaatgagtgaaggaaattgagtcagaatggactgagggagacaaagtggttttattggtttaacccttcttgaagaaatcagagccatggagatcccagaaaggtgtgacacagtcttgagatttcaaaatctggatttgctaactcacaacatttgttttaggcttgcatataatgaattattatgttttctcttctttgtagaaagaaattcaagccatgagtcaatgccatcatcctaatattgtatcttactacacatcttttgtggtaaaagatgagctgtggcttgtcatgaagctgctaagtggaggtgagtagagtacaaggaaatgctataagtaccatggtttgaaaagttagtaaaagtttccttcttttctatcctgatttcgttttcatggacatttgcatttgaggagatactgaaaatatagtatttgctgaagatgctaatctatgagccaagacagttttcacacattgcatttgattcattttgttgtcatgctgcttaaatctctcttaattctttttagagactgtctggctctgtcacccaggctggagtgcagtggtgcaatcatagctcactgcagcctcaaaactcctgggttcaagtgatcctcccatctcagcctcccaagtagctgagactacaggcatgtaccaccatgctcagttacttttatcatttaatttaatataattttttttttttggagatggggtctcactatgttgcccaggttcatgtcttaactcctgtcttcaagcgatccttcctacttggcctcccaaagtg

SEQ ID NO: 105317 - DNA, 1731 bp, Homo sapiens
tatttccagtttattagcactaaactgcaaatgtaagctttttagaaatcaaagtaattaagaaaacttctgagaggaaaaaaaaggtacctgtagtacttaaagggagtaagtgtagaaatgtagaaatctaatgtaaattcactgtcttagatggttgtttaaggatgccctcaactttgtctttttctaagagataaaatgcatggggacttccttgatctaaaggaggatccaggtaaaatgtctgatactaatagtgaccagctttggatgttcaagcaacaatgcagggttttaaaatttctgtaacatcttttggtctaaaatggaatactcagaccaagcaaattttggcctctttgaaaccttctgaggcttaggaagacataagcaataactgtagtagctaaagatttattaaaacttcctagtagagataccagtaactaagttgaatgaattgattttatatttaaagagtatcttttcatactagtaaggtgaggaaattaacttgttgatggggtcattactttgattgagttataattttcagacttatcaagtgtctgaagccagcagctgcttcactactttgtcaatattattttgatattctgtaatgattttattgtacaattaaagttttgcattgctttttaaatgttccatgccacaggctatgaagcctgacaggggattattttttgggaatagatgatctacatttaaactttttgctttgttacaaaatttgtaccaaataccctgtttcccattatttgatttatttacttttattctgaaaaatgtttggattttaacggacagctttcatcaaaataagttgttaaatgccttttaaaatccagcttcttgggccctacctcagttctcttgaatgactgtcttatagggcctgggaatatgcatttttactagcttgccaagtaattccttcacacattaaagtttgagaacagattatccctatatactatttcttacaagttgtgcgtgaggacaaaatactacatacgcggttataactttccctcattattcctactttaggtattaattgggttattcagtgataatctacttcttccttttgcttagcatattttctcttcacctttctcttagctgacctgcattctttataattttgatatttgaggatggaggattataaacaccgtcatcgagttagaggctacaagaggcttagaaaaccaaatggataagaagcgggggagcttacaggaccagtatctctcagttaaggatgaaggtcttagtgacgattagtgtcttagtgacgattcctccacccataagaattatcttgttgggaggagtttgaaactgaagataaattgttatgccaaagaagaagggtttcttctataaactttgttcaaaatgtctgttctggacatagactagagatgtgcattgctttaatcttcccattgatcattggatgatgtgaaatcaatacaaatctaaaagtttgaaaaggagttcctgcttcaaactctttgcagacttagtcactttttatgtgccccaagatatttgatgctgcatttgtttcatctaccagactagaagttcccttaaagttagcaatcatgtcatgtatatcttgccatatttggtggcacccagtcttagatctcacatgtaatgtaatagggcttaattgttaagtgaataagt

SEQ ID NO: 105318 - DNA, 1048 bp, Homo sapiens
tgtatttgtctttgccttagctcttttatttctataatttattaacctgaaaaataattttagtcctaagttagtttgtgtatgtatgtgatccttaccctccaagtatttcgctcctgatttgattggcatttcaattgtatttttatatctttagtcatacagcagtgcatattctaatctgatcttaaaagcctatattggtttgtggtatcttataatagtactgacgagcctggtttacctagggattatttaggggcagttaaatatcctctactacctcactagacatccaaaggagatgctggcataacatactatttgaatatcagccagctactttttgttttagattggaattgaaaataagttattaattttaaacttctgtatttcctcatatttgctgtttttttcatttctgcacagttaagtttatgagaaggttcacatgtgttttgattctaaaatggatctgaattatattgaatgatttagagatttttagaaaattatgtcttctgttttcaggttctgttctggatattattaagcacattgtggcaaaaggggaacacaaaagtggagtcctagatgaatctaccattgctacgatactccgagaagtactggaagggctggaatatctgcataaaaatggacagatccacaggtatgtaaaagacaatactcttgtgttacatcatctcattaaggccattcccactcttttacagaatcgtgatctctgactgttatcatagctctttgtatcactagttttagtacactgtggttagagtcttaattatacagctagtaaacattaaacaagtactgtagtaaaaccagacaatataaaaacaggaaaaattcataatttcgtaccaagaggcaactacttgataacattttggaatatcgctttccattttcttttatatggttaaaaaatatctaaaacaatactgtatatgtaattttgtctgttgctttttaaattttacattatattttcagtatttccctaaattattaaaagctt

SEQ ID NO: 105319 - DNA, 1225 bp, Homo sapiens
ggcttttttagttgtgtttaggtttttaaaacaagaatatttttctatattacgtgttataaatagttaaaactatagagatgcctgagtaatttccatctttttgttacaggcaaagaatgttccctgttttcagttgcatactgatgattttaaaaatttgataattcattggggtatagaaaaaaatatatttcaaaatgtagaattaggtgagggtcacattctttggccacttttatcccgatcaagaatatttgatcacttgtgttttctagatattatagtaagaacctttctagctttctttttaatgtgtgggtttctagtaccagtgacaacaattttactattagtcttaatatcctttaatataaaataggacatttaaatattgctagtattacatgaatatagtaaacaattgcttaaattatgttactccaaagaatagatgttttttgatacataactttttttttttttttaaagagatgtgaaagctggaaacattcttcttggagaagatggctcagtacagattgcaggtaatgattagtatttctttttatttgatttaatggtcagtagaaccacattacttatcttttatgtttccttaatcagcattctctcctgttccctggaccatctctattcaagcatcctctgttggcatgtcataggatgccaccgactctcaagatatcttctcatactcatccttcatttctgctcttagacatttttttctgaccattacttgtttccttccagctatccactccttacttccattagggtcttctgctatgggttctcatagcattctgtactttcctttaaaggaaaagtagttgaggatcttcattgtgtttaagaataagtacgttatatagaggctatacagagcttcttctgtcctgggggaaatggagtatttgtcaattaggaaaaagtgcctgagaagtagaagtgcacttttggcagtttcagagctgaagggataagagttgcagtccagggcctaccaaaagtggctatcctgatgaaacaccccctcctccaggctgagactccagaatgactgtacccagggattgtctagcaagcagatcatctgagaaaacctcagcttggtcccagactgctagaacagtcaggtgtttggcaggaggaagataatcacccaaatcttaaattatttcttcatctttaagaagat

SEQ ID NO: 105320 - DNA, 3095 bp, Homo sapiens
tttgcatggctagcgtaatgtccccaagtttcatccatgttgtagcatgttgaagaattttcttgctttttaaggctgaataatatccattgcgtgtgtgtgttgagaagctaaccatctacagcagattatttacgtgaaatacacgtaataactctgggttttaaacaactgattcagatatgaacttacagaaaataaaatgtttgtatgttggtcggggggtgcctgtattgaaaaatcttgaccacaatagttaaactttactgagtcatcacaagtttatagtatattgaaaattcttgcaggttttaatgctgacactgcagaacgatcctccttctttggaaactggtgttcaagataaagaaatgctgaaaaaatatggaaaatcatttagaaaaatgatttcattgtgccttcaaaaagatccagaaaaaaggtaaaatatgagaaaaagtctacttttctctctaataaaacattgtgagaagtctaagaatcacatactcatatgtacaggaaattattttcaaaagaactaaatataaactttaaaaaagtatacagagaccattatactggattggaaatgaattgatttctgccttctttgtagtatacagtgtaccctaaatagttcagctttttccttgttaatttcttacaaagttgtacattgtgaattctgtattaataaatgccaagttagtggagagatttgtttttaatttgcatttaaaatttataaatgaatgtcttaatgccatttacagtattaataaaggaaagacacatagaaaatttatatttagtgtaataatcatacttatttccatgttagaaagatattttagtaagtggaccaaaaattcaaatagcttccttatcaatgttagacagattgaatgacaagtgagcaaataaataagaacatccgatatgtgtaacttcatgaattaagcagaatcgtagaatgttggggatcattgagtacaaccttttatttttgaggtcacttgatacttagtcataggagtaggacttgaatctcaaagtcctgattcctaacttagggctctgttccttctgaatcttatctgtctgtttcacatatatattccactcagcttcttagcactgagttctttaatttttgtttctctaaagatcattaaaagggaaagactttgatgttcttgatcacatctctagtgtatgtaatagggtttcagaatttattgttggaaatattggaaagggtaagaaaaacaggtagcaaaatttatacctgtgtttttataatttttttttttctgtttctgagtaaacagttaaaaaagacaggaaacacttttcttttatcaaattagttggttaaaggaacaaaattatcctgttacaaatacctagaaatgccagataaaatctatccaacttaaagattctcagatgccagaaataatgaggaagccctaagttaaagaagaaatattgtgaactaatcccatggctgttttcagtgggtcactattcattctggtaacctactgatttggatttataactcccatgtgaaaactggaagtgagatcttgggtccacccagtggggagtttgaactgagattcttcttaaagctaagaacttcagatgtcagtatccttagtaaaaggatagacaagaataaaaattgtcatcaccaagagacaacaaaaacctctcctgaataatcaagcccttcaacctggacattccacaggtttagagtctatactccctatgttatccaggaacccacaggattagaaagttaaaaaagctttaccaaatcagtttttatttttgacggaagtagtcacagagctgcactggaagaacactttcaaactctagctcccattggattcctgaacataatgccccactgtaataaggtcacaatccaaaattaagaaacacacagtgaaacaatgcattatgaactagttagcagacacaagcagaaggattagtgctccagaagatttaggtaatgcagtgaaaatctgaaaagatacaaaattaagtatattgaaaataattaaaattagaagaaatcagacccacaagagaagactgtgactatgacagaagaaccaaatagcaatgccagaaatgaaaaatacagtgattaatgtttaaaactttccatgagtgtgagctggacttgttgactcacttctgatgagtagagtatgaaaaaggaaaaatagcaactttacaatgcacctcctctacccaatgaccaaggttaacatcactattaataatacattgataagactgatatgtgcctcttgatatggtgcaatgagaagggcatatatataacctgtgaggtattcttcctccaaatccgtaacttcggtctataatgagaaaacatcagacaaacccaaatcgaggaatatgcagcaagatacctgaccagcactcttcaaaactgtcaaggaagagagactaagaaactgtcacagattggaggaaattaagaagacgtgaagacggaaagcaagagtatcctatactagatcctgggacagaaaaaggacattagtggaaaaactggagaaatggaatgaagtctgtagtttagttaatagtattgtaccagtgttgatattttagttgatttctttattattatactgtggttatgtaaaaggttcacaatagcagaaggtggtgaatggcatgtaggaactctgtactagctttgcagctcttctgtaagtctaaaattattataaaactttaagaaaactggaagctatagaaaatctattccagtttgtaaaccaaaattaaactttgtttagaacattgctaagttaaaataacacgcacaatggactggttaaacagaacaaccaataaaacaaaaaagagattatttactcatcaagtaccaggcactgtggtaaacacttaacatatattgtttaattctcacagtaatcctttgaggatagcactgttattttctttattttacaaatgaagaaactgaatcacagagaggttaagtaaccttctccaaagtcacacagcta

SEQ ID NO: 105321 - DNA, 2244 bp, Homo sapiens
aacacaacagttgaggccagcgtttagtgaaatgctcagagaaaatgcagtcatgtgtcacttaaaatgatgaggatacattctgtaatatgtgtattaggcagttttgtcattgtttgaacatcgtggagtgtacttacacaaactttgatggtacagcctactgcatgcctaggctatttagtgtagcctgttgctctgactactgtcagatacacagtatattgttggccaaagcattaagaggctcatgactgtgactttaacccagagttctccagctagtcagactatcattcaagaatgagcatgaaattattttgcacacagaaattgagttttccagtcacgttctgtcacttaaagaacccataagttgtactttagaaagaaggaaatgaagtcagaagaaaggaatgaataataagaagcaatgttgagcaatcacattgttgagcatattgagaagcaattgttgagcatatgaaaaaataagagtgataatgtaggatttcagtttgcatagcactttcacatttattcagctttttaatctttataataatcatctgaggtgctggttcttaaacttgaatgcctattggaattacctggggagttttaaacattactaaagccaattaaagattctgctttaattggtttgaggtacagcctggtcattggttttgtttgttcgtttgtttgtttttgagacagtcttgctttgtcgcccaggctggagtacagtggcacaatcttggctcactgcaacctccgcctcatgggttcaagcaattctcctgcctcagcctcccaagtagctgggactacaggcgcacgccaccatgccctgctaatttttgtggtttttttagcagagactgggtgtcaccatattggccaggctggtcttgaactcctgatatcgtgatccacccactttggcctcccaaagttctgggattacaagcatgagccatggtgccctctggtcattgggatttttacattcttcccagatagttcaatgcacagcagtgtttaagaacttaggggcttggccaagtaatactgaaccttagagaggttgtgatttgctcaggatcaggtaggtgtgtggcaaaatcaggtccagtctcttaaatgttaaattctttattctgaatgatactcttttaaaagcttgtaaaattgacagtcgtgtctttacttaaaaggaaataagaccatgaagaaatgagttaaacactgagttttgttaaatttggggaatatacttttagaattttcatttttaaagggagattgtgaaatctgtttttagggatctgtggttacctaaattgaaggctggcaggctaccatgtggcaagaagtggaggtcttgatttggtccatttcctctttgtgtgtttaaatatatttttatgccttgctaaaaatgttagatagatattttctagcttacttattgggaaataatattaaatattaaattaatattattaaatagcaaatatattagactctattaagaaatcatgcttccagaaaaaacatttcactaatgattttttcaaagaatctacaataattatcagaatatttgttttgagttttttattttattcaatgtcctgtatcaagtttattttacttttgctttttagcagtttaaggaaagtagagtatactgagtttttattttgctgttgaaaaaaattttttctcatttttgatgatggaatctgacattacacttgaattaattataaaaacttttcttccctcccttcctggttttagaccaacagcagcagaactattaaggcacaaatttttccagaaagcaaaggtaggaaattccagcttttgattatgtgtgttcataggatgctcctcaattactcagattatgttcagtgcttagaagttggatgattatgtttggaaaaatgatggtagataaaataattgcagaaagcactatgtatacagtctttgataattaagataattgcttcagaatttagtaaatccgtttttaaatattaggttaaactgatcataggaacaatgattattaaattttgccattataaatataatttgtgaaaaataccgaactctggttttaaggtttactactgaatttgtaaacatctcatttcccaaatatatcagatagtaggatgttactgtagttggaaatgtaggaccatgatctcaaagaacatacag

SEQ ID NO: 105322 - DNA, 1014 bp, Homo sapiens
ccacttctctttctaatgagcaggttcggagagtaccaggttccagtgggcgtcttcataagacagaggatggaggctgggagtggagtgatgatgaatttgatgaagaaagtgaggaagggaaagcagcaatttcacaactcagggtaaattttattaaactgtgtactttagctagaactttttgtagttcttgttcagcttaaccagctaaaatataaagaatacaattgtaacaggattttcttgaacagcttattaataataggagcccagttaattctgcatggaaagttggacttagatatctgtttgaatatgataatatttagagtatataaaaatgacccaaatctaccaaatctagagacgaaagctgcaaatgtctgagatgcaaaatacactggataggattaatggccaattagacattgcagaagaaaagttagtgaacttgaaggcccagcaatggaagcttttcccctgaagtctgttatccttctactaaggaggaatggtgtatctcttattcagttggtatatcctagatatctgtcgtgcacacgtgtgtgtgtttcctaaaaacagtgaagacaagagtcttccttttggttcatttcatcactcttgcctaaaagcactgcctcaagttgtcaggactcattcattcctaagactggaagtgtttataaggaaatataaatgtttgagggtattatacctttgactgcttaggactgtttttgtgggatgaatagtgagtatactggtatattgcttcctgcttttaggatctgctttggtgaaagcacttaagactctcttgataaacactgaatatttgttgaccttgtttatctaatgaggtatttgagtctagtccttctgcagagctaagtttgtaaagtccttgccaatggaagttggcaaaaatcgattaagctctaagcttggaaacactgtttagaaggtaaatgcaaatattcgtttacatacaattgtgagtttaaggtt

SEQ ID NO: 105323 - DNA, 1108 bp, Homo sapiens
agaattactgctaacttttattatttaccaaataaacagcttaaattttcatatggcagattgtaattggtcatttcctaataaatgtggtttacaccagatatttgagacctcacctcaagtatcagtttatttccactacctttatttttgctagtggtccatgctttatttttggaccacccgtgtttctttagataccagattcccaaatatccaacaccaagaataagggtagtagactctttacatgcagctttcagatcatttttggctcaagagttttctccattaaagcttgtaaacagaattactctgctttgagaatgtgttggataattagcttaaaagtttaggtttggtctgggatcttatatacataatatgttcacgattagtagaaagaattttactttggagaatgtgacagtcccattatgtatgcttataaagctcacaattttaaaatacggaattttaaaattgataagtacattgatgtatttgttacaggctacctggacaaaaaatacaatactatcatgacagttattttttccagaaaactttcagtagacttgctggtgagttaatatatggatcagaattaaatggagttgatttgcatttaacatcacttgcagtttgggactgactacaagtaacctgagttgtgagttaacaatcatcctttttgtatttcgtttagtctccccgagtgaaagaatcaatatcaaattctgaggtaagtaattgtgattattgaatccttgttaaagtaaatgtgcttttgttttggtttcaattcgaagtgcttttgtttgtgcatatgtatgcttaaatgggaatgcaactttataccaatcgaattttaaaagttggcgtaagggctcagaatgttcttccttgcctctttgattttgtgaattttttatttttatttttggcttgggctgctggaagtgaaaagttatttatttatttatttatttatttatttatttatttatttattttgagacagggtcttactctgtcacccatgctggagtgcagtggtgtgatcacggctcactgcagccttgacctcctggggctcaagtgatcc

SEQ ID NO: 105324 - DNA, 1618 bp, Homo sapiens
attatttgttacttctaatttaacctatgttgactgatacttgatttctcagaaattgaatgagaggctattttacagattatctagtttttatttttagtcttctccttgttcctttgcctaaatatcatctccacatgaactcttgcatactcatattctcatgctcattactttgtttttaaatttgcgataaaattcacataatgtaaaatttaccatcctaatcattttcaagtatatagtccagtggtattaagtatattcacactgtagtacaaccatcactaccatccatcttcagaactattttatcttcccatactaaaactctggctattaaacagtaactgcattctccccagtcgctggcaaccaccattctattttctgtctatgaatttgcctactctaggtacctcatataagtggaattatacagtatttgtcattttgtgaccggcctatttcacttagcataatgttctcaggttcgtcagtgttgtagcatatgtcagaatgtccttactttttaagggtcagtaatattcctctgtgtgtgtgtgtgtgtgtgtgtgtgtgtgcgtgcgcatgtaccacattttattcatctgtcagtggacacttggtttgcttctaccttttagctgtggtcaattatgccattgtcaacataggtgtacaagtatctctttgagaccctgctttcaattctttggggtgtatacctagaagtggaattgctgggtgtatggtacttctatttgtaattttttgagggaccatcatactgttttccatagaggctgcaccattttacgtgctcatcaacgagggttccaatttctgtgcatcctctcattacttttaaaaatatatcctttccatctttactatagataaatgtaagtacatacaatttggaagctaatagtcttttgaaatagtattaataattaacattttcaaaagtagtcttaaaggcctacttttttgtaaaaatctagaaccaatgagtaatttatgacttcttatgtatgaagttaaatgaacacaaaattttattccttgtctccttgattttgcttatgtaatatcacctattcagcctgtactattactctttgaattttttctctttcaactttacattttggctattgcatcgttttttctcccccagtaactgcataattttgaatatgtttaacttgtttttatactcagtatcagtcatttcccccaaactacataattaaaatttatgaactatttcagacatacaaaataacatatataaaatatctttttttagttttaaagcatcacattcacttttaaaatgcatttcagatatgttaaggaattattggttgattgtctttgtaagaaatacaaagtcctcatgcatggaaaaatatagcttctgtaattttgtattacatacttaaatctgtattttggaggtgctgttttgctgggcaaaggaatggaatagattttgttaaagataaatataatgcaaactgaagacagacacaaaagactatatattatatgattccatttatatgaaatatccagaaaagcaaatttatagaaattaggatcagttgtt

SEQ ID NO: 105325 - DNA, 1602 bp, Homo sapiens
ggcacttacttcatttaactttgcatccctcaagctttccatttctgcttggcatatgggaaaagatacagttgtcttaggaaaattgatggaaaaattagattcattttataaacaacttaaatcgaatgcatgtcctcccataagcaagcgctgtacaattttcagagaggattagtttagccataaaaagactggaacctatgtatgggttggatggatttctgaagggcagctggttcagggtctaccttttgtactgccatatggtgcactggcagattttttaaaaatgagaaacctagctttgtgtttttcagtcttgtagaggggaacaggggtctcagaaatataaaatgtaaatgtggctatatgtgaaatttcatctgggcttgagagttttctttctcattgtgttggacttaaactgacattcagcttttgttgctgccttggagtgcatgtcctcctccagcagggaatgtcctggggattagtatgacctcagctggagatgaagaaaattgctgccaagtaaatgattcctctgccagtgaccattagtcacctccccacttaatgtttcaggcaatgactgtatacctttcaatgctttttaggctttgtcttcaggatcaggttcacaagaaaccaagatcccaatcagtctagtactaagattaaggtaagtagacattttttgttttgttttcttttgttttctgaatattctgcatgtgctgtaatagtctgtgcctgagagtaactggataggattgtatgtcctccagcatcaagctctgtttgcttggtggtgtattatttttccccagaaataatagcaacagtgtgaggacctgcatgttagcaggtgttgtgactaactgatgcacatgttctctcagttgtttctgtgctaattggtgatgagtttgtgtatttacagtgtagctagtttgggttaggaggtgtagcctgtaattgaggaacagtttttaggggagcagcactaactggcttatctgaagatcagtcttataattgtgacgaggtaaactctgagatcaactaacccaagaggggagcactttttgattgtggtagatcaaataaaggccttgtttttagaaggttaaaaggaaacttctaaatgtttttgtagtctgtttctgttttgcagcaagtaccctaaattggtggttcttggtgggaacatatagagaggtcctgacagattgctcagcaggaagtgccataggtagcagtctgttcattttaactccctgccccgccccccccgcccctagcactagtagctggattcaaattccagagctttcttgtcagaatcactatggctgttgtattgctctagttaggtctctttctactcataaatgcatttgaaaaaaaattagtattaaagtatcacttgaggcaactcaggccttttaaaactattactaacattttaaaaaagagttccactgaattaccattaactcattccccttgcacatataaattcctagtcatctttctgtaaggtcctaattggagatagaggcagcaagagctatttaagagaatgtggtaaggaga

SEQ ID NO: 105326 - DNA, 1818 bp, Homo sapiens
caattttcctcttagttttatatgttcttggtgtgggaataaggatgggagtgggcatataagaatctactcaaaggcatgaaatttttatattgatcagtaagggacatagattcaaagggttgtaggacaattagatggtcattccgaattggttttgctctgagctctgcagtgtgaacatatctgaatacatcatatgatctatgggaacaaaacagactttcttgaggcacagctttcttaatatatgttggcagaatctctttgcataaatttagaaattcttattttatgcattctgctttctttcataggaattccaaaaaagaactaaatgatattcgatttgaatttactcctgggagaggtgaggcatcaaatggattgaaaacaaaatagcttccaatttgtgattcaatgaaatgtgttgtgaagtttctgtcctttgtgaagttttgcttttaaaggataataaaaattttcctggttttggcgagtatatgagtgagataaaaatgcagttcgttgactactaaacacatttagaaaaccttgtataataatacaaacagtaataaatatatgatagctctttacagcttactataggccaggcattgtcttaagcgttatcttattaaattctcacagcagtctactaaggaaaaattattatccccatagtatcgatgatgaaatcaagacttaaaggcaaagtaacttgttcaaggtcacacagctggaaagaggtatagctggaattcaaaccagatctgtcagaatccaaagttcattctttatacatggttgttctccatgatggtaaagaaacaaggtctgcagtctcctctctcctcagacagaagctgaggtctgtcatgtactgtttctggctgttgaacttcaccttgaacaaggtgtgttttgtttcttgcctttattactcagtgttctaatttggggagtagccagcaagtatctgttctgtgtatcatgcttattcttcttgctgtctcactatcatgagcaactaaccactaaagagaaaagatgcaggtgtacagaggtgtcacctgttttactttttaaacaccaggcaacatcacattttcaggaattaattcaaattgctggttgcctgtgtgaatgtgtggacactgtctccaccgcagtcctcctgttccctctgaggggctcattttcaagcccttggcaaccaataccactgagttggttgaagatgaggttaattggggatattctgtcctcatctttttagtttctggttatacccattgctcagattgtaccacctggaataactagataagaagaaaagcccaccagaataaaaaagtaaatgattttagcaaaaaacttggagtatgattcccaaagagaagagacaaaaattttttgagacaaaaattgttgccttagtttttgagaataaatcattctggttttttagccctagagatgttcagtattcaacatcatgtctcagatatttgctacctggtttatacagattctgccctctagctagatctgtgagaattccacttgagataatctcagtggtaggaaaagtctttgtatggaaggaaggccctgcctgccttcttggttctgtggatttagcatccagcttgggcctagcatggcacactgacacccacatgagctgtgagagttaacagtggcaagcacgcacaaaaaacagagcactgtcttctttgtccttgcagatacagcagagggtgtctctcaggaactcatttctgctggcctggtcgacggaagggatttagt

SEQ ID NO: 105327 - DNA, 1015 bp, Homo sapiens
accacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgt

SEQ ID NO: 105328 - DNA, 2072 bp, Homo sapiens
ttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttgccctgctaggaattagaagacagacaccatgtcccaggacagtgttacttcttctgcatgatgtgtggtagactccctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtccttagtggtgtatggacgctttattttagtggccgttggcggagagctgtgggttgtgggtcaaggaatcaccaccaactttaattgttcatgcgaatagaagccaaagtacatataaactgtaaagtgtgtctgttgatctacaaattatctagaaccattaaagccattatatagttggggaaactgcaaccctaaaagggagggatgagatcagcccaaggaattggataggatgggatatggaactccttttattatcttttgatcttttttaaatctttggttttgcttatgctgttgggcaaggaaggatgccagattcaagcccttgggagtctctttcgaaagttcagaacagggctgaacttatctcttcttggctttgatattgcaatggtgaagttacatgtaagattctaggctcctttgtattcctgttatcctcccactgcaggaggaatcttccctcatcatctgcccttcccaacagcagtggcttttgatccatgataacactgcttgtgggtcctggtatttcagagctcagggctgtggagccttggagttgacaatactgtttggcctacagctagttgagtttgctttcaagataagcaagttataaaagtggaatcaaactattgtggggataggaaggaggtgcttgttactcataagtgaccatggtatatctggagggaagggaaggggtcaagggcaaattgagcttccacttgcccattctttctgacaagatcaggttgtatcactaggcttggttccttagctttatttgtttggcagcaatactcagtgcatccattcagggattccccctttgggtcaggtcatctac

SEQ ID NO: 105329 - DNA, 1031 bp, Homo sapiens
ggagatgatgagggcagaggacaaggcttatgtctccatctcagttcttccccataaggggaataccagactaggcagtggtgactggtagcagttgttttcttggcaattcaataaagacaatgctaagaataagaacactcaaggaagctaagtgaaggaaaaaagagctggggacagtggtgatcctggtgggagaggttggggtggggcaaagagcaaagcatgctccctgagcagcatgtcaggccttgcttctgccctccactgtctgccctgccttgacctgtactgcaggctgactgattaacaggcttccagcagctgtgccagtcaggtggccagggctgccctgcacaaccttgcttccttgcattcccttcagcaatgttcctctgctcatgccttaaaatagttcaaaattgagaacatgaaaatgctttcttatgcatacacaagcagacatgaatatgtgtatgcacctggtgtgtgtgtgggctgtggtggaggcatactttgtcttgtgttcattgtcactgacattgctcagggaggctggggtacgtgcatttgttttcatctttagagtgtgttaatggtttccttcttgattaaagtagagctcaaaatgcagctctgtcattgctctgtattcttggtttgtctttgatgttgaaaagacagtgcacttgtgcttttggtggggctcctggcctgcatgctgcttcctaggattggcaggtattgcatatcaccacataccagacacccacaggagagaaaaatcatcaggatcaagaggccagattgggctgctggcaaagtttatctgcaggctaagtgcttgttgctctcctgcttatccatgctgcctagtgtgggctgtccctagaagggaattctgtgtccctctgagtgctgcaactactctcagggttttactgtagtggttttacctcgcctattggttgacccatctacctgtctcatttgagttgagtgtgaattgtttaggatattgcaattagagg

SEQ ID NO: 105330 - DNA, 1039 bp, Homo sapiens
tggtggtttgctgcacctatcaacccatcatctaggttttaagcctcacatgcattagatatttgtcctaatgctctccctccccttgtcccccaccccctgacaggccctggtatgtgatgttcccctccctgtgtccatgtgttctcattgttcaactcccacttatgagtgagaacatgcggtgtttggttttctgttcctgtgttagtttgctgaggatgattgtttccaacttcatccatgtggactattttttcatcatattctacccttcccaagtcacacctagggggctgaggagtgacaggtggagcagggcaaggctggattaaacattaatgcagctatcaccactgcccagaggagcaagttcccagagccaagctacagagctaccctagtgtccccaggctgaggaggtagtgactggcatacatggctcagtttgtccaggtcctggctgaaataggtgactttggtcgcttccagatacagctattgatcctgctgtgtgttctcaacttcctgtctcccttctacttttttgcccatgtcttcatggtcctagatgagccccaccactgtgcagtggcttgggtgaagaaccacactttcaacctgagtgctgctgaacagctggtactgagcgtgcccctggacactgcaggtcacccagagccctgcctcatgttccggccaccccccgccaatgccagcctgcaggacatcctcagccaccgcttcaatgagacgcagccttgtgatatgggctgggaatatcctgagaacaggctcccatccctgaagaatgaggtaggcttgtccttttgctggtctctccaccggttgtgggtctgtcaggtcttgtgcctgactcttcgccctcagtcactggctctgtatctgccccatgcccatatggtcaaccatgggcacatatgtttttcattttgtcaatctcattttcctctttgtcctctgcctattgacccatctgtctgtcatcttctctgtccagtctgtctgcccatctgtc

SEQ ID NO: 105331 - DNA, 1009 bp, Homo sapiens
gccttgcctggtctcaggcctctgcagacatggatccccagagatgcctccaaaccttgcttcccattccttcctctctggcactttctcccgcctccttgtcaggtgcacgaaccaactcatctgtgaacatcttcctctagagggtcttggctttggctatttggggaacaaagattccttgagacatgtgggtgttcctacttagcctcagtttcttcattttactaaatctttgagtgttaccccagatgagtcctctgttaccacgattacggtgaggcagccctgccttcaaggaggtctctaggttgaactgctcctagggtgtggggcctcatctggtgacgttagtaccccctggaccagtgtagaagctgaggaaaattctacacttccttttttaaaatgcctttcaggtaaaggttgttgctgttgatgcagagttgaatgtcttctatgaggaaagtgtgcattttgacagagatcttccagaatttgggtatgtacttgatgtgcatgtgtgtgtgatgggggtgttggttttggggtcctcccgcaaacttttgtattcgcagaccgcactgttgaggctttgccaaatacaggagtggtggtctcggcagacctttcaagcatctttttttcctatacctagagtgccatctcccccatttcttcctaattccattcatccattcatgaagtaagcatcagttgagacctactttgtgccaggtgctaggacctgatggcgaaacaaaaagagaaagctctcccagagcttcccactgagtagtggagactggtatcaaacaaagaatctcacaaaagagtgtttcattataaactctgagaaggcctctgaaggaaaggaactcacttctccaagtgcttattataaaggaatgtgactcagacttgggaggggaagtcccagagcgtctctagggaagtggtgcttaagctagagatcagagtgagtgaagttagccaagcgatggaaggg

SEQ ID NO: 105332 - DNA, 1053 bp, Homo sapiens
gcagtgcagacgatgttgagattcacattcggtctcgtctctttgttgttataggataagttctcaaaggtgggattcctagatccaaggcttctgacacacacactgctgattgaacctcagtggcagtgtttgagtgcacctgttcctcactcccatttcacctttattcacatgttgattcactcagcatttagtgagtgcctattatgtgccaggccttccttcagtgctggggcccttcagcaatcaaggcagataaagattgctgttgtgagccatgtgtggtagtgtgcacctgtagtcttagctacttgggaggctgaggtgggaggattgcgtgatcccggagttctaggctgccgtgagctatgatcatgccactgcactccagcctgggtgacagagtgagaccccacctatatatctcttaaaaaaaaaaaagattgctgttgtgggctttgtgtctaaggcagggcacagagagtgaacataacctcacccccttcttttccattactgcctttgtctttctttgctgtatatccttggtgtcttgtcttggcctccttgattctctgcactctcggaagtgcctgacagtggagggatgtttggaccccttcagggaagagacttcacagctcaaatcagcggccctgctaacagagacttcaccccgtgacccctatgaccttctcctcttagggcctcctgagcgctcagctcccctgctcctgcctccaccctagggtgtgggtgggggttggaggtgggggctctgcgcctgcctggagagccctgtggtttgctttgtggttcccatgtggccgccagctaaccagaagctcccctcccattctcagcgtcgctggcaggcatgagactggaggaaggtgacattgcggtaaggcgacttcccacacccataggctctttctgtttccacactcacacccacactctgataagtagcagaggtgctgctgagacccagatcccagggtcccagggtctgggtcccagcaggatctctgctacttatcagagtgt

SEQ ID NO: 105333 - DNA, 1096 bp, Homo sapiens
taaactgctttttctgcccttctaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccacaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatcc

SEQ ID NO: 105334 - DNA, 1933 bp, Homo sapiens
atattttactggcctggcacagtggctcatgccagtaatcccagcactttgggaggctgaggtgggaggatcacgaggtcaagagatcgagaccatcctggccaacgtggtgaaatgcgtctctactaaaaatacaaaaattagctgggtgtggtggcacacgcctgtagtcccagctgcgccagaggctgaggcaggggaatggcatgaacccgggaggtagaggttgcagtgagccgagatcatgtcactgcactgcagcctggtgacagagtgaggctccgtctcaaaaaaaaagtatatttcactgaatttgatatatacaaagtaatttcagcctgagatcagtattaaaacgagacattttgcattccatttttgtactgtcatcaaaatccagtgtgtgccttacagaacatcctcaactctaactttccacatttccagtgctctgcagaacatttggttagtggctaccatattagacaatggaatctcagaagggaaggtagaatttatggtgtaataaatgtcacatggtgcttgtcacaagatcagtcagtggttagttggttctttaataattcttcaagtcttttgtggtctgtgcttggccgagtgtccttgggaaacaagccatttggctcttgcatttcagtggacatcctggacactcaatgctgtatcctacaagaactcctgacacctgtctctgtactctgtacttggggttcagatcaaagggcttatgggggtggggtaaacagtattctaagtgaagtgaccagagctcttggagagggacctgcctcctgtctatcccatcaggaagtgcaggccctgattactctgataggctgacccaaagaagtttcttggccacttccttgggggagggcggagggagtgagctcatgaagtgaagtgactttcatccctcaggcctagtgtagcggtagctgccaaggacatgggctacagagccatgggccgtgggtgcccctcccagagaagagtgttttctgctacctgtccttgtatctgctgggcactcgaggctctgccctgtctgggtgggctgccttttgggaggaatgggtatcctccctagctcttaggggccctttcaaggcagatgatgtgagaaacctgcccatctttccaggccctatagctgggtaaaaacataagatctaaaccctatggcctcccatcacttgggtgggcctctactgtgtactactctgtgggtctttctgggcatcaagaatctccagaagcacctggacctctgctggcacttcacctaaggaactcctgttataaggagccaatgaagagcccacattctatacagtggtcctccatgtcatagacccctctgagaatctgatgaaagctgtggacccttcctccaggaaaatgtaaatcggtatatgtgtgcatgtgtgtgtacattgtatgcacccactctgttttgtacagatactgggaacctactgccccctgattagactccttgaagtcctggctgccctgcacatatccactgtagtagtcttaaggggcagcttgttctgcgggggaggggtgctttttccaccttggtacctcacttactttgccttttgtgatcctgccggatgttcagattctagccctggtctctctttccagaaagctgtcctcttgagtgccagcctatgcattcagcccctctgcttgggagctcagggtagtgcaaatgagaaccaaggagtatcggttcaggagtttagatccactcacggatactgacctgtcaccatggattgggatctggagggttgaggactgggtctggataatatttttgctagtgactgtagatagactctagatagtcctgaggcagggtcctggttgcatgggcctcactgtagaacagggtttc

SEQ ID NO: 105335 - DNA, 1231 bp, Homo sapiens
tcaagtttgtggaactgtttctagtacaaatgatactccaatcagctttcccacattatacatatgatgtgcgctgtttgtgtcttagtctgctcaggttgccataatggaataccatagattgggtggcttaaacaactgaaatttcttttcttacaattctggggactggaagttaaagatgaaggtgctgtcaggattcgtttccagtgattcttctctcttgggttggcatatggtagccttcttgctatgtactttttgctgtgtgtatccactccaggtgtctcttcttataaagataccagtcctgttggactggaggcccacctttatcacctcatttagccttaattacctccttaaagtccttatctgtaaatatattaatggcaaaacctgcaattacttttgcaccaacccaatagtcacattggaggttagggcctcaacctatgaattttggtgggactcagttcagtctatgactgtctgaaacaataaagtttggttgaaagtgaattctgttttcctcttgagtgacattttggaatggaagttaattttttcagggctttgccctggtgtctctgttgttcttgcttaatactgcccatggacaatcttgtctacactggtgggcttaatttccgtgtatgtgtgcaggttcccttgcctttgggcatgttacgatcctgaaaatatgtctaaaagctgggtgaaaagtagatatggagatgtacttttctgataatcaggaccaaatatctttctaaaggtaactggagaaactagaaaaaataaaacttctctggttgaaggcattgtatatctaagaagatactgaagaactaccaggccagtatctgcatgagaacaaaggcctagggtgatgattttggtatttgagtctgtttttagtcataggggcaactgagaggctgcatttgatagctttgtggggctaggaagacaggaattggagttctaagcaaagggtgggcagagtcaatcacttatttgggattgagatcccaaagatatagaagttagggggaccaaaatgtagacaaaccctaaagttagattgaaatattctgggctgctgggtttggtggtgcacacctgtaatcccagctacttaggagactgaggcggggaggatcagttgagcccaggagttcaagaccagcctggacaatataggaagaccccatctccaaaacagaaa

SEQ ID NO: 105336 - DNA, 1762 bp, Homo sapiens
gtgcagcggtgcaatctcagctcactgcaaccactgcccctctaggcttaagtgatcttcccacctcagcctttgaagtagctaggaccacaggtgcaaaccaccacaactggctaattttttgtatttttggaagagatggggtctcaccatgttgcccaggcttgtctcgaactcctgagttcaagcagtctgcccgtgtcagcctcccaaagtgctgggattatgggcatgagccaccatgcgggcctgatgtaagaattcttaataaataagtaaggatggacctgaatacttactaaaagctctgaggccatgggtggagttggcttaatctagggtgatctgattgggctgttttgggaattagttggattcccctgagaaatatcttctgttttctctctggagggggcaggcttggatatcaacatcctggaagtcaagggggttgagaactaggggttcctgtatttggtatattgttctgtattcctcctgtttcagtgtgatacctgtgtcctcagatttgcctgctcctctttgtcgaagaggctctctgttcattttctttagaaaataaacataatctccgctgggttggagaggggcaaccatgatgagtggtggtgggatctgaggatctgactgtaccttactaaccaactcttctgtctttagactcatttttaccccattctttcaaagacatctggtgccacaaattcctgagttttgaagggttctgtgggggaagtcacattgcttttctactttatccagagccaacttaggagtctgtgtgatcagttaccatgtgtgtaagtgctttccagccttgaaatgtcatttctgtagttctctcctgttctctttgttcttacaggtttatgcattaaactactttattgcagttttagtgggactacaagagggagcaaaaaggaaatgtttgtgtataatccttgacctttacctggaagctctccttccagtgttttccaggaatgatggggcctggaaaaaggcatgtatttcagagctgtgggaggatggtgccagggccttgtttacaaagtccaagttggaagtgacttgaggtcacctggcttggttccttgtttctaggcgggacttctgaaggcagatggagctcctcctgtcaccttggaaggtgctcctgtatttacatttctggcatttgtagtgaacaaaacagtggaaaatcctcatgcaaaatacatagaaatgctggaaaaagtataataaacacccttttaaaatgcatatacattgctgcatgtataagaagtaagggaaaaacaagaaggagctggaaactagagctgtatgccttcactgactgaaactgctgattccttggggactttgcctgtctttataatttagagatgtgggtttaagtagcagtgtggacaataggagagaagatgtggaattgagactgaggcctttgcatggcttcagacttctgttgtgttataccttcagtaaaaatgtgggccagaagaaacatgtctttgttgacaaagagactaaataatgaaattgtctgagactgggtagggttggggttggggtagtttccccgagaatttataaccataggcctatgctcatgtgagcttggcatttataccatcctgttctctggtaaactaagttgagaaattaaagtggttccaaatagttaatgtcctagggagattggcagaaggcagaaatataagttacctttgaa

SEQ ID NO: 105337 - DNA, 6465 bp, Homo sapiens
aatgctgtaaattcttctcagaaaacttgcatcccaggccagtgtgcctgtccacaacccctctgagaatatatgggctggcctttgatagtgtggggactgggacagggtctgcccagccattagggtaggtgttgctttgccaaccctgggggaagccttccatctgaagtgcactgagggattctcacacccatgtcggcgcctgcagctgcctgcttgtgctgcttcacctctgcaccccaggtagggtgggatggcctggtctggggcctgactctagggcacagactctagtatcttgggaaccaaggtgggagttggatcatgatgttaagctttatctctgcccacttgtttccacagggactttaaaagtaagaatgtattgctgaagagcgacctcacagccgtgctggctgactttggcttggctgttcgatttgagccagggaaacctccaggggacacccacggacaggtaacaggcctcacagggcaggaagagagggacagacccagggtagatactttgccctttttgtgctcagctggggaggtgcagggatgagggtgactgcatgcgttcagagctgtctgagaacttagagcaatgctcttgtttgaccagtggagaaaccaagaccaggaaggcagtgtagtttagcttccgtaggacagtcagctgggaaatgtagagattccccactggggttttgaccactagtccttgcaatcttagtctttctctcacttttttagttttaattcctaagacaaaacaaagaaatgtactaaggatccaaacaaagaacctggaaaaagtaactaaaaattaaacttaggaaatcattcctaaaacaatcactgttattattttttaagtgttctccttccctctttgtttttggtcttaatctcagtcagatacatatcatctgtagttccttgtattaatttggtaacaattccattttagattactattatctccaggatatagtatttaaaaattattagccaagtataattgatgctgtgacctcttgtaactgttgtgaatgtggtgaatcgaggtttgctatcattgataacctgtctgaattgctctgtcttgcccgccatctggtgcacagaggctgtaactcccatgtcccagctgtgtgtgtatggccagtcactgtaaatcctgccctcctctgtcctcacataggtaggcacgagacggtacatggctcctgaggtgctcgagggagccatcaacttccagagagatgccttcctgcgcattgacatgtatgccatggggttggtgctgtgggagcttgtgtctcgctgcaaggctgcagacggtaagtaggatggcagccctgggcatcctagattgagtgatagggagcagtgggaccttagagtgatcctgccaggctctctctttctcctaggacccgtggatgagtacatgctgccctttgaggaagagattggccagcacccttcgttggaggagctgcaggaggtggtggtgcacaagaagatgaggcccaccattaaagatcactggttgaaacacccggtaaggggcctggttcaggcaactttgcaggggggtggagaagggaaaacccttcatgtgtagcaggtaagctgaaatcaagggggaatgggcaaatagaaagtctgcgacgttccctggactctagggatgtgttccaggggttatggggagtgaggtaggatgatgtccttctcctgatccccactttgactgaactgctacattttgggcacttgtatggtttgggcttccaataagattttgtttgaatatcagcacttcaaggcaagtagtggtgtctatcctagtaggggccttggtgtctccttctccctcctgtgtatgttgaggttcaatgaacctttcctagggctgtggagtgaggccagtaagctcagaaagatgactgccatgaaggcaggcatgctgattcctgaagttttccccaggcctctgctggtggacctgctgctgtggttggggctggtgggctctgcctgatccttgggaatatcaagtttactgtcccccaaagcttttcctcactgaagggtcctaacaaaggtgtctttcctgtctgccctatgctgcttagggcctggcccagctttgtgtgaccatcgaggagtgctgggaccatgatgcagaggctcgcttgtccgcgggctgtgtggaggagcgggtgtccctgattcggaggtcggtcaacggcactacctcggactgtctcgtttccctggtgacctctgtcaccaatgtggacctgccccctaaagagtcaagcatctaagcccaggacatgagtgtctgtccagactcagtggatctgaagaaaaaaggaaaaaaagttgtgttttgttttggaaatcccataaaaccaacaaacacataaaatgcagctgctattttaccttgactttttattattattattataattattataattattattattaatattattttttggattggatcagtttttaccagcatattgctctactgtatcacaaacagcggacacgtcagcaggcgttgaggtgctgagctgtggatgcagaaccagcgccatgctgaagagcctcagccacctcctgtcctttgggattcgtttttcccgctttctctttgtttgtcgtctcagaatctgtgacacaaagaaacccatctcctgtcttaggaaacctaatgctgcaaactctacctagaggaacctttgaagactgttacataagaacataccttcctcagaagaggagtttcctctgccctctgcccttctcccctgcctccctccctcccctccttttattttgttttagtgagcttaagaaacagcagatgtgtctttcacggatctaacgggtgttgtcctgatcgagaaaaaaactgggatgagaatggtttggactggagttggaaggggaggacggtactgggggtagggtttggaacagagctacactggactcgggcacattcggagcagcatcctttagtatggaggctacttctcaggtaaccaggaattgaggggaaggaccttgtggaggccgagcattaacagcaagagcggggtttggagaaagtctgagattgggtgcagccctgacttacctgctggccctgaccagtttcttttcactaacttggccttgggcataggatgaaacattttttctgccctaattttaaaactaggtgagggtagaatcatcacaggttaggaatacattcttcataagacacgatgctgtaaatacccttaatggacgaaaagttgaaatacttttgtttcctcttggagcagttcagggaaatgcccacaggggattgtcctgcacagatagggcaagaggatttcctgggtggagtctgccaaggcctgcctcgctggggaccccagagtcctgcacctctggttccgccccaggtggtgacattactgtccccgttctgtggctcgtggacaagactttctccagaccccttaaagtggtacatattctaaaaaactgtttttctattatgccataaccttgctctagtcagtgaatgttcctaatgctgctgtttcaacatttgaattctttttaatttatgaaacatgctaaattttttttttcaaacaaaacacacacatccacatatacacatgcttcgctatgtggcttccaaggtttaaattttgaaaagtaaaagaattaaaacttcacgaccacagatcacctcaaaccagaaatacctcagaattttctacttatgtaaggtttattatatattttgttagttgtgttgtcttgtagtaagtatattttaatgtaagttggcttttgtgacaaggaagtttaaaagaaatagagaaaaagaaaaaagtttgcatcttctagggagtgctaccatttttgtttgataacgcccccttgtaaataattgtcatcaactgtaggttggctgtctgggccaagtctgggcatttatcagtcttgtttgtgaaggcttttccttctggtttctttagatcattttatttaaaaacagtgcatctcttcatcgtgagggtaggcaaggcgggggccgtggggagaggttgacctgggtgagaactgaagaggccgcctcctcttgggttgtttggagcttcacatgtaattcacatgtaacatgtaacttgatcggtcagtgttcagaatgacaagtaaccccgcttaaacttggtagaaggatggcccttagacctgaatggggtgattttacttgggatttaacttcttcagcaaattaacagcaacgttggaagagatctgtggcgcctctgtgaagcacaccgtgactcaggccagtcttttagtgcagcgtgtctgggagtgaagggttttgcccttgctggtcttggagtccacagtgtgaggggcactgcacatgcctgggcatctacctagtgtgctatgttcagtgtctggggcttactgccccggggtcctttcctctgggtgttggggcacagggtgctatgggaggcccatttgcttccctctcggagctcagtttttgcttcatgggtcaaaatgtgggctggccaagtggttacaggaacagggtttcggtaagctatgttgtctttttttttttttttttttttttttttaatggtttgattttgtgctgtggtattttttttcccttagaataatttttaatggcaaaacaggccttacagcagttgcttttctttaccatttatttctttaagaagctttaaaatatttattgaaaagtgccatatctaatttctttagctttcgcctcaggcagtgcaggcatctttacttttcatcctcagaagaaacaaacgactaacaaatgtagcaaatttactgcaggaatagttaggtcatgatactacctgaacactaaaccccagcctctttgtttggttttagttcctctgggtggtttttcttttgtgtgctggcttgattcttgtgagaagttttgacctggccaagggagggttgagccatggttctggtgtgggactttgcggtcaagacacagtacagacaggtcaggcctgcgtgccttttctctgggtggcctccccgttaggcccaccgtacgctcagccactatagtgtccctgtggggccttgccatcagattgtgtgtcaggagatggtacctttttggtgtggctggggaggagtgtggtccatgccagttctttgggcttcaggccactcttcccctcatgctgtggtgtaaagtgcacccatcaggtggtatatctggttctgatggcaagaagaaggtgggggatctccttatagggcatgggtctaggagcacagatgggccttttgccccgggtaaatgcttgtctgtttgctgtcatgtgttctttgaggagtgagccatctcgagccctgctttgaatttactgggtcatagagcctctgcctgtgctcttttccataatgacttcatgtgacatgcacttttggtgggctcagataattggtttctttttgtttttgacctcaggctctgtggcagactggggaaaatggggcctggcatcattttccctgtcaatgggaggggctgttccatgcagggtgggaggggaccaagttagcagagagtagccaaggatccttgcttcttcctttctagtgtgctgtcatccaagcaggctcctggctgtagggatgggccttggggaagaatcttctttgaaagcatctatgataactgagaagtcatccctagttggagaaatccagtaatgagcagaaggaggaagcaagtgaggacagaggccattgtattacagtgtcacgcagagggccctcaatgatggggcattggggaaggctgtagacatagtcatcagaacatcctggcctggcataagctgggttttctcctgggaccattggtcctcagcaggagttctttgcatgagttgctcaggggcaagggctgcaagtgggctgtgcttaggagaaagtgacacctggcagtgagggaagatggtgagcattattagcctttgttgtccagcatggccttcttgtcctgtctgctctggagaggagcctgtgggaccagtcctgcctggggagggcatacccacacgtgccagctgattctgactctgaatacatcatgtccggacttgggggtgtttctgcagaaaaaggaggttgtttttcagccttgaacatcttcaggaggatagagactcttgctcacatattcttagcaaagggaagggtctctcatctccaggccacagagatagttcttccattgccctaagaggctaggctaaccctcttgacataacttagacagcaaagcacttcatcctgtagttgggctctgtcacctttctcttc

SEQ ID NO: 105338 - DNA, 6068 bp, Homo sapiens
tcgtttcctccatcctgctatgctttgtgtgctcgggctgtgtgtggggtttttccctggtggaaggaagcccagctgtgtattgaatgtccttcatgtgttgtgtgtggctcagaaagcctgtcacttggcccctgtgctctgagccgtgagggtggggaggtggctgttccattaaagtgggagtattggatggccctcttgaaactagaattttgccttttttagtatgcagtataaagtttccagcatctattggtaacacaaagatttgctggtttttaaaataatacagtaagcataagtatgtaagtttttagaattggtactagaagttggacagctagttattctcgagaactttatttcactagaaaaatatactaattggaaagcagtttccaggagttaactcagtttaattttcagtctcagttattttagcctgttgagtttttgatggcacacctttggagagatggccacgcctgattcccatttcaggggcatcagaccatacctttttaagaagctccgtgaatctagtcatctacccttcatcctgggcgaacagccaaaaagagaaggggacaaggtgtctttttctccttctcactggggtgacatgaattcttttagttaatggctgtttgcaaattctaaactaatgaaatacttagcagctaacatgttcaatctagtaatgatgagtttaaatctcaattgacagtaatgttttagataaacaggcccagtaattcagttgatgaactgtatatcttctcagtctagatttgtaaatgtttaatgaattcagggttataagcatagttctttaagtaagattccagatagttgatttgcaaccagcagtctacctatgaatgtatcccaaacctttagaagattggaaaagatttttgaaataatgatttagttttgtaggaaaaacacccccttgaaaattaattcggttgacccagtaacattttttaaaacaattggtggctccaaaaggcctgccaacaaagaaaagtccaaattatctagtgggacattttgaatgttttatgtttattttgggtccactgtaaactttggttcaaaaaagaatttgaatttaaagaatttaccattatttaaattattaccaagtttttacattttcatgatggtattttccaggtatgaatgaaacatgactttttgattgtggtacttcctgtatcccctgtagtgccaaaaccagtgatactttatttgctcctatggcagctcatagaggtaaccgaagtgatttttcctcagtaattgaaacacatattctctaaatgccaatgtgtggtgatgggccctgcactgccttcatttctctagggcagtgtctttggattgtctagggcctaggtaattctgagaactactgtaaaccaaccacagggcactaaagcaatgtacacaccactctttgtgtgtatggaaggggttatataaacctgggctatgctggacatctacagaagagtattacattcacttgcaaagtttacatttttgagctcacagttatgaaaaatatgacccacaagtttttcaggcaggtgaggatgggtcttcttgcaaatgcatgagttctgtcttgagtcctgggaacttctctgttggttgagtgtgggctcattccctgactctcctaatcatgtttgcgtcagaatgttagcattgtaaataaaagaataggttgtataatagatacacaacacttgaaactttactttaaaaaaatcgatagttctacatatatatttagttatatcacttgacagatttcttctacacagtgtggagattgttttataccacagattatttttataaagttagtgaatttgaatgattttgtaatcagagctaatgagctttacctttcaagagaaacgtacactggagcatgagtggtgtggaacttttacttagtgtttatatggattcttgtgatacactggcagactggagtcaatttgcgggtcttttttggccaaaactccacttgtggttgtgtaggacagtgatattcagctcagcttcttgtggattgggaggagagagggcctgcaatgtgttttacattggtgcttcctcctgagatttctgttgaacaaagggttctgaggtcaaaaattagtttgtaagcctttgccataggacatagtcatgtgagagtgtttgggggaacagaaattgtataggggtgcctattggggtgggatgggactcgaataagattcaggtacaaaaactttgaaatgagaatctggtggtttgagtaatccaccagactgaattatctaagatcacattatccaggttggggggcagaattacccagttaagtaattgttcagaaaagtggggagggtggcatgtggatgcagtgatccaattaaatggagagctgccaggcacattttgtcctctctggtcagtgagaatggttgggttggctcgctgcttcaatctgtggaatcagccaggagcccagtgaggaagctcagaaccccagtaacagcagagcatctttcagatagctccagagttttcctgcttttctgaggaagctcagcatcactgccacaatacggaaagtggtcttcattttagcctatttatttttaggcagagagtggatggttatttgtgtgggacttttggtggcgatatataatgaataattaagttaatttctggtatgcataatggccagtcctgaggcccagctgaagacctgtcccccagaccctgcccgctggcttcaggctgctgcttctagacagaggtgcactggacgggatagttttatcaagagaatccctaatgtgtcattttaaaccagctgtgctttttattcattctggttgagcgtataggtttacactttaccctttttatacttggaataaatttagttccagcagatctagtagcactccagaaaccaaccccatctgttccccataaaaagaacattttctctgctctccagccacgtgtcttggaatgtaattctgttgtgcctttgtttttatcactctcttcgccccaaaagcaactgctgtaagcttttttctacttgtcttttctagtccccaacctctacctttttcctttttcccagccctaatttctggatgcacttctgtgatccaggtattttaagaaccagttacctcagacctcatgttgaacagtgtcgccatctgggtcctcttgatactgcagacttttaacgtacacatgcaggaaccctgctgagcgtgggcacttgttttaaagcaaaactcttcccaaggactgaagaaagggcttctggcaagctcgtcatggcattgtggtgggatgggtctagagtgtcatctgaatggtgcttcctgtgttcctctttgaattctgccattttcagtattcttgtgtgtctgaataggcaaagcgatttaattggctggtcttgcacgcaaattagttccaaagataagctctttgtaacacatttccagtcgctaatgctcaaatgtagaacattcctttaaatggcaggataaaaaacccactatccaccatagtgcattttgggaagatgtctgtagcatatgttgctgtgaaattaggccttgtgggatatggctgtttgtcattttgatgtattttaaataaatatatatattttttaaagagccttttttaccagttcaaaaagtttaattaaccagcagtcaccgcatctgaatttttgtctctggggcatagatggcagaccaagattaaaagtggtaactcagctatacgagcatgggctaccttcctgggctctcctgcagtcctgtagacctgctgttccgcagaccatgggacacaaggtcagtgtgttcccagtgagggtcccaagtcagtcatcttaagtgtttgttctctgccccattcagtggactgttgacttcagtccctgcaagtgctttagcccgagtggggttttctcagagcactgccacgagttaagtgtgtgtttagccaaataatttctccgtaagggaaaaatgcagtcacccaaattttaccaacaatgacagagatgagagtagaaaagattaggcaacatctgagttttaacttgaaaagtgtccaagtcatcatgaaaggccgactgggagcaagtgattattagagattcttcaggagacctcatctgaaaatgttaagactgccagtgagggaaggaattgttaaaatgccagcggcttttttttcctctttttttctgtaattctgtaaaaatgcagagaaagttgagtggtacttcagaattgagggagagggttaccgcagagtagaaatatatttctagatttcagttccacaccacaaatccacaacaatgccatttttcaactgtacaaaaatctgcttatgaactggacatgatcttaatggtagtgtcaaaggccaagtttttcacctgttaatatttttccacatttgtccttgaatctgaataactttatacagtactgtaaatttaacttacatcgagtttgttgtcaattcttatgaaaagagctttctgcatgtaacacatacggttaaagaacacagcaaaggacaaaatttgcaggaacagttttggaaccaacagaaaatgtcaccttttatttgccatcttatatatatctatcagttttaccagctacttctaaatttgtacattatttgtaagggaaagaaggaaaaccctaagacttgtctaacttagtggagaatgtgtgtgttgggcttaggatggatagctaagtcttattgagctgtgttacctaacttgtatataaaaattgtaattaaaagtttgggttcacctgtttctcacagtttaaaatgatgagtaattgcaaactctggaaatgtgactagtatatgatttaaggctgtagaagcaaggaagctctttcaagtgctaaaactaaagacttctagtttttggctcaaataagtactgtttgtataccaggatatgtgagatgtaaatgtagtaggtcacttttcacccttgtagctataaaataaaaattttgtagaacagaaatagcttgtactactgaattaacaaaagttatactaaagtatcatgtttaaaaaaaatatatatatatatacagagttaagcttgttgctgttaccctgtctggatttgaaaagtgtgctgatttatatatatatattacacacacacacacacacacacacacacacacacacacacacacacacacacacacacacacacacacacacatacacctaaaatggcctaaagcagacatccatgtaattacagttgcaaaatgaaaacattttggaaagaacattgtatcatagttcattcatttgcagtggatctttgttcctttttactgtggtaattttagaaatgagtgtcaagtttgaaattagatctgctaagttggggttttgctgcttgaactctgcactgggtcctcaaataaaccgatgtgaatgtagttttttccccctgtgtgaagaagcagttacaccccaacaataggaggaaaaatctagaactatttcaagttttatctttttgtatatgaaaataaaataataataaaacaatcttgtctttcttaattacgtggcaggggattggagtttcctttcatgaggattagacatgaaatgaaatggcgttcggctgcttagagggctgactcaagtcagttcctgtttggtatgtgtaacattaacagatgttaatggctgaatgcctagtctgccatggtcctgtggggctggagctaagcacaggtctccatttctgccattcagaagtccagggtctagttggggacattatgaatggggaccattctcctgaacgaactgttctgggattttgagtaagtttctgcaggttagcatattttccaaatgtccaagacactccccattccctcatcctctgccaccagtcctgtactttgcagacaaccctgagcaatatt

SEQ ID NO: 105339 - DNA, 1048 bp, Homo sapiens
tgagacccaggcatcaatatcaatatttttaaagctccctagattattccaatgtgcacccaagattgagagcgactgcttgaagagaaggtacttgtagcattggcagttagtatagatcagtgaggaaattacagtgaggtagagccttgtatatttgggtgaaaaatgtgaagtgaatgaacacatagtggccagatattcagaagaacaaggacgttttctctgccacttttgaactagtatgtttgtactgtactaaaataacttttgtgaaaattgatctctattgagaaactctttgccagaggcttaaaaccagaatttgcccttaagctttgtgttggaaatatttagttcttagaattcacgttataggtttggattttataattgataagcctacctgactacttactttatagtcctcattttgaataattattataagagctttctgtcctggaataattatggctttcatttattgaaacaagtagtcaataattgcctagcactaatgtttaaataagaaagtgtttttctgtgtctttttaataaaatatcttttaaaggggaaagcatttcagtgcaagttactatgtttctttctttacagaaagccatggctgaaaccttttacctttctaacattgtgcctcaggattttgataataattctggatattggaacaggtgagggatgagagttttaaaaacatgattctatggaagataaatgaagtgacaggagaatgtactgatgtgcctattagctgtttctgtctttgtttttcaaaagctaagcctctgaaggtaagtatgttgggccagttttctttgctgtgttttgggagtacagccttctacagaagatcagacttcaaaacgtagcctgcctttttgatcatgtttgccactgttcaaaagtcaagttttgaaagaaatgactcaaaataataatcttaataattgaggcagcatcttttttgagtgtgttcagtgaacactattattttctcttgtattccaatatttcttagctttt

SEQ ID NO: 105340 - DNA, 1033 bp, Homo sapiens
ccctaccctcaccctaaattttcaagtaccattgacagcctagaaagagggtgcttgttttactgtgacttagtaggctgctaccctttggcctggaacaggtaccccagtgtgagaagtaccgtcttccagggtttgtgctgccacaaaagcatctgctgaggctctatagataacacagggggcgaccacattcttgttgactttaccacactttgtgactccctcacttttcatgttccttccccccctcaggttcggatttcctgtttatcaaactcccatggtttctttctttcacttgatcggcatgactttttaagggcgtggtctcttgatctgtccctctagttttatttttggagtttctttttttgtcttaccaggggaatgtaaccaaatatatctatctaattctagcaggtacatattttttcctcttgatgctgcttaatattttattggaggcacatttacagtatgtatgaccttacaaatggcaggcttaatatgggtattgtttgttttgggtctcttctgggtctgggtggcacaggtggtggtggcaaattgtcatttctgtctcttggatggaaggaaacaagctcaggccagtatataagaaaactagcttcaggttgcgaatgagtgccagcttatgtattgtattttctagttaactcccagttgacttccaatttttgctacagtcttgagtagagttcagtgcttcttgggaatttaatagcagcaagggtttcctttgcaaaatatttttatacctaaatcttacatgaaaagggttgtttgctgactcactgattaactagacttggtttatgttaagcctttgagtcctttgttacagacatcatttgtgcccaagttgctttctcctcctgaaaccccattgctgacctgtaactagtctaatcttgcttgattatacgtttcccccgcccccatccctctgtaaaaccatcttttgtaccaaatgccgttgtatcttttgaatgatgtccactacaaaata

SEQ ID NO: 105341 - DNA, 1003 bp, Homo sapiens
ttcccccaaaagatgaaagatctacaatgtttttgtcagtattatatttgactcaggaactaattattaagggagctttgacacctgcagatggagggctgatcttgtgtcaagttaacaggaagactgcccacagatgacactgcatttgtatccctgtggatgtagagtattgggaaggcatttgtttagtttcatgcctccaaaccatgcattgtctgtgatgtatctgcccagccttctcagaactcaatgttgtacatttttccctctaggacctgaattggtcttggaggcagcttttagaaatcctctgtgtagttcctgtccacatgcactatatatttgtttcttttttctcctctcatgaatctgctcgtttctctacttctgtctacgtagaagcactcagcaactagtttctgctcattaaatgtgttctatatactaggctcagtgctttacatgtgttgtctcacaatgactctctgaggtaaatacactatccccattttacctgtgagaaaattgaggcttagagagcttagtgtcttacctgagtttcacttttccaaagtagtcatccacaaagtatgaggcagacagatctaagagaagaaagacagctgaggtagattcaaatcttttctgacatggatggtggctttttactcagaaatatatacctatttccatgggtatttgtgggcctgaggcatgcttggcaagaagagtctggtttctcgtctgctatgcaagccaaagggactttaatgttctttgaattgaaccctccttagctctgtggaaagagacagtcaggaatatttgggaattagacggcaatactttgtggggtttattagagcccatgcttgcctccagagatacagttcttttagtgaccagatactgccaaattgatgtgttcttgctttccaggtgagctttttgttcttaagattaagaaacctatgaaggatctgcagccaggcatggtggc

SEQ ID NO: 105342 - DNA, 1052 bp, Homo sapiens
tggagaaaatatattaatctaagcactgacataattactaaggttgaagtttaaatttgcccttgagccttcagactgtgggaactaaaagggaagcacaatgaacagtgtgctaaggatgctcagggcaggaacaatctctccctgaagatccatcatggaaggcctcatggaagatggagctctggggatgggccttgaagcccaggaagcatttcagcaggacagccagtggctttagcctccaggactttttcctctgcactctctgtggcagtgttgcaggggctttgggctcactagagggtagagtgggagggtgggtggtctgggatgagaggcagcaacaggcatttgccagcctccccaagggccctgctgagcactttccatttgcctctcctttcagaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggtgggtatacaagtcagctggacggagaagccctccccagccaggcctctcctccagcccctgggtctctgctgaatgccatgtacaaccctagcttctttcataatttttttcagtgcatttctcaccccccttctcccctcacacatacacgcacacacacctctccagagagaacttatctggaaggccccacttgggccaaggagaccaatctggcagaggacccagcacttgctcctggccccaccctccagaggaactgggaacacagttctctaactgcttagagagcttcaaggatgagtctgggaatgggagtgggtgctgtggaggctaattctgcctgcacttaggttgaaggagaaggaa

SEQ ID NO: 105343 - DNA, 1049 bp, Homo sapiens
tgaaaaaaaaaaaaaagacatggaaactttgctggaccagggaaagtaagagcctgtattgctggggaggtgagaaccccatagatgagcaactaacagagaatgctttagactgcagagtgagagaaagggcactttgatccaaggctatgtgcctccattccatgctgcctcctcctgtggggttagaccatggggaggcactgtggctgtcatttttaaacctctgggcctcccaccccacccgatgctgcctcgcctctgttccagaatgggcctggagccatgacttgcagcctgcctgctgttttaccattggcagctagagccaaatctctgtaggcttcagagaaagatggtttgacaatatgttaactagttttgtttttaaacagccacaaacaagggcagccagagccatttcgtctgggctgtggagggaaagctcagcttggcataagtgaggaggagttttggcaagcatctggtgaatctaatcagggtagacagccaagctctgttgttaaaaaaccacgtcaatgatatattgagaaaaagagaaatctgagtgtgttatttaaagttgtaaacttgtttaacagaaagcaaactatatcctttccaaattgctgagggaaaattttttttaaaaaaagaaaaaacagagatctcacagcaaaaggtagaaggaaaaagaagcaacaagaaaacaaaatcagaaaacaaaataatataatagaggcaagatcaaacacatgttttaataataaatgtaactggataaaattcatcttttaaaaggaaaggactcaggatggatcaaaaaaaaaaaccttcagccatgtgctttcaaatgacaaacctaaaacaatgcgactcagaaatattaaaagccaccaggcatggtggctcgcgcctgtaatttcagcactttgggaggctaaggcaggagggtggcttgagcccaggagttcaagaccagcctaagcaacatagtaagaccccacctctacaaaaagatttttaaaaattagctgggcatggtggca

SEQ ID NO: 105344 - DNA, 1055 bp, Homo sapiens
gctggagtcagcctcatcctgtcccaagtagagctctggggcatgaattgcaccacagcattgccccaactcaaggctaggggctggccttctgtattcttgtatcagtggctgctgggcaccggccaccccttgggacggcagtcccccagctgaagatgattttctggaggagggccagctaagcagctagcattcaagtggctgggaatgggtgcagtggtcttatgtagtggaattgggcagggtacccacagtggcccctgtaacacccctttacacccacacccacaagtgacacacacagacactcacaagggcacacctgcatgcacatgcctctctgtagcctccctataatcaagttattgaggtcagggcagcagacttgcaaggacaggaagtggagggctccatcaccttctcagtctccgggctctgtccagcacaccagaacccacgggaactgcgcaaaatgtgtgggtggggttgctggcctgttctctgcggtctgaccttgctgcctgtgtgttgcccgggatcctggttctgactctgttctggatgtgacatgcctgtttccactgtgtgtgccacaccaccacgatgtgtccatgtcccactgtgtgtccaggttgctaccccatgtccgttttgctcccagctagatgcagtccccatccccagtggcttcccagagctctttcacagcccccacaccccagccttagactccagcagaccagaatcacagacccgggaaccccgaggtccagccttggcccagccctgacaggcaaaagtggctctgtgcaggtcccagggtgcgtcatgaagatgctgcctcccttcagggagccctaagctcctgcagactctgggctcgaggccaaaggctgctactcagcccacactcacaccctttcccaccctgtcccacacccctgtccatagaccccagaggacagttgctccgagggcagcacagcagacatgaccaacaccgctgagctcctggagcagatccctgacctcggccaggatgtcaaggaccc

SEQ ID NO: 105345 - DNA, 1242 bp, Homo sapiens
gaggaagagcttccaaacagagaggaccagcatgtgtgatggtctggaggcacaatgcaccagaacctggagcagagatgagtggccagaaagacaaacagggtacttgagaccatgttaaggaatttacatccaatcatgagtctagtagtcagcaactggaggtttttgagcagagctgagatagatttttaaataattactctagctgctttgtgaaaaatggactaaagactgggaaaggagtccagtcaggaagcagttatagtagtttagcaacttactcatgttggactaggctatcattgataccatccttctcttcagccctttagtctttaaggagtaaaatttaaatttgtattgggttgaaaaagtacatattggaaaacatgggattttctgtttcagattggccactagtagactatattttattactgcatggcttgtactttataaaaagcatatgttgacacatttgtcaggtttcctatgttattcgagatgaagtggagaagtacaaccgaaatggagtcaatgctctgcagctggatccagcactaaatagacttttcacagccggtcgagactctatcataagaatatggagtgtcaatcagcacaaggtaatgcagggattaaaatctgtacccagcaaattctggacaaatggcttttactgtctaatatgacacttttcacagtttcagatttaatctctctgaatgctgagttatttggtacactctataaagacatcgcaaccagaattctgtaagcctctgagaaaaaccatccctaggaaagtttcagaagtgtttcagctaagacaaggactccctaaactaggtttgccttacagagttctttgccacaaaggaacaaagtgatttggctagtagggggattactttcaacaattaatttttttgctttaaatatgttccccaacaacctcttggtaaccttactaaaaaaagattgaatattcttttacatttctaattaatcttgaaaaaatattttattttcctcacttaaaagtaattaggatcctcacaaaccccacacggcctaactaggtaatacaaggttaggctgagcatggtggcccacacctgcaatcccaacaatttcggaggccaaagtgaaaggattccttgagtccaggagttcgagaccagcctgggcaatgtgacaataccctgtctctgcaaaaaaaaaaacttaaaaattagc

SEQ ID NO: 105346 - DNA, 1059 bp, Homo sapiens
aatatgtttgtaaaattgggttcatactatatagacagtttcatatacatcttttttacttcagtgatactgagagtatgaacatgatttttgctatagtctgaattccttcctgaaaggttgtacctatttatcttcacataagtaatatatgagagttccattgtactgttttctttttacaatcaagtattaccttgttttttgtcttggtgtatgaaacagtgtttttggtttgatttgtgtttgaaaaatactgaaattgaacattttttcatatttatggcacatgaatagctttaaacatatcatttaagcggatagcttttcaatggcactgcagtttatcagatattgagcatttgtatatattcaaatccagaaaatatgtaaattttgataataatactgtttagatttatctccattataggtagatttcttttccgtagaggacttataaagataagattttctaaattgaataaacttgcagtttttgctgactagttactaaacagctgatgatcttgttaacatttagctccgtttatcctcaatagcttcttctttaagtggaaacaaagattccatttatagcctggccatgaatcaactgggaacaatcattgtatcagggtccactgaaaaggtaaggaggagcttatttctttatttaaaaaaaaaaattatttttcacataccttgtctcctattttttaagcaggtattttacgattagcttctttatatttatttatttagagactgggtctcactctgtcacccaggttggggtgcagtggcatcatgatcctggctcactgcagccttgactgctgaggctgtagcgatccttccacctcaatctcctgagtagctgggaccccaggcacacaccatcacgtgcatcaggccactccttgtcccatctggctaatttttgtatatttttaatagagacagggtttcgccatgttgtccctccaactccttagtgcaagcaattcacctgccttggcctcccagagtgctgagattacaggcatgagagccact

SEQ ID NO: 105347 - DNA, 1036 bp, Homo sapiens
gccgcaataaacatacaggataggatttcactttagtccttaatttgcttatctgcaaagtgagaatcataatatatagtttatatagttggtgagagtgtgtgtatatgtatatatatgtgttaataataagtattttcttaactgtaagccagggcatttcctagagctctcaagttcctttgtggcctcattttcacatgactgtaagaattacccagtgcagtcagctcctcactgttttgcagtgtagctgcaaggctgcacttgagatggttgcccgtgtctcttcagttagctttgccaggattgggcgggatcatatcatctccatggtttccagaagggggctatgggcctggcagaccttctaaagctctacctgtctgctccatctcttgtttcctatctatgcaattatgaatgtgcttctataaaagatgatttaagtatcacgtgtacagttagaaatgcacttcatctgaagtcagctacagtcattgtaagcagaggaaatattgtggttctactttaaaaactgcctgttagtctcagagtgcaaacttgataggtatcactcttcatctagtttctcttccacccattttccttattggcaactatggactaaatgtaaaattaccaccaacaaccaagcatatttacgttagtgaattgatcaacaaaaaactataataactgcttatttgggaaaaagagatgagaaaaaaagaaactcttactgattaatgaattgaccaacaaaaaactataattacttatttggaaaaatgaggtgaggaaaaaagaaacttctacttacagattcttgaattcttgtaatatggaagaggtggttatcagttactgggccaaagtttatattgcatcctgctaaattgccctgtgagcttgtaatatagggtacctggtggctttgtaaatcaggaattggcagtaagatacatatcttataggccaatgaatcccatgaatatctacctgttgcctgattcttttgttgtagaataagatt

SEQ ID NO: 105348 - DNA, 1054 bp, Homo sapiens
ttccacaaagcaatatttttgtgctttgttttcagatggagcttgatagatcagctgatcctcctcctgcaatttgggttgcaacaactaagtctacagtaaataaatgggtaagtgagctattaacctggcaaaggtttataaacatgtattttgttatcacagacctgtagacgccagttgcaaatgctcagtgtggccctaactctagcatgcttttgggcaggggcaaaaacctgaaagccctgtgaatgtaggtagaatcctaaagatcatactaaaattaagataatagtcaaaatgactattctgacttctttgtctggagccaagatacatgttccatgtccttagaatagacactgttgcctggtaaaaccagtaagtcttagtacatcttctgacctcatgaagctacatttgaagataggtagcccaagtaccaacaaggcagggaaactcaccaggattcaaatttggttaaacataagagaaagcagaaaattgtgctttcaaattagttttctttttcctcatagcatgaagaacagggatagagatagaggataaacagaagtcatccaaagtgcaccgttaattcttaaatcttaatttaaaaagacttaagttttcttgcttaccagactatctgtaggtaacaaaagagaaggtgtttgcatttattcctgttgacatgcaggtcaagtgttctttctgtatacttattttttaaatgttgtatatcttgtgttaatttcatcatgccaacttatgaccaatacaattttacctggaagagcactcctgctttcatgcatagttttctctcccaaagacaatattcccttcttaaaatttgtttctttctaaacgatgatagataattgtactgtgaccaaatatttttcggttgatgtagtggttgttgaggttttcttgtttgttttttgactttatttttcttgccactttaaacaggctggcaaagcttgtagagcataacatgatcaaataacaaattttgtaattttagactttgaaaggaattcataat

SEQ ID NO: 105349 - DNA, 1418 bp, Homo sapiens
cagcttgtgggttacagtttgatgtcataggaaatgtcagagtttccaagggacatatgtagactgagaagaaactaagtcatcagtctttcagggatgttgggaaaagaggaagccacaatagtatatgattttaaaaagttgcgggggagtaagaaaatgaagagccagtggcagctccagaactaattgagtgtttcaagaagaagcttgcggttagtggcattaacctgctgtgagttgatttaagatgtgactaacatcatggatttaaataaagagggtggcctctgggtagagtcttaagggcaaaagccaggtagagtgagttgagtagtgatttgaaggtgaagaaacagaaaatttgactggataatctttgaagaaatttgattggaggggtaggcaggaagcggcggaaactagagaagatgtaggagtcagagggccaaaggaagcttttgattttgtttggttttgtttggatatttgggtatttttcagatgtaagaaatttgagcatatttcattgctcctgggaagaagccagtagagacattcatgggtagatgacaatacaaggtcatcccaagaagcaagaggtgagggggaccggagcacagtcagaagggacaccgttttccttgcaccagggagaatgatagagaaagttaaggggattctgtcaaggcttctctttgttttgagaaaaaggaatcagagtcatgtgctgaggataatggggaaggtggcaaggtcagaggtagaagagagatttagttgagatggactgcaagacagtgaccccagggctcaagtctccagtaaatgagggagagtggcaggttgctagatggcagtgaaggaaaggtgtaccgtttactgttgctaaatgacataggcctcagagaaataagtttttacatgggagatggtagagtaatggtctccatggagcatcaaggaacaatgggatgtgggaaaataagcagtccccctttgagaagatggccgacaactgggaccctcgaaagagccacgttgctgttaagatgaggtggtatattatatcaatatcagcacaattaaatacagtttcttcccaaatactattttgtgcttttttaatttaaattttttatagcagcagattgttattttaaaaaaggaccacattctttttgaaatgtattttagactgtttcacttagacacatgtgaaaatatgtaaaattttgaatagcaaagtcagaatcaagtgaattcaccacttaatattgatcattatactttcttttgatgtataggcatgtaaagttgaagatctgggcaaagtggattttgaagatgaaattaagaaaagatttaaaatggtgtatgtgccaaattggttctcagtagacttaaaaacaggggta

SEQ ID NO: 105350 - DNA, 1693 bp, Homo sapiens
aagaaagaaagaataagacatgcttgtcttattcttgagtgcaggattatctatctttctgatagtttcctgagtggttaccagaaatattctgacttccactgtgtgtgaaagtctctgccatgcactgtggcactagctggggacctttactgggtgctttgcttgcacccaggtttcctgtcatcacccaaggactccaagaagcagctgtagtgtatgcctggccttggaatctgggggcctgattttagggcctgctttcccttttagctgagtgagtcattcttccaggctgtacttttatttcctcagctgtcaagtgggggttatcctacatgaaaaccatgagggttcctcccgctaatatttgttgacagtgattttgacatctgtgcttgttgggttacttactacttgatggtttatgtttaggctgctctgccgagattccgggggtgagactgagtctatgcttcttaatgaaacagtgccacaatgggtaattgacatcactgtggatgtaagtatcctccactcccactttgctcttttatttttttgtaactcatgaaattaagaactgctttagacattataattttaaaccttaataaaagctagactcccaagtggaatccccatctgcttccttgcagttccaaagttgcagaaatagtactgataattatttatctatctagctttgttggtttttaattataaaaataatatatgcttattcaacaaaataataaatgaatgaagctctcatcttccccaagcattcattcttgcccattcactccctatccttcctcccagaggtaacaactattaataaattaatgcatagccttcagtacttttttctttgcatacaagcatatattatttgtgtacatagatgtgtctacagttcattttatattgcacaaaatctcttatactgttctgcaacttttttttcacctaaaaaaatgtatcctggacatcttttcatgtctgtacatcttttcatgtctgtacatgtgaatcattcctttttaatgactgtgtaagattctactgtataaatgtaccataatttatttaatcagtcccctattaatggacatttaggttgtttccaatgttttctattacaaatagtgctgcagtgaacatccttgtacatatatctttgtgtgctttttaggataaattcctagaagtggaattgctggatccaaggttatgcacattttaaattttgatagatactgccaaattgccctccacaaaggctgtagtagtctacattctcaccaacagtgtatgagtgcccatttccccacacctgcaccaacactggatacttctaatctttgctaaaaaataggcaaatagtatctcattatttttatgtggattaaaaacaaattaatagtgaggttaagcatcttttcatattggccatttgtttttcttctgtgaattacctgtttgtattctttacccatttttctattgggtcatttttcttactgatttgtggggtggtggtttatattgaatattaaccctttaactattatctgtgtctcaattaaattttcactttgttccttttgccaggtgaaaagttttactttttatataatcaaattgatccttgatggctcttagtttcatgtcttgtttaggtatttcc

SEQ ID NO: 105351 - DNA, 1105 bp, Homo sapiens
tatgccattgcttttttacagagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggtaagtggacttgaggactacagccccaatttttccagtgctggtgctcataaagagttacatgcctttgggtggggggcttctacttttagaggggctctaaggagccctgggcctctcctacctaaagcccaccctaaagctcctctttactgctggggagattttcagagaagggatacatagacaaatgtggatgtgctggtagcttttttttctgacaagaaaaaagacacatggtcttcttgatttgcaaaaagcatgtgccatgtttatgatttagagtgaaggtgtgcggagaaatggcagaactgttttttaaatcaagatgcactcaaaacgtatcctcagaggaatggctgaaagatggcctggtgtttctggcatagtcacaaaagatgtacatctcactaagctcaatttcattcccgcatgcatggaagccgtgacagcaagaattggataccaggcataggggaggagtgagcaagctggatcacctgatgagagtccctgagttaatgataaggttttagatattagagactttgaaatttttaaatttaattttggctattcaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtg

SEQ ID NO: 105352 - DNA, 1530 bp, Homo sapiens
agcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttcaaagtgtagtacacatttattttcatttgttattttctttcatagcagattacagagaaagaaagaaacctctggtttcatgttctccctggaaatattagcattgatacccattttatcctccaacttatgggggaagggaaagtaaaagtgagggagggaagagccagaacctttgggtgagggcaactttgggtcagactgccaggctacagagttaagggaagctggccccagaacagtcctgtggcgattctgttctacttcctgcattccagcagacttgacact

SEQ ID NO: 105353 - DNA, 1123 bp, Homo sapiens
tcctcagcctgatcttctgtgttgcaggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttcttt

SEQ ID NO: 105354 - DNA, 1051 bp, Homo sapiens
atcctcgaggagagcgtttgcagctggggagggtcccagcctttagatgccgctacatggaggtctgggcgagcaggcttccggagagtggagacggagtggggttcctagaacggagtgtgctgtgagggtgaggagagggtcccgcagccggatggagatttgtgcctgcggtgagggaagggctataatgtaggtgagaggggctgggggtctctgaccccggagcgctgcggggaagaggcgtccctgcaccccccctttccctagtgaaaggcagctggatgcagagatgagtggagacaggcaagcttgtcggtttgtgtgttttgaaggtagggtctgttgccagctaaccacatgagagggctaaaagtttcttaacgtgaaaaccaggctggcttggagaacccagagttgacaggatttgtgcttgggaatgggctttcttatggtgagacaccaaacagcaagcgtggacagtggaatgcatccagccaggagcgtcttccaacaggtttgattaaaggcaaaggaactcaggatattggcaagaggaggggtggggcgatgatgggagcttcgaagacgggaggggcctgcctgatggagagggacaaattggagagggaccagggatcagaggttgtcagtcacaaaaacaaagttttgagctcctactctggcaggcagaattctaaggctctagagataaagcagtgaacagaacaaacatggtccctgttctggagctgacatttggatgatggtagggaaagaagggaaatgaaaaaatacatggtaggtggtaattaccagtgataaaaataaagcaggttaaggggatacagaatggtgagtgggtgctatttttgatagagtggtcaggaagggcctcttctcaagtcacattcgaacagatgcttctgaaggaagtaaagagtggacaatacagatatttaggggaatagtagtattccaggcagaaggaccagcttgtgcagaggccccgaggtaggttgtgcttgtgtgtttgaggaaatgccaggtg

SEQ ID NO: 105355 - DNA, 1238 bp, Homo sapiens
cctctgcaccagccagacctgtctgacctgtccctggcagctcagctgggcagcaggccagaggagtaggccacaccctgctctggggagccccagtctgggggcctgagaaaggttgacttcccccttaggaatgatagtgatttgtacaagagctggaaggaggaaccgccagaggagaactgatttgggtctccttgctctaattctctgccttggtctgtactgggctcactcatctctttggcttaactggtaagagcacagagccagaatgctgggcttgaatctcagattttctgctacctagtgaggtgatttgtgcaaattactccctctgtgcctgggtgtcctcaatactacatgcaaacagtaacactactcacctcataaacttgtttatttcatatttacaaagcccttaaagagtgcctggaacatgcaagtcctgtgtatgtttgcaacttgcattgattttcatgtttctgccattctttctctgaatgtttaatcctttttttgcctgtcctgtcacccttcaggtatctgtctcttgcctctggacatgcatggtcatgaccacatggccatatcagtgccattagaggactcatagtttggagtctggcctatggtgcggcagtatgtccctgtaaccagcttaactaggaataggcttctcaggttagagtaccctggtacattgagttgtcctgtctcttcttcactggtgcctagacacccttctgtagcgattacttcagcaagcacaatccaaaacctgggttcttcaagggttcccagggtcactctgattggcctggtggtctgggtggcagccctcagctccagtactctggcaggaagtcccaacaggcttccaccacatggactcagcccatggctggactgaggcctgcctactcccatctagggccacagggttcttagtttttgtttctctgtttttagataaatgaagacaatctaggttttacagcaaaaacatgattaatgtacaatccctttacaggatcattctccatatagatagacctgtcaacaaacctgtcccaacaaaactgggttgtaaagcagatcacagaaaggggactgggttttcccgtaggaaaaatggtagtaacctggagaaagcattccagatccccagctcatatcaacaaaccatgtatgtgatcagcagtgtgttataaaaacaaggctcagcaccatccgag

SEQ ID NO: 105356 - DNA, 2879 bp, Homo sapiens
aagcccatgtccatgtctgtgcttcttacatccctctttcctgtggatgcagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccaggtgtggtggctggactgggatggggatcctgagcgtggggacttctttgcactccacagaaccctcacttgtacctctacttttctctgcagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttctacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagcgtggggaacctggacaacctcagctgcttccatccagctgacatctttggtactagtgaccctggtggcctggccagctggacccacagctattctggctgtagcttcacatcaggcgtcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactggggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgtgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttatttttagcaatgtggtatgtatttgtggggtgggaagcaggggcaaaggggatgggggacaagccctgcagaggggagtatggacacaggctgtgttgaggggtaggagtaggcacacccagcatattgggcctctttccaggcaagccagtcaagttggaggcaggaagccagctgagaggctggccaggcagatagagcagtttttcctttggagtaacctgttcctctacagt

SEQ ID NO: 105357 - DNA, 1180 bp, Homo sapiens
cctaagactggcttgggttgaggcctggggcactggtaggactgctgaggtggacagaggagttgctgtgacgttttcaagccccgcccccacttctcaaaaacagcctttggttacttggtgcccaggggtgaggtggcctttcctggatttgcacagtgtgacctgagcgtgtggataactgtggccagttgagtggggggttgtcagtgcctgtgtgtggtggcaggagggctgcctgattgtcagggctcagatcccagaagaagcctggctctcagattcagggcctgtctctggggttcctcggcggtgtggtatttctgtctgagccagctcctgggaactgcttttccttcctccaggaccctagggagggggctgtgctcaccctgggaacactgccatggtcaggatcttgattcctgggtagctgctgagggcccctccccccacctctgactcactgtctgacacttttcttagattctcactatgtttcattccctcttggcctctccttgtctctggctcagtctttttgtttcatctcctgcctctgcctcttagcctctggattccgaggtggaacagaggaacatgagaaccaggggcacttcccccgcctctccagaggagtatcagggaggaggtaatttctcatttcattcccgctctgcagatttggaggggattgttcatcactagaacctgcagcatgaccgtagcttccctgtgtctctgtttccctgtctgtaggcttggaggtcataacctcctcaccttaagttctctttctgtggcgatcccttaggcagagccgcagtgcgtatctgagcctgctttcctgacatctctctccatctgtttcctcttgggggaccagggagcctcctgggattgcctacattggcacctgcctgcagcctgagcttccctctcctgccaccagagccaccctttttgagcaccattcttgcttgtaccctctggcacagctgggggatagacatgtgactctcctcctgcccctcttaaattaactgtgacaggagcaggagaaggtcacactgaccagtcgccctcagcagcctcatgtgggtaagattgcctgtgcagttgggtctatacccgatatgcagggctggtctgcttacctctggtattatcaggtgccttc

SEQ ID NO: 105358 - DNA, 1043 bp, Homo sapiens
ggcaagtgtgtggagaactgttgaccaagtttccattttggacatgttgaatttgagatgcctgtgggccatttgagggaagacaaggagacattagcagagtctggggagaggccagcctgggctggagatgtgggcattaccagcatgtgtgtgaagcctggatatgggtgaggttactctgaaaggagataagaggagcagtcctatgtgaagggcaggccaaagaagagaaggagagagaaaccagaaactgtgaggagaggcactcagctatatggcatgtaccagagaggccaagtaagataagggcagggacaggaacggggtcctggggtgcagcaggtgcttggtgagccctcagaggctgtgttagtggaggagatttagctggatagcaaactgggggggcctgcggagggactggcacagagcaagtggagatggtgtagcgtcaggctggaaagatggatgctttggagcctgttgcctggcagaagaggagatgccagtgggagcgagagacccagtgtgtgaagaaggggggctcattaatgccacaaagtcttggggagagactagaaacacagaactcatgagaatattggttggcagaagagcaggacacctcttggggagagggagttgatgtagatacagacttgctaaaatacgcacaccttacttggttttacctgttgtcttatcagaccaccctttggtacttcagaagttattgcatcgtggttgtaaactccagtttttaatgaccttagttccccccaccccctgcctccaacagtcttatgaggaattccagttataactggcttctttggtggaatttgagatacactctcttctctgttaagcaaatactgcagattacaaatatttcagttccaggtaagtagttatgtgatgtgtaatggaaactttatatatattcatcttaatgttttagggccacaatgtgtcatttatttaaaaaataatagtgcaaatgccacttaataagggaagaggtctttggggatgaattt

SEQ ID NO: 105359 - DNA, 1036 bp, Homo sapiens
gtgggatggtacctccacaccagcatttctttgctcaaaggctttttctggccttagggactcacgccaaggaattagtgcccagcccaaacccaaatcagaaatccatacactgatttctctattatcccagtaatgtacttcagagtaattttgtgttttgttttcaagagtataggccagttatataactcactgtaggtttatttgcagtttctttgtgattagatttagttctacatttttagcaaggagaccacagaagtgatgttgatttcctaacccacagcactgtgcatttccaaacccacagagtcctcaaccactgaaagatgagagttggtgtttaaaatcccatgtccctccccactcagttggagggataactctgaggtgtgttctacaccgattcccagagttccccagtgggattaagttgcccacagcagaaactggttttataacatcgtttattgactgccttctctcctatctcatgtcccccacttccctattggtgttccttccacaccttaaacaaagcacttgcatgcgaatcatcttggggtcttttgggaaaacccagctaagataatacttaaagtgtttggtctttgattttcttttctccctgaccttctctgcagtccattgtgagatgtgtccctggcgttggaatctactttggcactctctactctttgaagcagtatttcttgcgaggccatcccccaaccgccctggagtcagtcatgctgggggtgggctctcgctctgttgcaggggtctgtatgtcacctatcactgtaatcaagacgcgctatgaggtgagttcaaccactttagggcctcaggatagttcggcttagccactgggctcctggggagtgaccaccgatgtcaactcctgatttgtaatctaacatagagtctgatgtggtcagacaagccatatgtgaactagatcccatggtaatgccccataacctgcagtctgcttgttcagtgctgaaatgcagcgcctccatgcgagtca

SEQ ID NO: 105360 - DNA, 2469 bp, Homo sapiens
gatatatagtagaaaaacaagcctgtcttttttaatgtatgcaggaaatctctggagaagtaagagaggttaaggaaagctgggtatgtgcctgctttacatggagtagtagtgattaagttggccagtgcccagaagtgcttactgggtgccaggattgttgctgtggaatatcgagtaccactaacttttaaattcttcaaagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaaggtaatgattttaggatctagagtttgtgaatgcgtgctctagaaaaaacattcctgtgcacattgttagagcttggagttgaggctactgactggccgatgaactcgcaagtgtaggtagtgtgctacatgaggggcaagttttcgctaacaccacaagggtctctggcccaatgagtggagtttgatagtaattcttgctacaagtataacattactgcatgacagctttgtggagaaatgaaaacatttggaaaatagtgtgttcttctgcctttgtccatgtttcttgctcaggcctcaggcacttggcctttgttttcacaccaacttgatgggttctactataagatgctaaaaaggtgggttgtgtgtggttcagattggttgatttgtaaccctagttgtgcataagaattgcccagatattttttttaaatgccagtgtccaggcatttttttttcaatccctatgattccagtgtgcagacaaggttgaaaatccctatttataatgctccctgttacaattgcttttcaactaagagatgtctgtacttttggtacctagatgatgtaagagccaggaaggtgcttgctgtttgggtttgaccaagtgtcactttttaataatctgccactcttggcagggagctcactcagtgggtttgatgtggtggatgctggctcgggaagttctgcgcatgcgtggcaccatttcccgtgaacacccatgggaggtcatgcctgatctgtacttctacagagatcctgaagaggtaagcttctccaaaggcttgtggttacataagcaaattggacgacttggactgtgcttctaggaagcaaaacttgtcagtccctgtaagtctttcctcttttttttttgtaacccagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactggtatgtatcaggatagaggtgaatcaagctgatattttgcaacttctcagttttattctaactttaatgatctctgtgacttttatactagctttaagaggttttcattccagtgtgctacagcatctgatagactgctgttgggagtggggtaaggaaaaatactacattgaggacagagctgatggctttttttggtattctcttaacagaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaagcccactgtagatagtgtatattgcttttcacttcagaatttccctgagcttccttcctgtgtggagaacatgtgtgctgtgaaaatagatgtaagtggttacacatacttagttggtaacctcaggaatacttttccgaggccctgatgatcttgcttttattaccatttgcgtaggtaagttctatagagcttaggtttttatttttgagagtcttcctgtcacttaggttaactattcctggaagccctggagaggcgatggtccttccccacattgagagacattaattgcccctcttgtcagcttgcctacaggttctgggagaggagaggtatgtatgtatttaaaaatgtgatgttctccatatttgtctttgccggggagggggttggggagacagtctttccctgttgcccaggctggagtacagtggcgtgatctcagttcactgcaacctctgcctcctgggtt

SEQ ID NO: 105361 - DNA, 1880 bp, Homo sapiens
gctgggtagctaaaacctggatagaatccagtggtcttcttgcttgaagaacgagaagtaatttgaagcaatttaattaaaatcacctataggcccctctggcacccattggtaatcatctcaaacaaggaaacaaatacatttcttgtccctgttcacacgtgtacaaagatgataatgtgaacccgatcttgttcaaggataaaggacatctttgtgaaatgactgagcacaaggtatagcatgtggcaatgaatgtttccttcctttctcctcttccttctcaagaaacagtaataatactctcagaattcagatttcattctcaaattcctctgttggtctcttatctggacttaatattgtctaataaaacctaaaagaaggttgtctgtctgtgaataatggtctcataaatattaccaagcagagagccttcaaacatgatgaaatctcaaggtccaagtcattgctagaaaaaaaaaaaaaaaaaagcatggaggaatttagtagaacaaaatagctttgggggaatatttaatactcaaagggaaaaggaacttgtaactgcttgaagaaatagacagcaaaggcttctccttttatgcagacacaggactgggactggcaggcttaagacatttagccttgggacatccatggatgatttaaaaatgggcccagccctaggctgggcgggatggctcatacctataatcccagcactttgggaggctgaggcaggaagatagcttgaggccatgagttcaagaccagcttgggtgatataatgagacttcatctcttcaaaaaaatttttttaacttagctcagtgtggtggtgcgtgcctatagtctcagcaactctggagtttggggcaggaggatcacttgagcccaggagatggaggtttcagtgagccaagatcatgtcactgcgcaccagtctgggtaacagtgagatgctgtctcagaaaaataaaaaccaaaaagggtggtccctggtcctccatgacctgtggccatcaccacaaccaggccttcatcataattctatttttcttgcttgtttttatgtctttgtatgcaacttgtgggggtttaaaaagctgccttgtgccacctcagttgtggctaaatcttagtggttaaggacacagcccagtggtgtctgtcaaagcctttggaagaaaagttctcggttaaagtgaacacgactgagtaatctaagtctgatgtagagaaaccctacacaggagttggattttgagggtcaggacatctcaggaccttcacaggctcatataatctttgttccaagtcattgaggtcagccgttcatcctcggtggtccagccataaacacatagcctgtggggtaagaacttggctgtggagctgcaaggcctttttagcactcatccttaatcagtactgggaagagcccatgtgaggtaaagcaggggcagaaagtcctaggctaaattctctccaaggagctcactttctgtaggagggaggtggggtggtgagaaatataaggtggtgagaaggttgattttattctttttagggcctgagtcctgagctttttttctcagaagaacaagctctggagcactgcagagggggatttattgtaaaattgatttccctttagttaatatctgaatgcaaagacaagcatgggaagagcatttctcaagaccttaccttgattgttcctccagcatcattttcaggcttcagaagttcctgtgtcataaggatcaactggagagaaagttggttctgtgagtcagccctggagtggcttgaacctgagaaggggaggagatgggaagacggactttcccagctctcatcagaccatgctgtat

SEQ ID NO: 105362 - DNA, 1017 bp, Homo sapiens
tatctttgtttcgctctttgtttaaactttctttggcttttgtttggtctttctttagccttttgtttaaactttgtgtggcctttttgtagtctttgtgtagcttttgtttttaagtggatcttcgctgaggactcatcaaaaacaccttgtgtaatgaaaaacccagatctataacctctccctatatattctgcatgcattgaagtaggctcaaaccctcagggacctggtatagacgcagaatctgtttcacacaacaactgctatttgaaggtaagaggattccattggtttttattttacttcattttatactttcatctttaaatgacaagtgtacttttttgtatgggccatttcattatatcccagggaaaactttctgtaagaatagtcaagattgagaggacatacaaggatggagaaaacaagaacagaggacaccatgtttattctgatgtgggcagggggcctcctggaatgttcctgctaatgtttggaaatcgtctgagcccagagagaggctctgagcccttactcagatttcctcagattcaaagccccatgttcctggagctagatggatggtagtacatgctgctgctgctgctgcttttttttttttaatttatttcttcttttattatttgtcatgatttaaaaatgagtttttcttcttatctaggaacaatttttttcctcatacagttggatttatgtgtgggggatcttaatggaacaacaaagcccaaatcttttcggaattctgccccctgtagaccaacaaccttaaatggaaaggcgctaatgctttgtctgatacagaatatcttagaaacaacagggagttttcagttctatggatgacagagaaaggaaaaaatattatgtgtcagggaggcgagtaatgaacttggcctacagtactagcaggaaaacggggaaaggactttttaattctttgtgaataaatcagggaggcagagagcaggctgctgccaggtgtgcggatat

SEQ ID NO: 105363 - DNA, 1097 bp, Homo sapiens
agaccagctgggcccgcctgtccccttggcctgtagaaaattgtgggaatattcatccacatacaattccagggtaaatttgagtgtccataaactaaaaccatgtattgtataattttagatacaagaaactgaagggtatcatgttatttacataacattcagaaaactactgcacttcttgaatgtttatctggccccactacaataagtgaaggttttactcctgaaataattgctaaataaattatctgtgtgctaaagataacaaccgtaggtcacaccctttcctttcccttagaatagctggaagcaggtagagtttgttcatcagaaaggacttttgcacaactttatgagatagttgcaggtgggcagtgtggttcttggaccacattagtttgtccttgttgcctaaaacaaagcaaaacaatgagggcatttaacatggctttgttttgtgtccccacatgggccttcaaaataattaaggactctcttatgttttcattttttcatagtcttggcaggtccccacaacagtattagattttgacatcttgctgctttctgtggaaaagcacccagattccaaataaatatgtgtatgaaattttccattacctggcactggtttgtcaccaacaatctactgttcaacatttattgtactaatttgtaaacataatagttgtcacggagacaaatggataaacaaggacagacagataatgacatccttagagacagcatgtagtagttacagccaaccttggggtcctacatttttgtgtttttgctgctgtggactgatgaacacagaagccattgttttttactgtgtaaatctacactcagaagaaagggtcgtcagccgctggcctgagaggattagcaaggttttagagactaaggtctctacgggagctggtgaatgtggaatgaaattactctttgggaaacatggatgatttttatcacagctaaggagttggggctgagcagtttttggaaggctgtggttaggcatatgtgaaaacctgggccggtaatggaatctttggacccccagttattattccaaaatagctcttgta

SEQ ID NO: 105364 - DNA, 1119 bp, Homo sapiens
gccagagcccttacccttctcactgtgccagactgactgcaagtgtatttatagggctcattcagtcaacatcatcagccaggccctgagtgaggccctggggggatgagtgtaagattctctgaccctgacttatgcacactccatccagcaaggaagatggacaagtaagtgatgatcagcaaagatgtccaaattatagcagtggaagtatcaagggagctcacagaaagggcgaccatctgctcagcaagaagtgtgaaggctcttaagtcagagggctatgccaggaccccttatcactgccaataatgatgactctttagactctgcttccacaaaataccccacatcaatcaccctgacaaacccaaaacaggaaaataacaggtcactagtacacaaaagtcatgtcctatataaaatgctctagtcatcgtattgtagcacagctttgaaaggttaaattataaagactgcccacatagctgaatagaggaaacagataattcagggccatgtagggtttgagaagaaagtgccatagtctttggtccacacatggacaactaccacatgactgttcttcaagatgttaactccctccaagactgagattgtccccaaatgtgaactgaaattgaatccaccttgtaaatccaatccctagagctttggtaaccatctctcataaccattaagatgacattaggcaattttgaacaattaccaccatagtaattctaatagtatttaggacctctgtgattttttacatccaaagaatgctcgtgccaattttctattttgatgatacagtacatcagtcaataggccatgaggaaagttgagccatatcttgaaataaggatataaagaaagcacaggaataaactaacaacctaacctaagcatcttgtgttattaggcttgggccttcaggctgtaatcccttgtaataagccagagagccaatttggcaagaatttaatcttgttaaaatatttctctaaaaattaaatgttttgaacaaaatagcagttcgaaacatatacaaaaaataggcatacagattgaaaagaaaaatatcaaaccgtctctattcaaagacaacataat

SEQ ID NO: 105365 - DNA, 1203 bp, Homo sapiens
atttttggccagagactaccagaattaagaaattaaagagaaggattttgcagaataacctcaaaggtagtctcaaaatccacaattatactaactgaacacagagaaagagagagagtatacatcacctacctatgtcatgtgtttttctttttctctttgtaaaccagattgaaaaggaagatcaggccaaccccaaagaagaagtgaccaaggaggagtttaaactgaatgaacaacctcggctcctggactcattgcttcacaacccatctacccctggatgaagttatctggcttcaaatattatgcaggggcaaacacctgctgatgtggcaactgctgatgctcatggtccccatggcatgggggcctcagggcagcctgcctggaggtgagcagggctatctctgtgtgttgtactccagtcagggggttccagcagcacccgcaggctctagagctcaatgcacagttctttttgtttcacctgcagtcctttcttctccaggatatgcacaggcctccagggtctttcatggctcagggtcagggtggctcaagtgccaacccacatgttgtcctccaaatattcccttctatccctggcatgctgttgctgagctcaacttttaatttttgactttctcctttgtaattaatctctatctgggtttctctctttctctgtgccatttggtttccttaattagttccctgtgccagcccatagtcagagccataattggctctggggaagatccaagttattttctgagtaagatattaggcttccatatgatccagagatgcaaagaaatccctagagagtgtaggagttgtctaaatccatgtgtcagatgtagccaacgaattatgtcagaagcagagagaaaaggcctgaaaagcagctctctcccactcctcaggcccttgtctccaaccttacatgaggctttttgaacatctcctcctggcccagctggggtgagagcaagtcctcgaaggcactgcctttgagccttgctcagcccatctgaactatcccaactctagaattgactgctttcgaattgtgtgaccttgggaatgttatctggcttcaaccacaatgccctacccccagctcctctcccaaatgatcctagatacagggctgcttccccccgaccctaccccacctcgggacacaggctcatggcc

SEQ ID NO: 105366 - DNA, 1142 bp, Homo sapiens
tgtggctgagctctgaggttggccagtgttgttaatactggttgatagtccaaaaaattataccatagagtttatatttgcattaagtcatatgcacagcccattgtccttagtacatttaataacattttccccatcatcacaatatacattatatgaacaaaataaagcataatctttatctgagaaagtagataaagaaccattatttccttatatgaagcccttttgttcagtcacctttaagccattctgtgtgcttagaccagtgcttcatgttaggatacaacaatgaatatgatcaattcttgctctgtgaaaatgacctgtgggaaggggccgggggtatggagcctttttggatgatgaaagcaagcccagaacctgggacagacctccagccaagggcggggctgaagggatccgagaagatttgttagaggaggaatttttgggccaagccttggggtccgtgggaaccagctcagttatggagcaagagtctaggagggaggaggaatgagattgcaggcatgaaagaatcaaacaatttgttgcaactggggcatgggatgtgaatgatgcatgggaggcagtgtgaggcaggtgggaagggcgagggctttgtgtgccatggtaaacagcttagaacttatcccagagcccctgaagaatttaagcagaagagcttgaacaatcgttttactcatcattcccttttagaaatgctctttgttctgtttcctgtctaggacatagtgtgatggacaccttggctgtggccctacgggtggctgaagaggccattgaggaagcaatttccaaagcagaggcatatggggacagcctggtagggcccctcctgctcctctctgtggggggaggtgtgggttggggtccttgctgccaggagaaagtgcaggttgtcaggaaatcaatgtcccagcagctctgactagagcaaggccctccctctgcttttgtggtcaggactctcctggcaaagtgactgccaagtcaccccaaatccacccacagcacacagccattctcttccctcctcaggacaagcaaaatgaggccagttacctgcgggaccacaaggaggagctaactgaggaactggccacgacaatcctgca

SEQ ID NO: 105367 - DNA, 1014 bp, Homo sapiens
agtcccactgccacaatagaaggctcaactgttgtgtttttgtttgtttggtgtttgttttgctttgttttatggtgagcatttatcttaatatttctggaccaagattggaggttgagagaatactgggaggagggtcaacaattattgtgactacttagaaaaggtagagagtgaatggatctccagatgcactcgtgagccttatatttaataaaaaaaatttcgccattcatttactggcaacaaacagacttcgattgccttttagtgttgtgggttttcatctttttctgtatcttcccacacagttttggtggaaattttgtgtgaaagatgtttgccagataccattttgaaatggaaacctgctgattttttgttgattgagacttcaggatcacaggaggctgttattttaatttcctccaatgtttcatttttggttatactcattagtgaaacttgttttcttggggtaaactttctcctgcctagcattctaggttctaattattctttaaaaatatggtaagagtcttgccatagtgagaaactaccagttctttataactaaccatctgtaaatattcatttatttaataggtgtatgccttgctccagaaataatttaaagtggcttacataaatatgaacaggagaaaataaaataaaaacataacgatgaaaaggaggacaaagggaaaaccagagtaggaaagataagatgaagccaggagtaatgatagttcacaaaattgatggaatgaatcttaggcaagagataccaaaaatttgtctctgagttactagaggacaataaaaggagagtgacatgagcagctcctgaagtcatggaagctctagtagaacaataaatccattccttaaaggatgctgctttcggagctgaaatccaagagaaactcatcctgtggatccttgtggagaggatggagaccacagcagcccctgctctaaactactcccatggattcacactctgggggttgc

SEQ ID NO: 105368 - DNA, 1597 bp, Homo sapiens
gtcactggccagtggttcagtcttctctgcttgcgtagcaatttgttaaattacgcctcttgatatatatgtaatctactttttttttggcaaggcacagttacggttaaatgattaaggtgggcgtattcgaatgtttatgttttcatcagaatgtaatcgagatgacgcacatttttatagcggctacaatattaaggttttctaaatctttttctcattagaggaccatattgaacgataacattatttatctataacagcgtttttctacaatggacatagctgttcaaatgtttctctttttgtgagagtatcttgggggttttattaatactccacccccatctccattcctaccggcaaaaacagcaaaggcactagaaccttcattgatgactgtctggattggtagtataatgtatttctggaaagtacttcttaaaaaatatttttctactttggattttttttttttttttatccattcgcagacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaaggtaaagggattaggaagaaaggattagagttactgatgcacacctctgaactggattatgattcacacctttatatcggcgtggatgaaaataactagaccaagaaagttgttctcatttttgtaattaacatgtaaatatttagttattctcccagtgtggtctctcattttaaaagaagattcgcgttgcttttaaataaatttaaatgtgaaatatttagttcttgatgttacacataaaatcatttcctggtttacaaattaatttggaaggattgtggattataggagacaaaatctgtttctctaaatatgatctagcttactgaaatggctaattctgttcatacggtgaaataaaacctcatagtagttgactaaattttgttgtatatttatgcacttttccagaaatttgcctgtaatggtactgtgattgaacatcctgaatacggagaggttattcagcttcaaggtgaccaaagaaaaaacatctgccagtttctcttggaggtgagtgattgggtgctttatgtgtaaccttgagattgcttttaaaattgtatttaaaggcaacatgatttgttttctactaagtaaaaaatcatacgaatgaaggaaattaggtgaaataaagacatggtagttatttggaaagcaaagacctttatctggtttattttgtcattagagtattctgatcatttctttatatacacacacaggctatttcttggcatgtaaagtattcaaatacgtgttgaattgttggctatcagcagtgcatgccacagacaacagtgttgcagtaagctgttgatagtgattctttttaattactcttccatgttttcttaatgaatttttatatttctcagagttattttgctaaattagattttattttacaggttggcattgtaaaggaggaacagct

SEQ ID NO: 105369 - DNA, 1072 bp, Homo sapiens
actgaatatttagggtgtgtgtatgcaaattccagactgtgtttctcaacaagcgacaatttaggagtcttgattgttttctagcttaatcattcattccctggaggctgtaaacagaagtctctgtttacatttaaattaaattccttctaacagcaccgtggtagatagtagctgaggtgctttatatatccccagggcaagaccatgaaaacattgttgtctctcccaggtaaagaaaaatggcaattgatttatatgaattgtaataataaatgtttggctagattaatttctggatcacatttgagtgatgacaaaatcaaacctgtcagctggtgctttaatgatgactgcaacttaaacctttataatgcatgtaaactgctaggagccttccagttgtttaagtggccacaagggggtgataaaggactgcatacttacagaaatccgtcccccttcaatttcttctgtaatagcatcattcactgggtaccctatatttcgtttcgacatacttcatctaccaagtgggctgttactggttcccattcagtgtgtctggccactcatttactattcttcctgatgctagtattgggctaagcttttctgcgttttttaacaagtcaatggcagtgatgcactaagagtggatgtttatgggggtgggccttttctttttcttttttctttttttttttaactttaattttgagacacagtcttgctctgtcgcccaggctgggtacagtgatgtgatctcggctcactacaacctccgcctccctggtttaactgattcgcttgccccagcttcctgagtgtgccaccacacctggctaatttttgtatttttaatagagatggtgtttcaccatggtggccaggctggtctggaactcctgacctcagatgatccacctgcttcagcttcccaaaatgctgggattacaggtgtgagccaccgcgcccaggttggccttttcttacttcaaggaattataccttctaccaaatccttgtctggtgatgtcttccccacaaaatttaggctgacatggataac

SEQ ID NO: 105370 - DNA, 1042 bp, Homo sapiens
ccaaatcccatttcaggctgccagcttcttggaagctttctgtaaaaaaggagaatttatcttcatttgtatttcatgatgtccctatggaattgttacctttcttcagatgtagttgtagggaaacagactacttaatgccctttctaaaaccagcataaattggattttattgtatgtatacacaataagtgctttcttacattgataattttcagaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctggagttaggaggcagattgatagtaggattataataaacattaaataatcagttcctttttttttttttttttttttgagatggagtctcgttctgttgctcaggccggactgcagtggcgctatctcggctcactgtaagttccacctcccgggttcatgccattctcctgcctcagcctcctgagcagctgggactacaggtgcccgccaccgcgcctggctaattttttgtatttttagtagagacggggtttcaccgtgttagccaggatggtctcgctctcctgacctcgtgatccgcccgcctcggcctcccaaagtgctaggattgcaggcatgagccgccgcgcctggcctaaataatcagttctttaatctcactctctgcccatacttggataggtagtgcaaaatcattgcagtcataattgatcatgtcatga

SEQ ID NO: 105371 - DNA, 1114 bp, Homo sapiens
ctttttgttgtctgccactgaggttttctggttgttttttcatgcaatataattgtggctatagctaactaatgtgctatgtgttttttattattattttttaaacagggagttgactaaagagaaaagagcatttctgtgtgcaggctggttggaggctgctcaggcagacacaggcagagagggtggggccaggaaggagaagatagcacctcctgtctgtgcaactgtggccttcccacagttctgtcgtcttcaaatttttgtttgcatgcacatcgcaaaaaagaatctcaaaaaacaatataactgtcacatatttttaagttcataggtagaagttttcacgataagtttaagtgattgcaagggatataattttcattttactgcaaatattgacatttaaacatacaactatcaatcttaaaatattaaagagaatctggagctcataaagatttcatgctcatcaccatcccatttaaaacatatgaataggctcttctttactgttgagaaattttacattttccctttttctccttgaatttatatttcttttgtacttcctccatgaacctttaacataatttaatatacttttaaaatttgaagatattttattgatcatcctatcatacattaaaatatattacatatgtattcataatacattaaaaaatatattttattcttgtgaccttaaggctccccatgctttaaaaaattgcttctggattgaattatcatacaactgatcaaaattgcattaaaatgttaccaattttgatcattttttaaacataaagttaaatgtaattggaagtgcatctcctaatgagatgaacgattttctaacttttcatatgtatttaatgaaagagaaaggcatattctgctaaaaatgaatcagtccagaagctaggataatattattcctgttaataggaagtagaaaatgttaaatattttatatggtaaattaaaatgagcaatagctatcattggattatttcatatcatttcataagatggattttcaattaccttattgaataacatatactacatacaaataagtcacctaaaattggtatctgtgcattttatt

SEQ ID NO: 105372 - DNA, 1039 bp, Homo sapiens
atccaaaggtcatattgcatgacacagtcatgtttcctcaggaaaaaagagggacttcagaacctacattggaaatatcatatgtttttagttctttggaaacatttcatcacaggcaaatagaatgatttagaggagtttgttcattttgactgtgcatgaaaagtaagcctgttctttcttcattgccaacaggagataatacgtgaaacacataatggaatgtcaaaacaaattaatttcctggtccggcttgtaaatacagtactttgtgtaagcaacagcaaaaaaccatgaaaagtgagatcttcgtgatactaatttcactcacccattcaacaggtaattactgcaggtcttccatgtgtcagcattgtcctgagtgctggggacatagcagtgaacaaatctccaagatgccttcaaaccttgaaatattcatcccgttattttctgaatttggcatacatattggaaaaatgtttccatttttaaatctctgcctgctgttctgataaatattgttctcccaggttcccaaaaagagaattaatttggcgaaacaaatcagtagttgtttcactcattgttatggtaatagagaaattaggtttttaattaaggctgaggaaggatggaagagtagtaggcaaataagcacctacatggtttgatgcagacatgacaagtctccttttttgccatagtgtctaaaattctgtccattagagcatcctgtaggttaaggcaatttatccaggaggcctcagttatgtgcattttctgccttggaaaatgtatgcactatcttggtgtgaataaggttttaacatcagccacttttaggaaggtatacggcaggtatcgctgttttacaaaagaatgaactgaagcttagagaggttaagcaccacgctccaggtcccacagcataagatggaatcaggattcaaatccaggcagttagattccaggtactctgtgcttttaaactgaattaactttcaacacttaaagaaggggtctggattgtccagtg

SEQ ID NO: 105373 - DNA, 1847 bp, Homo sapiens
ttgggcgctcctttccttatccttccggggctgctcccgcttcctctcggagccaaacttcgtagcaggcgcgcggtccgggcggcgggctgggcgcagccgggaggcctggggttgggagcggggagctcaggtgggggacggtgagggtgggccgcgcccggggcgcggagggcggcggccgggcccgggttccggtcgcgctgcctctctggggccctgggggcatcgcttgcggggagggggcgccgcgggggcgcgtacaggagcccggatggcaggcggggtgggggtgggggtgggggtctgtggtttccgtccggggctctggccttggccgagtttgggggagggacccggtgcctcgggatgcgccgggccctgggtggggggcggggtggggacggggggctccgccttctcagctcttgcggcgagttggggttcgggcgctgaggcagagacgccaccctaagtcccatcagtcctggggatcggaccagtggactttctcttaagatttcctctttcattcttaagaatagaagtgttattattttttttaatgccctggctatgtgagtttgaatcgaagcaactttaaaccttagagcaactaaactctaagtgcagcgggtgcgatgcgtcagtagggtgagcacataaaaaatccatgtcttgcacctgtattttagcgtactatgcaggtgagtgaaagcagtggataatgtactgggagtcttatggatttatggtagtgggtatgagaccctggtgaaataagggggtggaggaaggcgaaggtgatggcttactgtttcttaccaagtgaactgcaggattcagcctctgactcagaccgcttcgagaattttgttcgtagaaataatttaaatttattcaaatagtttgatggcagctaaaattgaattatagagcacgttttcttttcagcggagtgaatttttccttcgctccaaagctggccaaatggaattcaagcattgcaacttctttcagtgttttgtctggagagaggactttgaaccgagacttttcgaagttaagttcctatagcctgcttctgaatctgccaagcttgaaagctttggcagttgggtgtatgtagttgttgccttcgttctcttcccttttggagggagcgttgtctcctactttgtatcttccagacatctgtggtcttccccccacccctcgagtttgtgagtggtgaatgaagaaagactaggctgctggtatgcagaggtcggcaaaaggaaatcgaggagtggttttagtgaaatgagagctttgtatcatgaataatggtggcttaggctagacatcaacttgaagagacggcagcatttcctttcataaagtctaggctaatgtttttcagatcgctaagttgtagtttgtctggaatttaggaagccatttcagtatttgtcacttggtgaacgaacattcaataccttcagatgtcttcgtgttgacttgtattcatcctaagaaatagtaaatatagtctcaagtgttatttatgttatactgctggtttattctctgcttaaattattgacataaatttctactttggaggcttttcgtttgaactaaggctgtgcggaatttattttacttttatatttaaatctttgaaaaatctctgattaaaaaaaaagtacccttaaaggtttgaggatgtcctttcacaccagacaaaatttggttaatttgcgcccaatattcattactttgacctaacctttgttctgaaggccgtgtacaaggacaaggccctgagattattgcaacagtaacttgaaaaactttcagaagtc

SEQ ID NO: 105374 - DNA, 1869 bp, Homo sapiens
gtcatgttgatttgtgacattgtttttgaaaatatgtgttaacttagttttcttgtagccctctttttattggaactgtggtatctattgttgaaactgcttgactgagaacatttttataccataaaagtaaatagtaaacatagcccaggagcggcttctggtttgtccatcgtatgtagccattgcctccttgtactctcattgagaagatactgatttgcagattcagttgtccttctctaacagactatttatgtaatattgcagttgtgattgtgataggtaagtggaccagtcggttaaaataaatactcaggtttcacaaaaggaaaataatatgatttgtgttgatctaaatgagtataggagttaactcctatagtttttcatcacttaaactcaggggaaagttctttatttcctctgtttacttaagaatgctgcttttgtgtttcatgcaagactgagcttgactcagtttgaaacctaggctcatctgttgaggcctgaaccctgctgtccttgaagtatgcatataatttgcttccttcctaaggaaaaataagctcttgaaagataaagtcaatcacattaggaacccatttttagggtttagccacttttttttttttttttttttaactcatgggcatctcttctgttaagagacattccccactctccaagtttccctcaagcctgaagcagcagagtgagtagtgttggagcatgttttcattgcatgcttgggtcatgttgagtgccctccagtggatatagtataatgcttgtgatttttttttttttaattccaaacaagtttatgtgggatatatttaggaatagttctgatgagggagaatcaactaagaaacctttgatttctaaaataattaatatcattactgctaattaaaatacaggcttgagaaaatgtcttctcagccaatatttgcagtagaaaagtcgggaggttttttaaggtcactttgagtaggcagttctgcttaaatatatcataatgataaaccagaatctcagtatagtactttaggaggtaaaagatcataatattcagttatattgatgaattacagcaactgaaattctcagaaaaaaattaatgaaaatgtgaattgtcaatttgtctaaaatcattcacagagtaaaacataagtgctcaacttgattatattaggaaatagatagaaataaaggtaattgagccagtgtatgtgacctaaaatataatgcccttagtgaccatagggttggtctcatttgtacatagtggtgggccatgatgaactgtgttttgccctttgaatttttccttaaaaagctttctctaggctcctatgttcatggtttttctgttagtaatattattttctgaaaatccatgtttcaaatcagaatctaattagcaacaggaatgaagcttattctaaattagtttttggaagttaaacggtcagcatatggaaatttttcagggtttagatttttaaaaatttgtttttcagaatatgttgctggaatgaaaacgttagcgtagggacggaaaatgacacttaccagtgattgctttactttgcctgtggaattcagtgtaattttgtggaaacattggtatatgattttttactacttaagaaatgtattgctatagttagggtttttttttttttaaaggcaagaatgcctcaagtgctttatgtgaatgattatttcaggatggattaaatattcctccatcaaggaccatacttgtaaatcagtgatttccaagttggtgcttagtatttacagcatttactgtctataagcttctgttctgatttttcaagagttttctgagaaatg

SEQ ID NO: 105375 - DNA, 1671 bp, Homo sapiens
tcatctgatttctttcccctaagtgggaaatccagatcaatgtacatctcttgatttgcaagtgttggtgaacaaaattcatattttaagatgctgtattcagcacaaattaaatacacttatttgctgaatactgccagtttgtccctctgcagtagtaccatttgaagtacagtgttttcataatgattctgtgaaatgactggttctgtgaatgtacataatttagcagataacattgttaaattattaggtttgtatttatttaggcacttgggaaatgccttgtgtcaattgattatagattaggagcttaaaagcaagatttatattatcaacttatttgtgaagactgggaaacccacatttttaaagttaggaattaagatggccaggttcaaggaaaagggggagaagtaactttcttattactcaaccatcttaaatagagttctttaagtgtatttttaagaggtctcaaaacttaatctgaagggacgtcaaatgctggacaaattctgtgtatacaactcaagtcagcccccaattttactggtctttaaatcatgtcctttttaccagaagtttgcatttctaagctaaactattactgttagactagatccaaaacttaaaaacagtttaggtaattaaaaattaattgaatataaacgttttacttaaattaatggcaaatggctttttggccaatttaagtttatgtaggcagttaaatcgattttggttaaatcttttgctgctaacaaggtatttccagattttgaaaagtggggtggcctggtgcctgtagtaccagcactttgggaggctggggagggtggatcacctgaggtcaggagttcgagactagcctggccgacgtggtgaatacaaaaattagccaggcatggtggcaggtgcctgtgatcccagctgcttggaagtctgaagcatgagaattgcttgaacctgggaagcggaggttgcagtgagctgagatcacgccactgcactccagctggggcaacagagcgagactccatctcaagaaagaaaagtggggtgtttagtcttcaaactccgtgtttaagtgactggagtgaaaatgtaaatcataggccggtgttggtttaaaaagcatcatctgaaaataatgctgtagtctgcaattatttttattacgatacgatggtgtaaaatacaagcagatcagtgaaccattcatgaaacattaatcctaaaggcgtctcaccccaagtctatcccacaatctccatgagacttcgtggaaccactgtaaagtttcttgtgtaatatcccagaagtttcctacctctggtatcttttgaacttgttgaaaaggcttttccaccccctctttatgatggtttgaagagtgtgaacatctgaatgatgctggggtgaaactgcttcataacacttccattttctcccctatttatttccatatttttattttttcactaatatccccacggttttacttctgttttagtaattcacatgttgctggactaattctttttaactgacttgtaacagatatgttaaaccgtttaaaacttggggggtatttttaacctactttaagttagttcaagttaatcagtctacatggcatataaaccttatgattaataaatcttaaat

SEQ ID NO: 105376 - DNA, 2356 bp, Homo sapiens
tctttgaagttttgcatatactagatgaatgccacatgtataagggaggaacaagggattcttggaaatatttttcaatccaagtaactttggaggcttccaagtggagttcattcccctgtgtaggaaagtgctggggtagacccttaaattcctttctgagccattgaaagaatgtcctcaaacttcgcttatactttatagttcatttagatacaaaagttacaaactgaatgctatttaggaaacgtaatacactgacataccgctctttaaatagattataaatttagtatatcaattttctggcattttgctgaattttattgtttagttttcaagcccaactatcttgttactttgtatatcgtagttgtcccccgttgatcactgtttcctgcttaattgtgctgtcgtttttcctgggtcctgattcagagtgtcagcattctgttccccatagaataagaagaggctagaaagtttacagatgagatatctaggaatgccagaagatcaggggtcaccgttgaggcagagtaattaattatggttaaaatggtgttgctgataagtgggtgctgggaaataattaaaatttgattttttagaagaatacttctcatgcttgaagagcgccctcattatatgctaaagggcctcaggtttttccttattgccattatgctgcagattctattacatttgtctgaaaagatctaagacagaagggctgtttaataccttcccttttctcctgaacttcccctctcctctcccccatcaggagctaagtaggaaccccttcaccttgttaccatcagatttcatcaatggtctgtctttacaatgaaggaagtagtactgcattctgggcagaggccagtcctgaggcatgccttttcaaggacattgttactttagttacactggctcttctgttttaactcttatcccccagactctaatcctgttgctttttttggtccccatctcccacctttcatcatctgaaatccattcattgtaacttctggaactcagtcgttagaaaatcctttatattctcaatcttgtgaatgttcctttctttcttattccagctgtaacctagccttctccccaagaatgctacttcccttgcagctctctcaagtggtgaatttttcccttcttgcacaccttataacactgaactaggaggtgtgtggactaaatgtctgcttttgttccttattgtcacttcttgacctttattttccaaaacttcaagctttgactttcatgtgatcaaattataccacccactgcctgtctttatttcaagcacctgcaaaccttcctgggtcattcacatccttctttgttcacttcattagctcttggctcattgtcactgtctcttatttctgtcataattcttggtgacatcagtatctatgtagagcaatactagtgaagatgtggtctggtaactgttacctgtatgaattaagataaggagttatgccagaatataagtcacctgtgtcactaagtttactgtttagcttactttttttgtagcaagattttgatgaaggacgcaatatgttgatttacagtctggtacaaattttgatgtagaagatgcttccaatatcctggtctcttagttccttgatttcttctccagtgatcttattttctaccctaactcaactacatattcccattgtcatatcctagaatattttgtcttttatctgtaactctgctctcttcccccaatctcatttcaagcatcccactttctaattcctctagtaaatacgtcagttccaacagcccatcaatcccattgggacctacagtttatctatccaagcttttccctgttcctcaccctcacttctatacagctgaagtttcatactgaattataatcactttctcgtatacacgtttaacaatcttgtccctccctggcttcatgcccagtgatctcttgtatctatgaccatgtcctttatcttctcctctgtcactggatgaactgtagccttccaagataaggccactcagttcatttgtacagcagattccatcccctcttgctctcaagaatattactgtggtatctctcttttcttgtctctactggctctttccatgagcaaacatggtattatcccattacaaaaaaaattttttctccgtctctccttccactcaccacctcagtctctgcttctctttcccgcaaaataaccttgaaaaattgctttatgtactcccgttttcttttgaacccctgccagtgaccaccacgttataaatttgtagttgtcatctcacttaatctgttagtagtatt

SEQ ID NO: 105377 - DNA, 1655 bp, Homo sapiens
tctatttctgggatgtttattctctgttccttacatgctggcccttttgcatccttcttcaggtctcagcttacatgttaccttcaagaagcctttgaccactctaagtgggcccttccttccacttctgctgtgtaatcccactcccttctcccacttgttaattagttacatacttttttgtaattgtttatttggttgctgtctccctctcaagaatgcagggaccatgtctgcattctgcagtaatcactactgcacacccagaatctattacagatcctggcatgtagctgatgcataaatatttgttgaatgaaagtctgtacattgtatttatgctattggtattgctatgacctgaaactaaaaggagttgtggaaaagatttcttatggaacagaaatatcccttttgattaatatcacaatctcgtaaattgagaaaacaaaaaaatatatactactggagcattcatgtatagttggagattatgactcatttattggtgtgtttttggactcagaacaaagatgagggaatattccttaaagctctgtattgaaataacgaaaagcagtcacattttaataatagaagcttcctagcttactctttctgtaatcttcttttcctaaatgtaagagagcctcataattatgaggcttattactagagtaaggctgtcaaaggcagcaaaatgtctttctgtttggaagaataacataaacttgacatgtatggtgggggacagaaggtttcaaaagtttaagaatctgtgttgtcttaacaaatagatgcttctcaaggagcttacgctagtggttactctgtccagtcagggttttttcttctttaacttgggttcatttcctgatggcacacatgaagtttggatcatatggtttgactttagctatggtccttagctatggggagcagcatcagcgacctgtgacatgtaaattaaaaatacaatgccagggcccttccccagcccctctgatagagaacctcttggccatctgtatttttagatgttccaggttagtctgattaacacccttggttaagaaccattgggaggatctgattgccagtttaaggggaccttcaagcctgtaggtctttatagttaaaaaaaaaaaaagattttaaaaatcatgcatatgttgtggctgaattctggtttagcacatactgcttttaatggcctgaaatgtttttcccaaataaattgtcttgttatagctttcatgtgtgatttggtccagcttcttgttttgaagatacttacgggggggaacactttgtgatttctcttagtaacatattaacccacttaaaaaccctttctattacaggtcttcacatttaggcttaatgtgcttaattcaaatgtaaaaatacacctgcctttgttctcagtgaaagtatgtaataaataaatgaggggttggcaaactactgcccaccatctgtttttttatggcctatgaactaagaatcgttttggatagctaaaaaaaaaaatcaaaaggataattattttgtgacgtgaaaattatatgaaattcaaatttcagtttctgtgaatgaagttttaatggaacacagccatccatgcttatgtaagtgtgcatattctctggctg

SEQ ID NO: 105378 - DNA, 1063 bp, Homo sapiens
aagggtacatgactgagccacaagcagacctggatttgaattttaactgaacggtttattagctattcttacattaatactgctaatcagttttcttgtgatatgaggaatgatgtcttctttatgaggttgctaggaagattcaatgagataacatactaggctcagaactgaagttgctaggaatttaattatgctaccttgttaaagtatgtcaaaggcagaattcagtgtttagctgataccacaaggcagtatcctaaaattatgctgtaaaagatataaagatgctgtaagtgactcagaaacctagtgactttgtaatgcagttgattcttagaatactgtcactttaacagaataggagctaggaatgaagaaatagttattaaattactaaaatagaaaatttattgacacatgtaaagtgacatttgcttaaatattgaaaaatttgtagtactatttccttgctttagaaaacattggttaccactttttttatttatagcagtttgtttttgccttgaggcaagatggttgactgagtagttgccacatttcttttgtacaaagtccatttcataggccatctagcttttatgcttagaaacatttccttaacgttatatttcagtatttggctaacctatatagggttaaattatataggctaacttctcggacagatatttctaataatttatgtatttggttctgcaaatgtatgcaaaaatatatgtacaaaggtatgcagatgccttgcatacttgatatatgttaaattttttttaatgtagacctttttcgttctctttaatgactatatggtattccaccatcccccgctcacctggacaactacagtaacctcctaaatggtgtttctactttgctattgccccttattgtcttttttcccctttatagctgctggagtgaattttagaaagcctaagtcatacatcacattgcttcatgggcatcccagtacactttggattttattttacatccttactgatctgattctcatctctgtctcttcatggttctctgcctt

SEQ ID NO: 105379 - DNA, 1062 bp, Homo sapiens
tttccatcctattccctttgctgcccccaggcctcctgtattgatagcccgctattaagaagctagtgtatattctttgcatacttttacttcataaactatatgaagcattgttctgttttttaacttaattggtataaaattatattttggaaattcagtatattctgtgaaaattatttagaaaatgtgcctctgagataaagcctattcaggatgtatcttaaaggagatagctgtgctttaacattatcagtctttttggctgcttatgttaatataagttggagaaaaacagtctgctttttgtgataatatgttcttggagatggagtgaaagattgtttaaaaacattgtcttttttttcccctgaagtaccagtatttattttaggattatgttactgatcaaagatgctgtgtggagttactcattggtgagactaacaataaatcacacatgcaaaggatgttaccataatctaattattttaaacagtaaaattatattctaagacatccagttggcctatatgtgctatatcaatgactatcaaggggctttttatgtatactgtatacatgtacttcacaaaaatataaaaggatgacatcaaaaatctggcaagccaaaagcctacattacatgtagcaaataaataagcatatgaacttattggaatttaaaaccctgtaggatgggcgggtgatggtatgtatgttagatgtgtggacatatctattaaaagttgtgtcagataacagctggtgctgacaagcccttggtaagatggcagcatgttcaatatgttctgtgaaaattatctcagtttatgatctgtcagtattgtggagctatgcatgaaaggacttaaaattcttacccttaaactcagtaacagtgtttctagaacttctggtgatatgggaaattaagagaattatttatatgcaaaggtgtttattgcagcattgttggaataatagacaaaatggggaagaacaagctcagaatggaggaggtagcttatagtatagacatacgatacaatccagatgata

SEQ ID NO: 105380 - DNA, 3074 bp, Homo sapiens
tccctgtgtgatgcagtttttttcaatattgcacaataaaggcaaaatacggacaaattagatgataagatttatataaatttttaaaatattgatcaaaatatgtatccatattggtaatatttgtatttataataaatcattgctgtaaatttgaacttagaaaaattttactaataaaggtgcttttgtgttgcaaactttcatttgaaaagtaatttttctttgtaccaaaaaatctaaaattcgctattctagtcaccaaaatttgctttatgaaaaataatttttgatggcactatatcagaaaacaacttgttaaagaaaatgtggagtttttaaaatcccactgtacctctgttatccaaaggggatctgtgaatttttctgtgaaaggttaaaaaaggagagacctttaggaattcagagagcagctgatttttgaatagtgttttcccctccctggcttttattattacaactctgtgctttttcatcaccatcctgaatatctataattaatatttatactattaataaaaagacatttttggtaaggaggagttttcactgaagttcagcagtgatggagctgtggttgaggtgtctggaggagaccatgaggtctgcgtttcactaacctggtaaaagaggatatgggttttttttgtgggtgtaatagtgacatttaacaggtatcccagtgacttaggagtattaatcaagctaaatttaaatcctaatgacttttgattaactttttttagggtatttgaagtataccatacaactgttttgaaaatccagcgtggacaatggctactcaaggtttgtgtcattaaatctttagttactgaattggggctctgcttcgttgccattaagccagtctggctgagatccccctgctttcctctctccctgcttacttgtcaggctaccttttgctccattttctgctcactcctcctaatggcttggtgaaatagcaaacaagccaccagcaggaatctagtctggatgactgcttctggagcctggatgcagtaccattcttccactgattcagtgagtaactgttaggtggttccctaagggattaggtatttcatcactgagctaaccctggctatcattctgcttttcttggctgtctttcagatttgactttatttctaaaaatatttcaatgggtcatatcacagattctttttttttaaattaaagtaacatttccaatctactaatgctaatactgtttcgtatttatagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctggtaagagtattatttttcattgccttactgaaagtcagaatgcagttttgagaactaaaaagttagtgtataatagtttaaataaaatgttgtggtgaagaaaagagagtaatagcaatgtcacttttaccatttaggatagcaaatacttaggtaaatgctgaactgtggatagtgagtgttgaattaaccttttccagatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtaagcaatgacatagctagctttttagtctgctttgaagtaaatgctcaaggggagtagtttcagaatgtctacccaataccagtacttgaaaactaacgatgtttctgaattcctgtattacaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttgggtaagaaaacatgtcagaatgcttgaagctaaaaagtagaagagtatactcacaatatttctgatgaggcttttttcttcttcccagttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaaggtaagagaattattctttatgtggttttcatggagcattggacacctccagtgtcatgtcattccatgcagtgttcctaacctttttggcaccagggaccagtttcgtggaaaacagtttttccatgaatgggttgtgggaatggtttctggatgacaccattccacctcagataatcaggcattagattctcatagggagcgtgcagcctagatccctcgcatgtgcagtccacactagggtttctactcctatgagactctcatggtgcagttgatctgacaggaggtagagctcaagccaggtaatgctcgctcacctgccacttacctcctgctgtgcagcccagttcatttctgttcttttaaatttttgagtttccatatgtaaagcactatgcgaagtagtagggatatggtaggcaagcttctcttcacacttttgttcttaggtgggatgtagatgt

SEQ ID NO: 105381 - DNA, 1085 bp, Homo sapiens
cattcttgatttggcttgcagcttggatgttgttggtgtctagaaatgcttctgacttttgtacattgatttttatatcctgaaactttgctgaagtttattggatcaaggagcttttgggcagagattatggggttttctaggtatagaatcatattgtttgcaaacagacttcctatttggatgcattttctttctcttgcctgattatgagcagtgttttgccctgatattctgtattctcagtgaatagatgtcgtctaagtatgagaaacaatttttttctattctgagtatttttaagaaggcaacttatatgtggtactttgtatattgtgtatgttggcaattggggaaaagaatagatggtttgtactagggcctcttgggttctgtgtgtgtgtgtgtgtgtgtgtgtgtgtgtcatgaaaacagttactttttagctaccaagcattttttctcctttcagtaacccacctaacaacatttactcagaatttcaaagcaagcttcaaatcagtattgaaagaaggaaaaatataaaggcatttaatggaagaaaatgttgggaataaagtatagggctggcaacacttacttttctcacttattgagagtaattttacttgggaatttatgagagagaaagacattatgattgctccaggtaactactggcagaggaaccatagtcttggggatagacaaatgtggctgagttcatatagaatgaggggatgggatgtaaattctgtcagctgttccagcagtaacctgtaatgtaggctaaaaatacagattttgagatttatttaatcagaatccctggagtgttaatttttatatcaagatctcatagtgttttatttgaagtgacagggaggtctgtagatagctggacatgtatgggactggaagcttaggaatctttaagttcttccaggttattcttatgttcatttgtttattctgaaaatagcatctaatgtattttaagaaatggaataggcacatagtatacattgggtaacacaacagatagggtccccgtgcttaattcttagtcttgtgaaggtgacaaa

SEQ ID NO: 105382 - DNA, 1719 bp, Homo sapiens
cagtggagataacaaaggctttttcggcttaggaaaggaacagtagctatttgagagtttgtcactagtgaggtgaactggcaaagtgaaggaaactgagcaacattctagaaaatgagaggaaatcaaatacttaggtgaaaggaagtaaactctggaaatacagaaggacacctcctaaggctagaacagatatttaggattgataggcacttctagctaatgactagggccttatatcctttttaattttctaggtggaatgcaagctttaggacttcacctgacagatccaagtcaacgtcttgttcagaactgtctttggactctcaggaatctttcagatgctgcaactaaacaggtaaattctgagtaaactggtgccatgggaatagagtcaagatgagtatgtgcttgtactgaccatctgtttttatctccataggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggtaaattgtcaaagtagaatttacctttgttgcagaattgaaaatgaagcatctctagctgttggatggctgtctaagcatagtgatcaataagtaggaattgtattccttagtaagtaggaagtatggctgcgataggggtaagattctgaaatgtttgtgtagtcagaactacttttagttgataccaatagatttagtgtggtgggaattttagggtaagaaaatgattttgttgagttgtatgccagttcttccttctgtttttcaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggtaggtaaattcttacagtgatacctggctatctaaaaggaatgcataaatccaaaggatcctgaacttctttctttggtcattggttccccccatccgtcttcctgaagagctaatgacaaagtaaataaataaataattacacatttctatggctgcagagaaaataaggcatagtgtggccccagtgatatttccttggacacgtccttcacatggtcagtcttacaaaggttgggttaggtgtttcataaagtgttctcatttaatttacacaaaggcccacttccttaggaagaggtagagtcataatttgagatcaaatctgtgtaatttcagagcctcttacccttgcctcatcatgcattttgactataaatatttagcagtccgttttattatcttttctgtgagttaaacttttttcatggacctaagaatattcagaaataagtagtagcatttctgtactcttaaccacaaaaatctcaacctgaagctttga

SEQ ID NO: 105383 - DNA, 1013 bp, Homo sapiens
tgctaaaacttggcaaagttttcaccaaatacatggaagatatacaaaaatagagggggcatgtaaaagaaaaacgttgacatagtctgagcattactttctcatcttctctttttatataccttttacccagaatgattggtgcccttactgtaggaaagttgtctttgggattcagcgctgtatggaagctctgttgcactgtgtatgggggaggggtgctgctttgaattagtgctgccaggaggcctcttttcagtgacattcaagttaatggaatccttcttccttcctgaactaattgcaagttacggggaacttcgggtatataatgtaaataattacagtctaataattgttcctcaaactttacagaggagaatgccctgtttgttaaccatgtttcttttggcaggagggggtccgcatggaagaaatagttgaaggttgtaccggagcccttcacatcctagctcgggatgttcacaaccgaattgttatcagaggactaaataccattccattgtttgtgcaggtatgttttaagtgaagtgttctaggttttatgtccataaaatttccagattgtaatgactaataacatttcagaaaattagggaccataatagggttaccaacatttaattttatgaaaattccctacattttttggtcagtaagagaaacattgagacttgagaagagggaggagatttcacatttcacttttatgggtgcctagaggggagagctgacctgggctgccagaggcagggcatagacccccaaccaattctgggttttccaaatcttagatcagttagagctgcctctgaagaaagggtttatagctaaaaaatattatggaaatccagtgctccagagcattaaacaccccaagacataaaattcagagaatattatttactacagtgtgaatgcctcttgcactctgaattgggaatgtttgcaccacagtggggggcttgccatgttttagctttagatttaat

SEQ ID NO: 105384 - DNA, 1050 bp, Homo sapiens
aacatgttccaacttgagcccttaactttctccacctacccccttccacaaacctgttttcactgtcttctctgtcttagttaatgtcagctttgtctgtccagctgctcaggctaaaacttttctttcatataacacatcctatcagcagctcctgtttgtgggtaggcattttgcctttttttttttttttttttttaaactgctatatctctagcatgtagaacagtgcctggcagcacataataggtgcttaatataatatttgttgaaagaacaagtcagtgagtatttttaatgtgaggtgcaaagagaaaaaaaaatgtatctttgaggtgtggagttttgaagaacttccattttctaagcatttgtgtaatgttggagttacttgttccttttgtaatctgaaagtatgctttaaaaaaaattagtgtacttttgagaattttcattttgctttctattcttccttgctttgtgcatgtttatctagactgctgatcttggacttgatattggtgcccagggagaaccccttggatatcgccaggatggtatgtgtctcatatttctcgattaactccagatcaagctaaagttctaaaacttttatcagaagagccggtttgctcatctgggaaaccagtgttggcagaaaagtagtggcttcaattaaaagcagttcttaaattccagtcagcaacagtatctttaatggagcacagggaattcagagccacacaatgagtagcagtaggattacaccaccaacaaatacatgctactgctaggcctctgcagtgcaggatgttacaatttacctggctttttattctctttttggccagaggactcataatacctttgtctacaagctacccaaggaagataggaaaactcctgtttctaggctcagatctcgggtgggtttttacatagttgcattatcatcagggttttcttgaaaagctaatttaaatctgggtaatgaacatggaggatggcatagaccactaacaattataactgtcttacatttataaccgc

SEQ ID NO: 105385 - DNA, 2157 bp, Homo sapiens
gaaatagtgcctttccttagtacttttgtgggtgtcacttggcctttttgtcaagatagattacacctgccagacctcattattgtcttaatcctccttcccatgacttctcactgcctaggtggtcacacagtagattcctgcttcttctcctcgggaaccccaagtctcttgacaggggtaaatgcagagtgttcagggttagactaatgatgtgactaggccctgctggtgtgcctgtctgatggaaatagatgttatttgtgtagtctcatgggtggcctggcactgagtaattacttggctaaagaaagctggaggttgaagaggctagaaagcgttgttttctgacaagtttgctgctgaactttggatgccctaacctcagtgttaacgtctatgtctgcttctctcctctctcttttgccttccttcttgcctattttgttgacaccctgactcttctagatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgattgtgtcactctttctttttttcttgtcattaataaatggtttgtgagggtggtaagtaagtttatccaactcaactttatcctgaactttatcctgagatagatagatacatagtgaagtaatttgttgtagcgatagagagggccctacttctctagatgcaatttgccaagtttctttagcatttggccctggattacgctggacccctaaaaaagtgtttcagccttgcacattgtgattagttctgggctttggtgggagaaagccaagcagactatccatctatctatctctaccccaatccccctcagatgatttgattccattaaagtaatgaaataaatagtaactacccctacctggatttggattt

SEQ ID NO: 105386 - DNA, 1050 bp, Homo sapiens
aatgtgtctcaaacaatttgctccagtaaaaaagttcccgttttaagctcttaattgcacatccacacctataagagtaagaaagctcctggctgattggctggaaagggcaatggagcagggagggtcagtgtgtggagtgggtctgggacacataagtcagctccaggcaggagccaggcaggcccactgaaggccccaggcctggtagagtctggctgcctaccactcactggcagtgtttctggcagaggtggctcagatagtgagtggtggctggggctgggagctcagaaatagctcagggtgctggcatggccaattctgaaccccaccaggactgtgggccaggatttcctgcttctgcttcccaagaggatgctgcagctggtccaccagatactcgggtgcaaaagaggctggcccctttgaaaggggggagcactttaccttagagatgcctattaagtgtacctactttggtttttcttacagttcatttgccgacagtgcggtggctcccttggccctggaaatcctccaagccgttgggcactaggcaagaaggtgcttagcacaagcccgccctgtggccccagccctcggatgcataagcaaggtcagctcccagacacctttgccacatcccctcacagctgtctttggacctaataaagtcagcttaacccagaacctggtggcccaagtgctcactaaccccagggcctagaaaactgactcagaatggacttccttggttcctgtggaatgcatctgggaagcccaggtttgttagctgttctcagaaatgttctttccctctctgtgtgggccaggtgggctaaggttagcactgcctgtggtaataaagcagtggatgcaaagcacagtcctcagcctgccagcatctgtgagcatctctcctctcctcagggaagagcggaagggcgggacgaggcaggaatgctctcccaaccgcagctccagagcaagcctttggaagctaatctctgagcctcttgtcttctccccttttacctgcctggcttt

SEQ ID NO: 105387 - DNA, 1050 bp, Homo sapiens
cctggggtttagttattaatgcctctctcccaggtccccaggcaccttcttggcatccttctatccacgtgaaagagatcatgttgggctgagagccccaaagacagatttccagttgctagccaggcctcttgagtcccagcacagaaaaagtagttttgctttaattggaaagttcaggttcccagacacaaactctcctgagagatccgcaggaggctccctgccctgaactggccgtcttctgccccagcagactgccttgtcccctcccctgaggaccaccagtgtcctgcctctttccccttggtcagcaacactctgtgggggaggttacgcatgggggttacagacaagcccaggggacaccccccagtgccttaggcagccacagcaccatgcaggcctgatactcagggtgcccatccaacagggcatgagtcagggacgggtcagctgaccactgtcttcttcctcctgcccttgcagatcacctccaatgagaagcacttggagagcctcaagaatgcaggcagcctcctgcgggctctggagcggctggcccctgggagtgggtaagtgggacccaggaggatcagcagtctgctctagatcagcacacactctcagccattcctttctccactcctcccactcatctccctccacaccagggactaccaccttccagcccatcactgtccactgagatccttcccagtgtgggaagggaagctctgccactccacacactgggaatccccagttatggtggggaaagtgaggggacaggaatcaacagggggagagaaagtcttagtcctgccaggggaaacaatattcccaccttgaggcccctgaagaggttgagtggatgaccaagtgggagatgcaaggaacctcatgagaaaggcagcccctggcctgtgcacacatgcccccatcagcagcccagccagaggcatcctcatcaccaccttgtggaggactcaaggcccaggcagggctggggcaaatgtgacagcttagcctgctctgctgcaccaggtt

SEQ ID NO: 105388 - DNA, 1160 bp, Homo sapiens
tgcacttgttcatgcccctaaagacttgggcttccctaatcaatcagacttcctgggaactagggaattaaaaataaatatttatgtaatatgtatcctctgccactctcactacccatttagcatagcaaacctatgatcccacatgcatgcatagtttcttcttaagaatttgcctttaaaatcaagcatcatagtaagtgacctttttgatctgtgtcagtgcacatttactttgatttttaaaaaatattttggcttgtaggggtgatgagtaaggttgagctaaaccacatggtctccttccagtctttctgcttagaacatttaggagatggctgggcaagggttagtgccccaaacgtatgtcatagatcaggtctcattggcattttaggcagttgtgccaaacttcctagaccggtatcccagtgatggccatgaaattgttattgaggcttgtttaacgttttctgtttcagggattagtctttttcaacaccattgttcaaggaaatgttttgaaagtgttcctgagaattatttctcatggcatcttgatttcctttttcagttgaaagcaagctgctatcatgaccctccctgaagcaagtaatgattagggctctcatttcaaattattctgcctccatttccaatttatgcatataacatttttatccattcttcaaagaaagtctcagagttccatacagtacatgtattttttaggatactgaacactttttttttcttttttcactattttttttttaaatactttaagttctgggatacatgtacagaatgtgcaggtttattacataggtatacatgtgccatggtggtttgctgcacccatcaactcgtcatctacattaggtgtttctcctaatgccagccctccccttgcttcccatctcccgacaggccctggtgtgtgatgttccccttcctgtgaacatatgctctcattgttcagctcccactaatgagtgagaacatgcagtgtttggttttctgttcctgtgttagtttgctgagaatgatggtttccagcttcatccatgtccccacaaaggacttgaactcattcttttttatggctgcatagtattccatggtgtaaatgtgccacattttcttttttattttatttt

SEQ ID NO: 105389 - DNA, 1050 bp, Homo sapiens
aaaatgtgatggaaatccttcaagtgtctcccaagtttacctttcccttaaactggatatcaatgggagttttcccagggcaatgattgtagattagctacttgtcttttaattaaagctagcttactccaacactcaaaatattgactacacatgaaccaccacagatttgttctgtgcctaaaattggcttaaatatatgctatcgactactctctgaaagcagaaaaatagtccatggaagggtgactataatatgctgatgttactaactccctgtcaccttctcacccgtctacctggtgcagcagaggtggaaggaatgtgatttgcaataactctctgaagatgaatagcattaaggatatgttacaaatatctattccatgaagaatctttaccctgtggtcttcagaaagtcttgctgtgctcaccatcattttccttctgatttctcatataggtatcggcccttctcattccacatgagaacagacgtgttctgttgctgaaaatgagtgtaatatagcatttccttatgtacagagtcattaaagagaccagatgaggaaaccaggaattctgcagccattcttttaatattttagtaccaggttgggttgtagaacttagaatcagaagaggcactctttctactagatagaaaagtaaagaaatattccttgaggtataataaaaaggtaaaattatacctctctccctcctgtcttatttttcttggggttaagaccttccattcttgacttgtattcttaaaggaaaacagaatggggattgatgtaaaaccagtaaaatttctaagagaaacactgtgtacccaaatgagttaaaagtaaattcaatcaattttatatgcaatctggttttttagaagatttcctaaaaccatgagaggatgctcttaagcgtttctgaaagagatcttttcttgaatccatacacactcatttgtagttccactggataagcattctctgccactgattgccatagggtttgcaagttaatttgggaactttttgaatgatt

SEQ ID NO: 105390 - DNA, 1042 bp, Homo sapiens
aaatccctgataatgtaggtctgagatcataacttcccagggcagcctcctcagttgtcaggagtgtgaatgtgtgtggaggggttggtgaatgaatctagtttttccttacttagagagtataatctcctctcttcaggtgcccatttctgtgtaaggtgactcataaaactctgtatgctaggaggatgggagtgcaggggtcccactgataacctttgtttgtgttgttgctaagtgcttcctgggcagtcagctccatgctctcatggtctcaactctctgcctccggttttcatcagaaactagtctgaaagctccccctgttttcagagcttagggtttagggtctttatattttatctggcatttttcattgttttcagtaagaatgttaatccaagtaacagtacccactataactaggaacctgtttgtcatggtcattgtcacagcaatgaattccaagtcatcaaataagatatgacttgctgggtcgttacttgttgattcttttgcctaatgagcaataacctatggttaatttgttaagatccagtatttataaatatctattttgcattcaaatagaaattaattttctaatcatatgaaatgcaagcatactaattattgtaactacagcgtctattagaagaggtattattgcaacttactggcttcataaaaatattttttaatgatataactcatgagaaattttctaattacctctttttgagcatgactggaatacatgaagatgaagatccaacaccccaaggaacatactgttgtttgaaatgttagcacacatgatgttcaaggctgctgatcaatactatattgtatggaagtggctaaatgcatttgattcttgctgagcacgagctcttaattcagatttttcccagagttttagaccatttagctcctcagagttgaaatcatcaatctggcctataggacagtgagaaagccacgatttgttttgtacagcgaatttgttccccactcatggtggtttcggaaaatattatta

SEQ ID NO: 105391 - DNA, 1029 bp, Homo sapiens
gcgccgggaccctgcggggacagccctcctaatgcaccggccgcacctgcaggaggccctcggagcccggaaaagtgcccctagggcatcgtgtcggccacgccgcgtggcctggattccgcgctccggcactccgaggtgacagtgaggcgaccttcaaagagcctggagctgagcgcgggcagcaccccgattcccactcacccgcaaaacttgatgaaaatgacatcatctgagcgtgtcagagagcagagagcctttagagccctcctttgcatccttgagagttaacaagtttactttgtcactttcttgacctgatttttaaagttcttttctagtctccaaggtcaagctcttgcaggtaaaaacaaatgtaatgaactgtatcgtttcttcttttgtaaagttgtgtttcaggaaagatgttaaaagtcggcctgctcttgaggctggtgctgggtgccccttccgctttaagcttgcctgttttagaacccgtggctgcacttgttcagacactgaaattagcgtccgctttgagagccttcagagtattcgtcgttggaccgctgatttttttttttttctgatatgcttcactggaactttatttgcttcaaaagtgtaaacgttgtcaatactgtctgtgagtgtgtattcgggactggtaaccttttctggagggtcttttgtttatctggaaggagagtggaggttaccatagggaaacggtctagttccagggtcctttccaatttccaactacaagagcagcgaagaggaaggtgctcagactaagctctgattagccctggagccagtctgcactggggagggtctccccagattgagtgaagggacaacaggctgggagcttgactggtaggtttggagagttggacctggagtgacagatggcgccttcccctctgtctctcggtttggaatggtcatactcggttgctctttgatcttggacctcagctttgtcacagaggttcccagcccagtgtagcctaagccagc

SEQ ID NO: 105392 - DNA, 1016 bp, Homo sapiens
tttgggaggccaaggcaggtggattgcctgagctcaggagttcgagaccagcctgggcaacatggtgaaaccccgtctctactaaaacacaaaaaaagtagccgggcgtggcagcatgcgtgtgtaatcccagcgacgtgggaggctgaggtaggagaattgcttgaacccaggaggtggaggttgcagtgagccaagattgtgccattgcactcctgcctgggcgacagagtgagactctgtctcaaaaacaaaacaaaacaaaagaaaatggactcagatttatttaactcatctatatttggcatgcactgtgatttttgtagggaaagacaagaggatgttctttttaaaagatggagatagaacccaagggcttatgtgggttcttaggttttattttattcttggacagagatacactgttgttagacagagatacactgttgaatgaatgggtcttctggcttctcacctccttttccccccttcttttcaaacaaatgttccctattctgacttgtcttcttagatgtatctaagtggaggccacttgcagtgttgaaaagtgcaaattttagtgaagagacagtaaataattgcatatgtgtaaaactggatgtctcctgagttacacagaataccaatgatgttgagctgcttaaaggctatgataggcattttatgaaaggctgtgtagtatgattcattatagtgagaaatttatttaattattattgttaatagtgcacctgaggtgaaacagggtggaatggggtgggaggggagctcttgaaatccttgtttggacttaatttttttgttttcaaaatttattatttttattttacagtgctgttccttgcagagcagggctaactcataggcagtgtgcctgtaggcagcctgtttggacttccttaaacactttttttttcttaaatagagacaggttcttgctatgtaacaggtgaagctgggaatagcccttcctagaatgctgaggtgggaggatc

SEQ ID NO: 105393 - DNA, 1051 bp, Homo sapiens
tctggttgttttggtacaataaaaaagtgctttttttagagatagaatctctgttgcctgggctgaagtgcagtggcctgatcatagctcactgtaaccttgaactcctggactcaagccatcttcccgctttggcttcctgagtagcatgcgtgctgccacacttggctaattttcttttcttttttaaatttttttgtagaggtgaggtcttgctatgttgcccaggctgccttagcttcaagcgatccttctgccttggcctcccgaagtactgggattacaagcatgagccactgtacctggccaggcagttctttaacataaacaacgtgtgctgtgggtctggattttttttatgctaacattctgtaagctctcagtttttaagttttgcaaaatgtagaacatatatgatacaacctactctagatacacagcctctagtgtaggctgcctccttttattatgggtttctatcaaataatttccagtttgagatttgagatgtgaccaaagataaaatgtctccttataatgttagaagtggtttggcttcagctgtattattgagtcaggaatttggacctttaggagcaggtaaacaatgagagcagaaactacccttgaatttatgtttgtctgaggaccattgggaaatatttcttggagagtggggaagacaaattcctttgacctccagaagaattgattgtcctcagtgtgatgagaaaatcagggagagagtgactgaagacagctcagctgttcatgccaaagggactgacggtccagattcatggtggaaccaggtggccgtgttctggctggagaacagcagtgggaagaggacaatgctcacgagagggacaatgctgtctcggtttctgcctgacttttggttgctactgtgttctgtggaacaaatattttatatcatgttgcattaccatctaaggttgacaagttaactagaacctttaatttcttacgcattgaacctttaattatcttagctccattaattttacttacatataccacttgtact

SEQ ID NO: 105394 - DNA, 1030 bp, Homo sapiens
tccagaggtgtgggccttgcctgcactgaagaatttcaaacctgggaagaaaattggaggtttacttaaactaaagggacagattcttgtcatgttcggaagttggaattggcaagctttatactggagaattaaaaactcaaaacaaacaaaaaaccaaacctatgattcaggaatagcattataatgatttagaggaaaggtggggaggaggaaaatgagcaatttgttatgtgtatgactcactggtgctgtgtctgcgagtattacatttgggtgcagaatttctgagacaattggtttactggctttcttagtagagaataaaagagtgtcacctagacagtgagcatttcatttcaacctttgcatctagaatatattttaaataaaatgcagaatactatgggaattgtacagttgtacaattgctttatgtacctgagtgggaagtagctttgttttcattcattaattaaaaagtaaaaaccttcagattgaacagtgtagatacaatgcagcacagcattgatgtgtttgaagccatgttcttttttcccctgtaagattgttgcttaggtgtgttgaacccagcaactcctgtttatgacaggcagcttcggaatcattaccttatatgataacctcatacagttattatttttttgaaatggagtctcactctgttgcccaggctgaaatgcagtggcacgatcttgcctcccttcaacctccgtctccctggttcaagcaattctcctgcgtcagcctcctaagtagctgggattacaggtgtgtgccaccacacctggctaatttttgtatttttagtagagacgggttttactgtgttggccagactggtctcgaactcctggtcagttatccacctgcctcggcctcccaaagtgctgggattctataggtgtgagccactgcgcctggccctcatacagttattaagaggattatgtgaatttatacatgtgcttggctaagaggaagcatttgtgttagccataattattgt

SEQ ID NO: 105395 - DNA, 1061 bp, Homo sapiens
ggccaagtgagatagaagctaaaatatcttttgggtttgtttatacatagtaggtatgcagatatttctagttgtatcatttggttctttgtttttcagaagagatgctggcttagccttgtaaacatcgcagttgcataaaagtatttatgatagtccttaaaatgctgtaattatctttgaagttttataattttgcagtgtttaacttatggcagcaatagcattggtattttaaatcaaaacagaacactgtcaagggttacataacttattcatgatattaacaagatataaagcaccatgtttttgtgtgtaactgtttaacagtagatgaagttaatgattgcccactttcagctaatcatatgattgctattgaaataagtacttgctagacagggatagaatctagtaatttgttagcttcagtacttcatgcttgcatacacacccatgctattgtgttaccaagcctgagttttgaaatgtggcgttctttgtctttttctggtgaataaaccccatacgtcttaccatagccatttgactcttcctggctgtcaggatgtgttgccctggactgagagtgagagatcccagatttttcagcttctcttccaattgctagggataccacatcagtgccaacgtgagtctcctcttgtcactttctgctaggcttccccttagaagctgaaattctttcccttcctgatgctaagttgcagtttcttaaaatgctagagagcttttaaaagcataccgtgatgggaattagtttcaaaagattataccagagggggttaaaacttgccaaccttgtaaaaacctaacttctttgtttacgtcctccctgccccgctttctgctgtgcttggtttcctcctagcaatatgccttggtcagggggagagtcttcctgtcagacataacttcccagaccagcactcctggaggggcctgtacctcagaccctggcaacgaggcacgctggggcacgctggcctttcgttgtggtgtagaaaatttttcatttggaattccattttaaaaataag

SEQ ID NO: 105396 - DNA, 1004 bp, Homo sapiens
tagcgtgtttctagtcctaagagttacagacttcctaggcttgactctgtaacagccaaatgccttttaaccttctagggagtttattgtactttttattttctatctttttgagacagggtctcgctctgtcacccagctggagtgcagtggtgcaatcatagctcactgtagcctcgaactttggggctcaagcagtcctcctacctcagcttcctgagtagctaggattacaggtgcatgccaccacacctggctaatttttatttattcatttattctatttttgtaaattttattatttttctttttttctctgctgcttgaatcatcataatttcttattattttttgtagagacaaatcttgttatgttgcccatgctgatctcatactcttaggctccagctatcttcccaccttggcctcccaaagcatcgggattacaggtgtgagccatcatgctttgaatttaacctggccaagtgcagtagataatgctgtggtaccacagagcagaaatgtgctattgttgtagtgtgataccatagaagctgcttttagagttttaggattcaagtaactgattagataaggttcatcatcattcttttattggacaaatatacacggtgtgtccattttagacccattttccttaattatcttattcactggcttatggattttgttttcggccttccctctaagtagaccagaagcttccagaggtcaggggcttcatctgatgtttcctgcagatgttcaggacctagagaggtgcctggcaagtgttgagtcaatggcaggcagggtactggggatggtgagcaggcatgcagatgcataaactgtcatggtgtttacagtctggtactatagacagacattaatgcaatttcacaaacaaatgtcaaattgtaactctgacagtttctgtggcagagaccactgttctcagatgactaacataagagctttggcttagccaggagtttgggaga

SEQ ID NO: 105397 - DNA, 1049 bp, Homo sapiens
tttctatttccaatattaggattttaaaaataaaaatcttgtgtgagagacaaagtaaagtaccaaaattgcctcagttagaggagccagttttctgtggatttgaaccaacctgtaacctgagccgtgcacagctgccatgaatagaacagggacctggtgaagggcaccttctgccactttggccgattgagatccagcaacctcctggctggcagtgatcatgaagatgggaactaggacactggtgcattttaaggtgcagtaattaaaggcactctaaattactctttgctgtttagaccacctgggctgtccagtgctactttggataccaaggaaaatggaatattcttatgtaaatatggatggaccatgagctcctggagggctggaatccagttttgtgcaattgttttctccacaaagactgacagtaggttcacggtcctgcttcttgaatgaaggaagaagggaaggaatgaagggtgaatgatgggagtaacagaaattgattgccaattcacatccatctctgccacactttcttctttcctaatagaatccagatttcattccattcttaagcctcctttgcagcatgctggagtaggggttgaggaggcgtccagtgggtattgattggtccaggccaatcacagtggccccattccctttgctgtagttgtgactgggccgattgggatcagaacaagtgggctgcagtttcctggggaggttttgttatgtttgctggtgatgctgtatctgctgctctcatcttgtgatctgaggagaacctgctggaaggcgagcactgacctgctgtgtgtggccaagcagaaagggagcagacgaacttagattctggggttggctctgtctcatttgcatcttgggcaggccacatgtctctcctccatcaagtgtcctgtaacctggagaactcaccctggttcacctgacacgtggcccacaccatgttaatcagtttgtgcttttattcttaagtatttgaaggaaccagaaaatacaaccaactgaaaggc

SEQ ID NO: 105398 - DNA, 1029 bp, Homo sapiens
aaaaatgcgaatgctcgcagccaggcgggcgctgtggctcaagcctgtaatcccagcacatttcaagcctaggtgggtggatcccttgagcccaggggtttgagaccagcctgggcaacgtagcaagaccctgtctctaccaaaaatacaaaaattagccagtcttataacccggtctcaaatgaataaataaatagagggatacaaattaaaaaaaaaaacctttaaaaagaattctcttacagtctgatgtcaatgttggaagattaagaaataaaataaatttttgaacttgctgtctgagttacccaaatgtaatttctaagaactctaaaatattatcacctagaatctaggaagctaccatgtgatcctagactaatagcatagaatgaatgttgcttcattatgaacttattatggaaatacaaatacataataaatactttaagcagactatagactgtttcctaaaatactgaagttaaaatatttgtgctagacttcctgatatgaaaagcttttctcataatgatttgtgaattaattttaccatagaatagtaagggtatatttttaatgggttaagtagctatacttaaaaaatacatgccaggcatggtggctcacacctgtaatcccagcactttgggaggccgaggcgggcagatcacgaggtcaggagatcaagaccatcctggctgacacggtgaaaccctgtctctactaaaaataacaaaaaattagccaggcatggtagcaggtgcctatagtcctagctacgcaggaggttcaggcaggagaatggcgggaggctgaggcaggagaatggtgtgaatccgggaggtggagcttacagtgagctgaggtcgcgccactgcactccagcctgggtgacagagcaagactctgtctcaaaacaaacaaacaaacaaacaaaaattagctgggcatggatgcacacacctgtaaccccagctactctggagtctgaggcacgagaactgtttgaacctggaaggtggaggt

SEQ ID NO: 105399 - DNA, 1026 bp, Homo sapiens
gattgctttagcccgggaggtcaaggctgcagtgagacttgcttgtgtcactttactccagcctgggtgacacagcaagaccctgtctcaaaaaaaaaaagaaaaaagaaaagttatgggtgggtcggatggtgcagtggtgctaagctcacttagctgtcaacaggggagggctgggtttgtcatgttggaggtcagacaagtacctaataaggaggtaactgaggactgttggatgtatttctctgggtggggatggtctgcctgtgaagatgaaattctattggaaatattctttaattatatttttacatgtctcacttttatttaaatagggatactatattctgtactttgttttgtgacctgcaattttcccacttaatctatctctagagcgtcttttcttggccaccatgtgattctctgcagtgttactggaaatggcgttgtggtgaaaaatgtgcagacatgatatatgggaggaccatgccttatttaatcaaaatcagtattattagacattttcattttccaatttttaacagttatataactgctgaggaaagttacatctttgtatgcagttatgatttttcttagaaaataactgaagaagtggaattgcttttttttttgagacagaattttgttctgtcacccaggctggagtgcagtggcgcagtctcccctcactgcaactgctgcctcccgggttcaagcgattctccagcctcagcctccccagtagctgggattacaggtgcccgccaccacacctggctaatttttgcatttttagtagagacagggtttcaccatgttggccaggctggtctcaaactctggacctcaggtgatctgcccgccttggccccacaaaggccgggattacaggtttaatccactgtgcccagcctggaattgcttttgattcatgttcctgggtgtgagtgagcttgttacctgcacccttgtcagcagcaatagttattataataattatgaataataataattattata

SEQ ID NO: 105400 - DNA, 1089 bp, Homo sapiens
gaatttttctttgagtgaccgttgatttattatttggggggattccctttttccagggccagagaaaggtttagccttaaaagtggcatttattttgtgtttatctgtgtgcatatgtgtgtttgtgtgttcgtgggcctgagtgtatatgaaatgagagcaagagaggacagacacgcatgacagcatgcacgtgcagcccccagtccacatacaagtctgccctgaagtcattcgagcagaatctgtaacaggggctgcctggggcccctagctgttctggcttgtgctgttcaggaggccctgggggctctcccaggagttcacaagaggctctggcagttgtccttgaccctttgtcatctccttccctgcgcctttggttaccctgacactgctccgactttctgactatagttgctgctgtcggctcgtctaaatctttcttattctgtgggtggtcacacacaccgtcttccaagatgctgcttcccttcacagcatagtgtagcagtagttgcagttttccagtgatcagaaatgcttcccagtcctacatctacaattatttgagataaactttgattaagtcacttaatctttgcccaagccttttccccaacccctgcctcacaaaatggggatgattctacgaagctctagcatatgattattgtacgggcaggacctgtggcctagggcatgtgaaagcccattgtgaggtgtatagcatgagggtcctgtgaggcggataacggcttcttgacagccttgcttttttgctcacctggcattgttgctgtaaacctgcaactcatctcctcatctcccacctgttcaacttttacatgatattttccactgcgcagccacttgtccagttatttaaggagctgacccggactgatgggcgtgccagaaaggtcaaatgaggtaggagagtggtaagatgaaagacgggaggaacagacctctttgcatggttgcctgtcagctgcccccaacccaacttgaccccggagttcagaccccatcattgtcctagctggagtatgcatatttcatatatggacttgagcagtctcagcg

SEQ ID NO: 105401 - DNA, 1570 bp, Homo sapiens
ctgcccaactgccccagactctggcagtggggcccccgatggcagtgggcacctccccgtgaaacctgccaagctggacgccacagctctgcacgacgacactttggccaactccgtgcccccttcggaggcatgcaaccatgcagtcctagcctgcagcctgggcatccctgaggaacactacataagcgaggctgtggaagatgctcccagctacagagggtaccgggatgcctgcaccattactggtatgggggccctttccctgccagggaggaagggagggaggtttcagtcactgaggactagggaaggaatgcagccacatgggagggtcttggggaggtatgtggagaggaaccaccaaagtgcaaaagactctgagctttcggattgtgagacctccaatccagaacctgttctgccagtgaaccattttgtaacttgtgtcagttgttgacctactatcctgactgagaggtagacagcatttcactaaattgtcatgaaggttaaagatggtaacatccaaacctgagcagcaagcatggcccatcacaggcactcagtgtattgaacccttccttctctctttgcactcagcttcttcagatataagacaggtgtagtgggaataacatgcactgtcattgtgggatgcaaaaacagaaaactacatggagtgccctttgtacaccatcaggatttgcacagacatggatttttacagatacctgtgtcagtcataactctcagtgtcccaggtggtaatcacctaacatctgtgcgggcacttagtagtagagctattgcttttttattttccccaaggaagcattgagacaagtgcttgaagctagcacaagagagggctctcaatggaaatggtgtaggatggtgtgcataacagcagcaagtggcaaaattatagctcaatccagttgcattcatatagaagtttgcttaatttctcatttttgtctgcagtgtttgcttttgtttgtctgtttgaagtaatgcctgatgacagcttaatatatgcaagttggcttccagtagcttctcttggttctgtgttaccagttaagccttgaggacctcctgtgtgtcaggggtttcctggatacagaaaggcacagagaaagccgggggtcccagcctggtgcctagctgctgtgctaggcccccacacacctcctctccctttttgttaagtggcccacatgtgttgtcctccgcttgtgactgagtccctctcccacttgcctgccccctgaaggacacagttccaacatctcccttttctctactgcatcattcttttccccttgcacttgggtctttcttattagtgcagaaacatgctatgatctccctcttcggaaatagaatccttctcagtcccgtgtttcccgcaggccagtgtctctgctcttctgtttgcttactctagtttttcttttgttctctctggagtccactgcaggcaggctcatgccccaccacactgacagcctggttcagtccaggggtctgtcctctgccttcaccttacttcacttttcagtgg

SEQ ID NO: 105402 - DNA, 1071 bp, Homo sapiens
ttctgtggagggaacctgacctgcgggagagagggagggagaaagagaacagagagctccagccagctcaccctttggggtgactggaagctgcctagaaggtggttttgccctaatttacaaatttactgcccttttgaggccttatctggtccaggctcacttcctactctgctaccttctatcatggtgttggaaaagaaggagcgcctagcagggtgggccttttgagcatgggagtccacagtgtaccccttggagcccagttgcagggagagcaagatggacaggtggtttcatccagaattgggttttgctgtatgggtgccgtgaaagtcccacgagagtgagggaggccgagccttaggcaccagcgttgctggagccaaagggctgggggattccagctggacaggaagtgggcggtagaggccatgcagaggaattgaggggctgggggtctccatggaatagcggggataactgagggagagctgtgggggaagggggttgcagtcagggagggggtatctaaattccagatttcagaggtggcccgggtgtggctggcagaagtggcatgtgataggagggccgtggaggtcccagacttgagagctggggagtcaggtggtgtcaggtgtaggggtggcagtggcagcctggatgagtggctgcactcggtggagaggacggccgccaacctctaccggggcggagttgctgatgggtggacgagtgggcataggcgggggtaacccagctggatggcctgagtctcaagcgagcaaggatttttaaaggcaaatgggaggaaatgagagggggaggtggcccaaggagccagaggatgctggcaccaactccagacctgagtgcggcagctcagagcaagaccctaatcttgaccttccaggaggtttaaaccctagtttgattttgacctagatgatggaacgtttgcgtggtacgaactgaaccttcttagtgggagagatggaaatggttggaaagacgatggtgagctaagcctgtgggcaggggcccctccttcaaaccccagccacgcag

SEQ ID NO: 105403 - DNA, 1045 bp, Homo sapiens
tttacaggctatgtgatgtgggtctaggtattcaacttctctgtgctgtagtgtattcattcttatgtcaaacggggataaatgttaggactcttaggaggattaaatgagttaatggatgtaaatgcttataagtgcttatggtaccactccataagtgtttaccattattactgatgtgtttgttatcattataagaaagtgcaactggatccctgcataactccatcaaacccaataaaatccagatggttcaaaaggtgattcaaagatgtaatgttggctgctaccctaggcacactgcctgtgaattagccctgctcagcaaacagcagttaaaataaaatagaaagaaaagatataatgttaaaaattcaactgtgaaagtgctagaggaaaatattgctggatattttactaatcttgagatgggaaagtccatcctaaacatggtataaaggctagaactataaggaaaatgactgatcgctttgagtgtgcaaaattaaactttacacaggcattctttaactgtgtatttgttcctgaaaacattgtgtgtgttcatgcacacgtatgtttattgtggcactattcacaatagcaaagacttggaaccaacccaaatgcccatcaatgatagactggattaagaaaatgtggcacatatacaccatgcaatactatgccaccatagaaaaggatgagttcatgtcctttgtagggacatggatgaagctggaaaccatcattctcagcaaactgtcccaaggacagaaaaccaaacaccgcattttctcacttacaggcgggaattgaactgtgagaacacttggacacaggatggggaacatcacacaccggggcctgtcatggggtaggggtggcgggggggatggcattaggagatatacctaatataaatgatgagttaatgggtgcagcacaccaacatggcacatgtatacatatgtagcaaacctgcacgttgtgcacatgtaccctagaacttaaagtatatatatatatatatatatatatatat

SEQ ID NO: 105404 - DNA, 1054 bp, Homo sapiens
tttgctgtgttggccaggctgatctcgaactcctagcctctagtgatctgcccgcctccgcttaccaaagtgctaggattacaggcgtgagccactgtgcccagccaacatatgcttttaagagaagttaccaagactattggaaatcaaaagtattttatctttttatttcctagcaaaacaaattcaaatcgacagtaatagtctattttttgagtattctcctggagatttaactctgggctgaacttatacacgttaactttcacgtttaaaataaatttgtgtacaatttttgctttgtgttttaatattagaatcaatctaacactaataacctgtactgtaattatcgcctgtttttttttagttgtgacattttggggcctccgtaacaggatccttcctccctttcctttgccctgcccttcttgtcctttcttgttgagcaacaaactggcatgcccaagtggaatgcgccacattcagttgccctttagcctcacgtcggacaccctgtttccaaacacggctgagtcggctggattggctgtctctgtgcgactgcttctttgggggtatgtgtcaccggggctggtgcatgtatgtgtgagtagatggtaactcggtacgtgacaccaggctatgtggaactcaactgtgtaattttgtgtccgttttcttagaaagcgtttcttctgttggtaattaaggccatggaattctagagaactccccagtgttggttttcgttcctgtctctgaagcatagttagtctttcctttcccatcctatgagggtttctctgcttgtccttctctcttctggagatcccctttgctgttcacagcaagtgagctgtccctcagtggggagagaggcagaaaaggaagacttggacctatcccttgtccctttgtggctggggtgtgagccagggtggagtcggaggtcttgcttccatttctgccactgcttagccttgagacttcccccatgtctctgaaccttgcagggccacagtttccccttctgtcttttagatctgggtct

SEQ ID NO: 105405 - DNA, 1092 bp, Homo sapiens
caaaattctagataggaggatagcttcaatggtaaaagagtggcatgaagaagttaggcatactggtgaaattaatactggtttggctgacatgtagaacgcttgaaggagaatggccagagaaagggttggaggaaagacttaactcagatgataaaagctcaaaaattttggcttttcttcctaaatagtggacactaaacagcaggaaacatttgggtaggtcttggccgtaagcatgcacaattcaaagttttgagactagaatttaaattggaaaaagactcctgatatagccttgtctagcttctttgtgctgtagataaataaccgaagatacctgccgcaggctacaagtttagttaactagcagcaaggccatagccatttctgggctctcatttcttggttgtcttgtctttagatgtgtgcaacagcaccgatcttccggaagtcgagatcattagcctgctggaggagcagctgccccattataagttaagagccgacaccatctacggttatgaccacgacgactggctccatacacctctcatttctccagatgccaacattgacctcacaaccgagcaaattgaagagacgttaaaatacttccgtaagtagttgtccatgtgtgttgtgatggcagtatcatgatcaggtcttcttagccatggccccaaataagatcttgtactggctaccctgtgatgtggcttgccacctctggaaaggtagtcaaagaaatgcggctgtaggggttaaccgcacaaaaggtcccaattttaaatgttctgaatagaaattttagaggagtgaggaccaagtaagattttcatttgaaccaactttttatgtatttatttttttgagatggagtctagctctcttgcccaggctggagtgcaatggtgtgatctcggctcactacaacctctgcctcctgggttcaaacgattctcctgcttcagcctcccgagtagctggggctacaggcgcgcaccaccatgcccggctaatttttgtatttttagtagagacagggtttcaccatgttggccaggctgaccaacctgagcactcctgacc

SEQ ID NO: 105406 - DNA, 1353 bp, Homo sapiens
gcctctgctgccagcatccttggaagacatttcctccatctctgcatcatttttcagagccggccagtttctatggcaacggttagattgaaagatgagcggcgagcaggagacgaggcttgagtgagacagccagtggtggtgtgtgtctctgacgtcaccctctaggcgtctggataggacgatcctggctactcccattcagggctgctgtccagtgctgctttattggcagtgctgccagggtctccgttagctctctgcaaattgccttcctttctgctcctcctactccctccttcccccatagaatttttcttttcattgcccactttactgttttggctccagactgtcgttaagaatgtacagcctaattctggtgtgtttcgggatattcttctgtccagtattctggaagggcggggaggcatggcagcgttttacttgacgttgatggtgctgtgaagtccattctttcctctgcaagactactgactatgcagaaatttatcgaagcggattattatgaactagactggtattatgaagaatgctcggatggtaattatggcccctgcaaaacagagccgggatgtataggggtattgtctccttctgggtggggggtgtcctgaaacctttaggggagacaggcggctggcgggtgggaggtaccagaactagcaccactggctctggcaattccaaaggcatggtggaggaggtggcaggtgggcagggctctttaccgtgaaagactcctgcagtatgtatgattgtttgcttagaaggggagatggtttttggtgtgctgggcttgtaagtgttatacttctattggattgaattttctctggtgtgagacgtgagtgtgttgttgatgcatgaatgtgtgcaagtggaaatgtgttcactgcgctcttgctgttggaggggataggaaactgggggcttggaatagtgtgttcaggaggtggcttcctggactgtcagcagcaggcctggaagactctgcccttttctgagcccagacctgggaaccatcagaggctggagaaaaggcagaagcagcttaccacttagcgggtgattcaaatgaagtttgcttgttggatccaacagagatgggggtggggaggtgatgggaggggcagggaaagaatgtgtccttctgtcactaccttggtttgtgcagggagggtgtggcacattccaagggagactgggtggaggccaagttgtgtggctggacaggtctcaggaggtttcaagcacacagaaaacagcactgaggtgcgttctcagagacatcacagtgggcggggtctcaggttcctggggtgttggaca

SEQ ID NO: 105407 - DNA, 1034 bp, Homo sapiens
atactaataaaaggtgagtcaaatgttttaaaaaagatgcagaatcatcatttatgtcagagctactgactcacacttaaattgcagtgttagcactgaaaaagaaatgtatatggatgggaatatagattgcaggccaattaggacccctcttttgaagttggaattaagggatagctactgttctcttctatctttgagggttaggagaactttattcagtgttgaataactgtattcctcctgtttattaatgtttgttgtgggggtcttctattcagcacccatctctgcctgtcctgctcccccgcccccagaggaggatataataagaggcatgggacaggggcttataataataagacatgggaggggttgattacccagtgtcttcaagtaacttttacgagagatttgaaatagccagcgatcaatgcaaaatagcaatggccttggcagaatttgcacatacatactcaatgtttacagtttaaactctggtgtcagacagggtcatagttaccccgattggatgcatcccatctctggtgcagaacctctaaaacttgggaaatcattgaaagtcatctgcttattaaaaaagcagattctcagactcacatcagactaggagaagtcctgagaaatctaaatttttagcacatgctttgggggattctttacatcacgtgtgtttgggaaactgtgctgattgatgtccatggaaagcagcctcaggcatggggaggggctggaaaagaattatttaggtcagtttcgggatcttagattgtttcttggctacactggccactttttaaagtgtgcttagaaagagtatgacacctttttaattttcaaaaggacttgggttcagtgtatgtccttatgttaaagaaacagccctctttgtagttactctagaaataggtagaatggcagaaagagcgctggctgtctgtgtttgaggcctgttttgtacttcatgtggccatgtggtatgggaacatcctgggatttctgtgagcctctgt

SEQ ID NO: 105408 - DNA, 1046 bp, Homo sapiens
gagaacagcatttccagctcctcaggaagtcccttggtccctttctagtttacatctaccttcccagaaacaattattatgacttctgtcaccttagatttgttttgccacttcccgatctttgtaatggaatcaaacagggtgtattcctttgtgtctggcttttgttgcttaactgaggtctttgaaattcatccttgttgttgctaatatcactaatttttttttgtgcatggcattccagcattctgttttaagagattcagttgttatcttgtgactggttgggttttgataagttaatggacaagagaccagtcttattaaatgaagcatgtttttgttctggcagtgtttatttttaaaaaaattattaatcacttatctgaaataaagattttttaaatcttagaaatatttcaaaatgaatagcccaaggctgacattgaaatctgggagcccactgccggctctcttaaagagatgctcctttgcagggaaaagggaggatgttaggtaaagataggcccagatgctggtatgagctttctagttggccttccagggctttcacccacagcccagagaaaggagctttgggggctgatcaggatgtttaaacaatgactaatgttctttaggtcccttgagtaaaaacaatcagaatatgtttcaaacttctgctttaggatggtctattttcctgtcttgggataacttttttcttttttcttttttttgggacggggtctcactctgttgcccaggctgcggtgcagcagtgttatcctggctcacggcagccttgaccttctgggctcaagcgatcctcccacctcagcctccctagtagtgagtagcagggcccacaggcacacaccaacttgcccagctaatttttaaaattttttggtagagacaggatctcactaagttgcccaggctggaacttttgttttcaacattatttataatcagccatatactgaaagtatttttcttttgaagttactgttctaaaaatatggttaacacttcccctccag

SEQ ID NO: 105409 - DNA, 1014 bp, Homo sapiens
tgccagtggtttcttgggggcaccgcatcttgcctctgactttccatctcatgcccatcttgaaaggggacatcactcttgtccttgttgtcccagtgagaagccctgatcagtgctttttgatttacctcccactcagttttagttcttaaatctcaggataagagcccactccttgccacctacaatttccttgcattaatccaacagcctcaatgcttgtcaatctaaattgccttgcaccccctcccccattgctgcacactggagccaaaatgcttctgaaatataaaccttattgcataaccccccttcaaaaactctctagtggttttccatttaattccacccttcttaaagctacttgtcaggcttcgaaccccctgagccccatcctccaggctgccctgttttctgtgtgccccaggagggcaggtgtcctgccttgttcagtgcagagcttggtgcgtggtaatggttgtttggtgttagtcagaggtgaggcgtgtgtattttactatggtgggtaggcagcaagttgcatttaacttctttttctaggagatggaccataattttcttatattaaattatcatagagactgagcacggtgggtcatgcctgtaatgccagcactttgggaggccgaggcaggtggatcacctgaggtcaggagttcgagaccagcctggccaacctggtgaaaccccatctctactaaaaatacactaattagctgggcatagtggcaggcacctgtaatcccagctacttgggaggctgaggtgggagaatcgcttgaaccagggaggccgaggttgcagtgagccaagattgcgccatggtactccagcctgggcgacagagcgagactctgtctctaacaaaagaaaaaaaaattatcgtagaggtttatggtggctcctttattttgcttttctttcttttttgaaacatcttttgggtggaagtggatttatttggtagcactccttgggtcagaaatggaactt

SEQ ID NO: 105410 - DNA, 1048 bp, Homo sapiens
ctgtctcccaattcctgttggtttctggccgtttgtgtgctggaagccttccgcatccttcaggtgctctggcagtcccttgccatgcctgagccatcttcattattatgctgtgtgcttgatttgtttgcattgaaatgtgcgtacaaaatgcggctaaaggccgggcgcagtggctcacgcctgtaatcccagcactttgggaggctgaggtgggcagattacttgaggtcaggagtccgatactagcctggcctacatggtgaaacgccatttctaccaaaaatacaaaaattagctgggcgaggtggcgtgtgcctgtagtcccagctacttgggaggctgaggcaggagaatcactagaacctaggtagcggaggttgcagtgagctgagatcatgccactgcactccagcctgggcgacagatcgagactccatatcaaaaaccaacaaaaaatgtggcgaaggcatgcaaaatatcagcgcttgttggaacttggcagcctggatgcatgaaggcaatgcagaccaggtagtcaggtagtgagctgaggagcactgatgaagcaactgctgagtgttcagtctgagaactagttctagtagagacattaggtagacttgagttagatttttggagactatacttccaaagagaagtgaacattggtattgcagttttaaccaaatccacctgaaaccacttggactaggtgctaattttcagtcagcctctggagactttaattctgtgcagtctccctcacacagttctttgaatcctttcctctaggtacctaataagcacagctgttgagtctgagaaatgacaaagggccatgaaataaggtacctttttttttttttttttcaattttgtgttttgagatggggtctcctgtgttgcccaggctggtcttgaactcctgtgctcaggagatcctcctgccttggccttccaaagtgctgggattacaggcatgagccactgcacccggccaagggaacttcttggtagacactgaccagtgtggataaatgtgcag

SEQ ID NO: 105411 - DNA, 1059 bp, Homo sapiens
ctgcctccctgtgtcagctcttggcttcattgtcagagcattttagaatttctatatttattcattcattcacttaacaaatagctactgtttccctgtgccgggccctggcaatacaatagcccagccctcaggtggagagacaggttatcaagtgactgcacaaatatcaaaagcagttgcaaataattgtttttagaagcatttttttctttcctgtaggaacaaagatttgttttcattacattgtcaggcttccctttccttgtgtgatgtctgtgtagctctcacacactatgtgggcagaggttatgcctgttttaacaggcatcaaatgctaacacagatggtgaattattaattcctttgttatttctagatgcttatgttttcctcatttgacactgagcaccattgactccttcaggaaacacaggtcttttgaatctctgttctccctctttccttttgtagaaagagcgggatttagaattggccgctcgcatcggccagtcgttgttgaagaagaacaagaccctaaccgagaggaacgagctgctggaggagcaggtggaacacatcagggaggaggtaagacattggaggccgaggcttccagaggggcccgccacaggcctgggagctggaggcatggctgaaggagatgagagaatggagtcctagttggaaggacgctcccgagggcacgaccgcggcctgagcccagaactgtctcttctgaaacgttcacctggggactaaaagccaccttcctgcagctcctgctgctgcttgtgtctcttttctttcctcaggccatgtggatgggatggctaagggcgggcatggtcctcactcagtcgtacatctgtgtgccatgttgggccagccacagtccttgtcctcagagagtctagactctaacgatgcaggctgatcaagatgctccatgcttggcagaagggcacccaggctaacaccacaacgagcaggggttcctgagtcaggctgggcgtgggcagctggagaaggagccctgttaggaggccagctcgtgta

SEQ ID NO: 105412 - DNA, 1093 bp, Homo sapiens
tgactctgaatatgggttgaaaactccaaggaaattgcactgtgcagtcagtagttcctttttagaactgggtgcagcaggggattcctgtttagtcacatgggttctcttgtgtggaatgtgaggatgtggctagatgcactcatgttttgtttgtcactttctatctgaccactggagccttcctgatttgttctggggagacagccttggttggtgggcttgggaccctacactgagctcaggagtgctatctaatggggtgagattctttttcataactgattgagccctgaagaagctgctttgcttctccatgtgggaaaatggtcattatgagttccttcctgcaccctccccactctaccctgtcttttagtaaggatggtttttcttgtgcaaaccacaaagaaaccattctctctgggtctgcatgtgtggttttctgacttcctctcctgattgttgcttctttgtcaaaggggatgccaatgtccagattgctagtatctcagaggaactggccaagaagacggaagatgctgcccgccagcaagaggagatcacacacctgctatcgcaaatagttgatttgcagaaaaaggcaaaagctgtaaggcttctctgtttatctggctgatacaacaatggccatgctgagacggggaagggacatttactccagaagacagtgctctttagtttcatatcttagcagttcgtgttgccgctttgcagaaaaagcttagtggactcagtagtataaaactgattacctgaattggtgacgagtcttatttgtgacctcttatctcctaaaattatattgaattcattaaaaagatgttgtaaatatggacttttgcagtttaacttatggatcatctagtctagtatttgtttttacacagtgcactagatatgtgctgcagtagagcagtatcctcttcagatttaagaagaggcagcaaaatggactttgctattagtgtggggtaaaatgcttccagagagctttggaagatgggggtggggcggtgggctatagagaatgaatgtggatataggaaagactttaccttcaaaataatat

SEQ ID NO: 105413 - DNA, 1011 bp, Homo sapiens
ctgtctccatcattctgaacacatcacccctccctcataagttctgcatcccatctcgtagccatggttacagctccatggtttggccaacggagcatagggtttgcttttagacacctaatggcatatgagtcagcagctttacactcagtgcccagtggcactgccacactcagaacctgcctgggaaactgctcagccagggtctctgacaacagagagtgctgttaagtttgtgttgtgggaagaccgtgagcttctgatgccttggtttactctccatggcccacctgggtgcatacctcttttagagacagagcatttgaattggcgctcacttgacatttgtctttctggcttttcccaggattccttggcagcagagattgagggaacgatgcgcaaggagctgcagttggaagaggccgagtctccagacatcacgtacggccacagtttttacagttttgagattcccagagaccaacttggaccagtgcagtgttcaaaacctagcaatgttgaggctctgggtaccgacagtgattgactattgtccttcccagtccagattaagggaaataatagaacacagctgacagcatccctcagctcctcttattatcttttgttagtgttaatttttatttatttattttttagagatggggtgtctcactttattgggcacgccagagtgcagtggtgtgatcatagctcactgcagcctcgaactcctaggctcaagtaatactgctgcctcagcctcttgagtagctaggactacaggcgcatgccaccatttccagctaatttaaaaaaatcttttgtagacatagggcttcaccatgttgctcaggctgatctcaaactcctggcttcaagtgatcgtcctgccttggccttcccaaagtgttgggattacaggcgtgagccaccactggcctgtgagccactgtgctcctcttcttcttaggttttaaagacaaattgtgaacttccagaaagtcc

SEQ ID NO: 105414 - DNA, 2876 bp, Homo sapiens
tgatttctgctgcgctgagcagtaaacactgccctgctgcagcgtttattctagtgaatattatgaaaaaagaaatctaggagacaaaagtcatacttaagtatttttatttgtgggttaagctttagggatgtgaaacacaatttcactcttgctggcatcacctttaggatacaaccatgcgttcgagtcctgggtttagtgggtgttgaatctctcaaatttcgcattgtgaaggaggcagccaataccctaagaaacaggtggcaggcacaggatagcaggctgctgggggactcgtcataggccaggtgcccttttggctcagttgatcatttttggagggttaaactccagggttgtgcccgcatttgctcactcacggatgccgtgcattctccctagtcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctggggtgagcaagctgggagttttcacttctctgttttggggtgaggagtggtagtatggattgtctgcaggctcagtaattattaagagggaggtagatgagagtcacctgaaaaatacagacctggccgggcgtggtggctcgcgcctataatcctagcactttcggagaccgaggcgggaggattgcctgagctcaggagtttgagaccagcctgggcaacattgcaaaatcccatgtctactaaacatacaaaaaattagctgggcatggtggcatgcacctgtaatctcagctactcaggaggctgaggcaggagaatcgcttgaacccgggaggtggaggttgcagcaagctgataattgcaccactgcactcctgtctgggtgacagagtgagactctgtctcaaaaaaaaaaagcggaccttacagttctccaaatctgttctgcttacccacttgagcctatgcctatccttgatatgatattttaatcagcttaaagatgtataacaagatgataccagaaagtctgctttcctgtgaaatgcttgggggaaggattaatgaatatttttttttttgttaatcttcacggtaaggctacagaatagacatttgttttgtgaccgttttgtagcttgatgttggaaaggctgaggaggactcaggctgtctgtcttgtgaccagaatgtggtcacaaggttcagagggtggggtgcaggggggccaaggtgcccaggactgggctttcctcaggaatggtcagttcctctttgtcctgaagccctgcagaacctggacggacggacggacggacggacagacggacacacacacacacacacacacacacacacacacacacacacacacaccattgtctactttgtgcatccttttcctctgacttaataaaattgattcttccggaccagttggaacagacagacaggaagctccttgatcagagcaggttttgttcagagttggggtctgggctcttttccttcaagagaagagagaaacatgccttaaccccattatccttctggtagccaggaacagcaacctacaggtttcttcctaaaggttcttcagggagatgtttacagggactgaatttacttagtctgtgtgcagatattcatcccaccttagtcctcaccccacctcaaccccactaaaaaagacccctggcgggagtggttctggacacgaatttatttccccctgttgcctaaatgtcaactgcttgccttggttcccatggagaatcctgtagccccagggaacgtccaccgctgtgcattgagcagtcgggcctctgtggccttggagccctgctggcattccaccctcacacccctttcttcttccagaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggtgatcacgcggggcctcggcccctctctgtcctcctgggggactccctttggtccctgatccacctgcggaaggcggggcacctctgtcacgcctactcctttttcttccgcgacagccacccgcgctgctggtttgagttcctctgagggtggtgctcagcctaggcctccgtccctcccctctggctggcaggtgtgacaatgcacacataggccatgaaactcgccgaggaaagacaagcatgtgcactgtggtcttctagttctttcctttgcctttagaaccttagaaataaaaacttttgtggcggtagaggcactgctaactgattcaaaaattaattaggttttgcctgtgggtgtgaggaatgcagaaaattaatgctttagcttttctgcagttttggtgtcggggagaggttccaagcaaactctattaaatggggatttttttttccccataaccacctgaatgtgatttgtgggcttatgtgttctgatttgaacttcatatagcaaggttgtggcttttgg

SEQ ID NO: 105415 - DNA, 1053 bp, Homo sapiens
ttatttctttttttcttgaatttagaatattttctatttatatttaatagatccaaattaagtatgttgctattgtacccgtgaacccttaaaactgggataagccttgatgtgggtgtctgggaactctttaaacatgtattggcagtgtgcaccttttttttccttttgagtggatttgaaattgttcatttataaatccctttcaagcctccctggctgagatcgacacatgagaagttatttccaaggggtgtttggaaatggcagactctgcgcacaccatgcggcctctccctcaccccaccgcctcccacctcggcctgcctgtgttcccttctcttttgtcttgacttcctgagctgccgactcctggcatctttgactcccttttcttcgctccccagggcaacctggtatcctggagggcttcttgcctacccagaaagtatacccttggtaaaccagtggtgactgcccgagcatccatttgtgcaggaagcctcctgcctttcggtgcccgagaacctcttcagaagtctctcctttgagcatggaatatttatttgtgtggccatgcatatttgggtgccttcttaatctgtagaatggggctagccctgccagcctcacgggccatgcactagcatggtgtcatgtgaggtgttaataagtgttccaagggtaaaatgggttgctctgtcaagtaagttggcaagaacaccgtagcatactaaaggttctgtgatgcccctcagtaaaaacacttaactcaagtttcctgagcatgcttggcctaggaacacttctctttgtagaacacttgtgacaccttgaggtcttcagggacacactccagtgttattacagaccttgcatgatgtcatgtgagtcctggggtttggtgtcatcgagaagatgggctcccctgctttagacctctgtgtggacttactatgttcttaaatcacacctctttaacccaattccttctccctaacccggcagcctctcaaagttgctggcaaaatacagaaaacctaagtaaaggag

SEQ ID NO: 105416 - DNA, 1670 bp, Homo sapiens
tgtctcaggcagcagaagttacccgagccggcctcaggcttccccagaggagatgcaggagccgccagcggccacggaggaggaggaggaggaggaggaggaggaggggtctggtgagggcaccacgataagtcctgtaaacttggcacctttcccggaggcagagttttgggccattctcacctctgttccaggcaccatccgtagtggttctctgtctgtagcttccgctcgtctgtgtgggtgatgattaaagcattctcattgcacagttctgtttttaaatacagagtctgatgcctcctatttgtaacaatgggtgtagctcccctgcccatcttggaggtgcatggcccatcagggatctttaaagtgggagcaggaaaggctgctaaaaaaaaaaaaaaaaaaaaaagtgggcttttgggtccctgaaaacatcagtgcccttcttcctggtctgggtgtctccctgagtctaaggggaagattctcaagtcccctggtgatttccaagtggagctgagcagttttagggaaattgagtgctgggtcattcagaaggtaaatgagatcatctgttacctgtacgctgtattaaaatagaaccaggaaaggctcaggatttcagacatttcatcagccttttcactttcccagcttcaatggaggtatatatgtcattttcttttcagcttacacatgtgttcaaagtggatttttaaaaagtgttttagcaatactccttaaccaaataaaccttcggagaacgtcactaagcttttccagagagaagaccctagatgaagttggaaaagagctctggctgactccacccactgtccccaagcattaaaggtgtggccatgagtttacagaattacccacattccagttgccactgggatgaaaagctttgtgctcagagctctgggaatcatgggatcacatggttactgtttaccccaacagcatgctctgtctagactggacctcccagccccttgtgttgggaaggcaaagcttttgtggagtcaggggggagactgagaaaaaatgaattaaccctgtgttgtcatcctcatgacattcctgaggattcaccaggttagaagtgaggacgtttatctttgtgattcataattttcatttgtgaaggccacaacactccccttgaaatacagggcaggaaagagctgaggttcttggtggtgtctcccattcccctggctaatttcagacagctgtggtcaagggattttacttgggatcaacttttccttttttccttgacattaattttagagaagtcatcaagtcatgtgatttgtttagcacataggtttatttatggtttgattttttttaggcagttatattactagattaagcttgtgagggaatgaaaatgttttttatttgttatctacacactcgaaaaagagaaaccagctgcggtactgtcccatttttgtcatcagcaccagtgtccgtcaggaaggcaggtggtggtgcagaaacatgatgcctggctgattttcgtggctaaaggggtaggccttatgttgattgggatgctcccctacagccttacaggtagaatagaaggtgagttctggaagtgcaaagaagcaccattaagtgcatcttctagaagttgtacagaagga

SEQ ID NO: 105417 - DNA, 1096 bp, Homo sapiens
gttggctcacacccacctgtattaggagatgctaaggaaagccctgtgctctgccgtcagaatatatattaagccagagtaaaacaggccaactgccacctgcaagtggaaaaatgaatgaagaatgaaagaattgactccttcaaaacaaacagcatagagtcaaccctgcttaaaatatccagaacaaagcccacttgttgagcattttctctctggtatcctcacctctgaacactacagagggccccctggtgctcctagaggcacgtgggttgctgaggaggtgtctgaacctgacacccttctaatgtggagggcccttgagggagcaccctgtgttgagaggaggagctgtgcaaccacactgcctagtgaagcacaggtgaagtgctctcttgtgctggccttgaacgcactagtggggaaaggtcttgatgcagctcagccaggccagctcccttcacctgttggtgtctgccacagaaggaaggacaagaggacagagggtatagggaccagctttgttggtgtctgaagactacaaagggatttctgcatttgccctttggacgttttaatagcattctaaaaatccccctctctctagaagataccccaggggcacttgagagaatttctgaccctctctgcacaatgctgtgaaattgtttatctcttaaatcacatacttttcagatgaaacagggtaggcaacttggtgtagtgggaagaagagtcgacttttaattttgcagaaaccaaaaataagttgtgcagaaaccagaaaaagatcttgtgatgtgtggttcgaaatctctgtgatagaaacctcccaggttcctgctggccagatgtctgatcaccgaggagctcagggacctctacggagctgcaggggcagtcgagagctctgttgaagaaatgcttaagcagagaaaaaaataaataccaagcctctgtgaagcccagaactaaggcctttaaaagtgttatcttgtacaacatattacagtttaaaatcacttttgtattttttaaaacaagaaagttgcactgttgcatctgaaactgctcttgattccccgactcctca

SEQ ID NO: 105418 - DNA, 1074 bp, Homo sapiens
aacatctgcacgacagctacgggcagttcatcaacacaggagatcttgaataataatcaaggattaattaagtttaaagcgtatcacattttgtaccagtgtcagaatctgggggaggaagaacaattaaaaaagaattaggggtttttattggtaaatccaaattcattcctaaatcaaatgatgaaaatatttgtcgttgttaatactctaacccatttaatatgtgcctgtctcttcaaaacactaggaagccctccactcaggttgagagaaagaataagaatttaaatagggaattaaagccttaaatccaagaaactctatcctttgagctcccaaatgagcagcatgggatgaacacataataccatcttctgcaaagaactttctgtttagataaagaagggggctttggtgcgtggcatgggcttggtgacttcacagtgagccctcacccaacccccctatttcctgccaagaaggatgttttatgtttctctctctctctcttttttttttttttttttttagaacttgctctcttcctgcacccagggctttaggaatcagcccgttgcttctctgtagcaagcatgaggagcctctgatgatcccagtcttgggtgactcactgtctctctgttgtgtctcaaggaagggaggtgcagcagcatcctggcagtcagtggtgacatgcggagagcccacgggtccaggcgtcctggtggtattttggaagggccaaatctctggctttagcactttggaaacttgttgatcttccttggtcttctacggctattcattgcttctggggaatggtgacttgtgaatttttagcagccttttcctatccccaaaacccatttgtataagatgggtttgcttctgctgatgcaactacgtctctaaaatgtccatcttacactccctattgcaattgaagatccaatatgtaagagggtggaggaggaagtgaacatttgtgaccttttgatttgatattctggccatatgtttaaatgggggtatgcttctgattttaaatccagccttcccttgtttgatttc

SEQ ID NO: 105419 - DNA, 1043 bp, Homo sapiens
aacaacttgttgccatcccattttcattagaaatcagacatcttagagatgtcaagaaagcagctagcagctagggggtatggggacctgtcctgctcacactgctgtgtgtcagaccagacctgatcctggagctcaggaccctagagagccctgatctctggaactcttgccacgttgttgctgaggcagctgaagtccccatctcccaccataacaatcacaaatagacagtagtggagccagcatccccaggcccctttttgtgtaagcagaaagggagctgtgagccttgccctgtttgcaggtttcaagtgcctctccctgcctgtacttctccccttcctctgagcagagctttggtagctgttgccaatgcaaagaaatgtaaagcagcaaaagaagacagcaggttctgacctgaggagggaaaccaaatttatcccacaaaggcccattaccccacccccctcgcctcccacccccagactggatccactactggcccaagaatactgatgagaaacctagtctggattgggtcggaagctggaatttggtgctctgcagaccagtgctcaaaattgtggttatttttgaggactcgccttcaatccagaacatttgcgtttcaccttcctcgcccagatccagttaacaaggtagctcatcacttcttgcatctgttgagtgacatgctggattttaatttttattgtggttgtacttggatgcaaggaatatgttttgttcctcccaatttagcgcaccatcctgggaagtgcatgtctcagaccaactccaccttcaccttcaccacctgtcgcatcctgcatccttcagatgagctcactcgggtcacaccaaggtaagggaccctggctttggggtgggcaggggtggggtgaagtcagggcactcccttccctgcaaggcttaatgttgaggaaagccaagtagagaggctcatagaaaaaccaactgaagccagtgtaagcatctcagcatttgcaggcacttgttctgggtcccatccttccttt

SEQ ID NO: 105420 - DNA, 1077 bp, Homo sapiens
atgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccatgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagtttcagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaata

SEQ ID NO: 105421 - DNA, 1015 bp, Homo sapiens
gaagatgtccctcacttttcagggctgtgtactattccactgtgtgcatacacctgctgtgaattatacatacctttatgaaccatcccttacagatggtcactgggataattctttttttttttttttttgtggagacaggatctcactccattgcccaggctgcagtacagtggcacgaacatggcttactgcagccttgacctcctgggctcaagtaatcctcctgcctcagcctcccaagtagctgggatcacaggtgtgtgccaccatgcacagctaatttttattttgtattctttgtagaggtgggggtctcaccgtgttgctcatgctcttcttgaagtcctgggctcaagcaatcctcctgcctcagcctcccaaagcaccgagattacaggtgtgagccactgtgcctggtgtcactgggttaattctaatcttttgctatcacggtactgtaatgaaaaaaccttacatatatgcaattgtccacatatgtgagtacatctgtgaaataaattcctggatggttattgccaaattgccttccatagagttaagagacaaccaaggacagtggaggtccaccagatggagaattgtgagaagaacaaaagaaaaaaataaatattctgccacctcaatatttgaaagcagtgagattatgcaaataaacactgtggtaggatgtggcatcatggattttaagtcaggtgctaaccatttggcagtggtgtgaccttgggcaagccacttaccctctttaggtcctccattttttttttttttaaacctgtgacatgaaaacagtaatgcaccttagagttaattagttgagtcaatgtattttgagcacctaccatgtgccaggcatttaagtactggggacgaataagtgagccagtttctgctgtcacggagtgtacaatctagagagaacaacaccaagtgtagaataacaagggctgtgcagagaattaaaacagggtggtgtgaaggagtgggtggctgc

SEQ ID NO: 105422 - DNA, 1050 bp, Homo sapiens
tccatccctcactaaggaccaaggaactgtagtcaggcctccttcctgcctccctgtcaggacagccccgtgcaacctccgcagggctgtgcctcccctctcagactggaggctccttgaggtgggagcctggcagagggaggaagagagtgggtgcctatggcctcaggccccagggctggaggcacctgcactgtgctcacccatgtgtcttctgccttacccccataggctgcagcaagatgtgggacaacctcacctgctggccagccacccctcggggccaggtagttgtcttggcctgtcccctcatcttcaagctcttctcctccattcaaggtaagacccctgggttgaagaggtgatgtgagtggggccggctggagtggggactcacctctcaaggaagtggaaaggcaaaggaaagtggtcaaagaggctggagcaatccgagggactccctggcagaggaggcaatggtgctgggtctttaaagaactcacaggatttgattagctcttcacataaagataagcatgtgggaaaggctcactaaatatttgctcaacaattgataactgattgactgacaggtacttgattaaattatgactcccatagtcctgttgtcttgggctggtcttgattcagtctttcgatgcctggagcctatgacctcttgggctccatgaagccaccacatgactttgcttacacaccttgtcatgttccacttaaatgaatgtccacagaatgaggcagaaaagaaaagggggagcccctttaggaggtggctttctagctagtgagtcattaaagagattcacaatatagattcagtcattcttttgtgcagtgaatgaagcacttaccagtgtgccaggcactgagctggacaaacacagtggagagaggataaaacagcccccggggctgctctcccagagctagcattctcattggagagacatttagtaaggaaataaacagatgtatcatcaataataaaaagtgctggacgagagaataaggagagtggggactaactta

SEQ ID NO: 105423 - DNA, 1026 bp, Homo sapiens
tgctggtggagggcctctacctgtacaccctgcttgccgtctccttcttctctgagcggaagtacttctgggggtacatactcatcggctggggtatggtaccagggagggcttccaggctggggacagagggggcaaggcctggagaactccctagggggagggtgccaacccagcttgcagtcctacgtcttgcttagctgcaggtcctgcctgcaaggatatcagccaagggtcaagaaagtcctcaaaatgtctgatcccaggacaagtccctcaggttgcagctgcacctagggctgacctgtgggacagattttgtgaacatctttccatttccctttagttcccgaaatacacagggccactgctaatctataaagggcctctgtcacaattagaaagagaatgtccgtctaggtagacacagcccttcaggcatacagcttcaccccctcagtggagcatccctccgtggtgaacaacctatgcaaccaaagacagcagactgacaacccacccttttctctctccctccctctccctgcttttctccaaaatctctccctcatgccctctacccctgcttcctgtgccctctctgctctttcactctccctgggcctgacaggggtacccagcacattcaccatggtgtggaccatcgccaggatccattttgaggattatgggtgagctgctgccccacacactcccccggccgccatcacttgggcaggccccctgggtgggatgataatgccatctggccttggtgagtggacaaaaaccacagctctcgggccagaggggaggctggaggaggacctggggagcaacagactctgggcccggggttgctaaagtgctcaggagcagagctggggacaactgggggaggtgctgctgagtctctctctggctgaggacaatccctctcattcctccccacggtctgctcaggtgctgggacaccatcaactcctcactgtggtggatcataaagggccccatcctcacctccat

SEQ ID NO: 105424 - DNA, 1017 bp, Homo sapiens
acggtggcttgtgcctgtagccccagctactcaggaggctgaggcaggagaatctcttgaacccgggaggtggaggttgcagtgagccgagatcgagccactgcactccagcctggtgacaaagcaagactccgtctcaaaaaaaaaaaaaaaaaaagtcggtaagaacggcttaaaaatggactgttttcttttcctatgtggcattgggttgccatgtagacctgtaccccaggtgctttgggcatctgagcctatgatccatattcagcaggcagtaaagaaacggtccttgaagatgagtccttcctggtaatgcttcctgaccaccgaggcactaccagagatgttatccacaccaggtcgaatgtgtggatatcagttaacatctacatggggtgagattgacttttgcaaacaaaagggaaaagatgcactagaaaaacagtacaagtaatgaccacaaaaacattgtttgactgaaatccagctagctaaaagaatcctcagctcactgaaggaagagactgaaaataggaaagaagttctggtgatttcatccgagggaaatccccaggcttaggtttgacttggttcagggttggaggtttatagcctcttgtgtgatccttgataccagcaaactggttccaaatcccaggagttatcctcactccaccatggactcactgttgttgtagcacttttgttttcccagtagttaaatgctacctgtgcagctgacatcactggactagatctgggaatagatgaaataatgttgaaaacaaaactttagaggtgccttctggtatcagatgctgcaaggccttgagcatcagagtgtgttaagtcccatctactgtatcaaggccagagtgtggctccatgctcttaggaagggtttcccaaccacggggccagagcccaaaaggtttccccttccctaatatgctaatgaacgaaacatgtaaatctgttttcccctgttaggctagtcttactgtgatgagaagt

SEQ ID NO: 105425 - DNA, 1100 bp, Homo sapiens
gagaatgaccagctgatccgctgtattgtggagtatcagaacaagggccgcgggaacgagtgcgtgcagtaagtacccccacccccgcgcccctgacctgtgggtagaggggaagcctgtgtgatgcggtgctttctcgaactaagagtcttgggtgattgatcgcagttaagcccctctttgaactgaggaaagagaggctcaaagagtttgccaacctgcccaagaccatacaacgagtacactgcggagcctggagtcagacgtggctctttcttcaaaatgtgaattattctcactgcaaagcctccttcactcaaagctatgccggctgatgacaacagggatgggggtgagagcacacagaaaactaagctcaggagattagagccatggcccctttctcatcttggatccctgcctcatcctttctctgttaagtgaaggggtcaggccatttgactgctaagcttcctctcatttctaacttcccgtcagtctgttagtgacacacacacaaagacaaacaaaggatttacaagttaagtcaaaggtaaattgtgcataataatttaatgcactccctaagtagataccaaaatgagagaaaatagagtctgagtctcttttccgaatctagtccaggtattacgcccatttttttcttttctttttttttttctttttgagacagtctccctctgtcacccaggctggagtgcagtggtgcaatctcggctcactgcaacctccacctctgaggttcaagcaattctcgtgcctcagcctctgagtagctgggactacaggcgtgtgccaccacgccctgctaatttttatatttgtagtagagacagggtttcaccatgttggccagactggtctcaaactcctgacctcagatgatccacccacctcgacctcccaaagtgttggaattacaggcatgagccaccacggccgaccttatgcccatttcttatagaaaaatatattatttcattgttactgaagaaatgtttcacaatccctaccccctagaaaaattacctacagtccctcactgaataccttaatagaatagtagagatatcagtttt

SEQ ID NO: 105426 - DNA, 2062 bp, Homo sapiens
tttttttagaggcagaatttcaccctgttggccaagctgatttcaaactcctgacctcaagtgatctgcctcggcctcccaaaatgttgggattacaggcgtgtgccattgcgcctgacctcattctttgactagagtgataagtgtgtctagtattatgtcctatagcatgtagagtctgtaccacacaattttacatttacatgctgctttggattatttattttggtttgcgtgcatgtgtgtatgttaaattatcatgtcatctatttcttatatctcttccagtgcctagcacacaggaaagatttgacacaggattaattggtttgttctttccatggaaggatgtataaataattaaacttcatttcttttttttttttttttttccaggagagaaaggccttgggaaaacaactgggaagaagttatgttataaaggttctacgttccatcgtgtggttaaaaactttatgattcagggtggggacttcagtgaaggtagagctaaaagttgtgttcctaataactccatctatcagtttttaaagtatttcattattacttttagttctaaatattgtgtcagttacagtatgatataaaatgtggtcagtgaatacttgttggatgagtgaatattataggtccagaatgtatgaaaaagcaaagtaccacgtaagacattttattttgtttttatgcagtttattttattaatattatagttacttagtgaattcctttacaatgaatgccaaagtactgtctgattgcttttgttctggaatgtttttggtgttattactgtttgaaataagtaggttgtgaagatgacttttttgatggtatttcttgtaatgggacttgacatatattttacagatgaagttaattgaggactctgagaattttgattattgcagcagttataacattccaaggtttccttcagcgaattgaagctatcaaaaatgatttctgtgttagtatatttttaatgttcattatggcttaaagtaggtgattatttgcaggtaatggaaaaggtggagaatcaatttatggtggatattttaaaggtaaggcttaatattttacggtcttttgtttcagttctgatattaaagcaagtttgatcatatacttttaatgagaagaggtttacttatagttcactttttgcatgaaactaatgctgcatgaaaatactttatttgcatgaatttggggataaattatattgtaatatataatttttaattgacaagattaattaaggctaactttatggttaaacatgactttcagcatggaggttaggcaactatatacatgaaaactcctatcttcctgcctaaaactgtcaacatattcttttgtttatagagaatgtggtcttttgcaaaatgaaaaggtaagagaacgaagctcagtaacacaaactccaattctgttcccttgcacccttcctaataaatttatggacagtctgggtcaggttgtggctggatttctatattgcttgaagacttggaaaattctgtgtattatttcatacatgcttctgtatcttttttcatttcccaatgggttattaatttcacatcagagaaaagagtctagttgtggggttttttttcccctaaaccaagcaatttctttgaataaaagttgaaatttcgtttttcaaaggtttgtatgttttcttttgtatattagaactatgactgtgtttattctcataatagtagcatctgcataaatctaactattgcacttgccccaaaaagccttagaaaagtcagttgcagagatttgtaatgaaatctaatattactaggttttaacgctataatagcttcagtgttataatagtcttttatatttcctttgggggaaaatggattactactctttttcagaagcctgttcccaaggtaatcactttttaaagttttctgtgtttctgtttgttctgaagaagatttgtttgtatgaatgttaaaaggacatataagttagttttcaaggatattcctgctggaattaaaataac

SEQ ID NO: 105427 - DNA, 8373 bp, Homo sapiens
tactactaaaagtgactgttctaaggctgtttgtgtgaagtattaaatatatgttcttttcctcaaggctttaattagtatcttttggcctttttatgcttttgttatttgattagcttaaatttttcttttctgagtgttcagtcaagttatctgtactgaccagaagaggaatttcatcttttgctttctatttattacttgaacattactttaaagtgacttataattggagactgacaaatttgtgttttcttcaaacagatgaaaactttattctcaaacatgacagagcgttccttttatcaatggcaaatcgagggaaacataccaatggttcccagtttttcatgtgagtaggcataattcagagatgagcttttcttaaacagagaagcgctgttcataagaaagatggtatagttaaaccaagtttaatgctaaaattctgtcagctttatttttattattaatttctaatatcatagtaacttataaggtctaacaactgcctcagcattcagcatatatcctgaattggaagaatgggacttaaaaaatttaaaacttatacattgttttcaaaatatgccgtcatcttcagaaaagatgacggcatatttaagcccctgtcaaattcgagtgctgactttaccaaaactagattggaacataaactattgatgaacatgtaaaaattgttcatagacgagtattcagttactgtaccccctcaacagggaaagcagtttgagtaaaccattgcatggttgttttttcctcttactgttgctctttgaggcaattttgagagaggtactattattttctgatgttgtatagagataggtgacctgctgttgagcgagcattttaaaaaactcattttatgaggtctccatgcataattgaaataacccaatgttgctgtcatttccaccaaaatttatgagattgtcactcaggaaacttaagaatactaaatttgcttttgaaaaagcaaatatatttacatggatgtgcattgcacaaccaaaaacttacctttttattatctgaaaattctaaataaatcctttggcatacttttagttatattcttatctaaggctgcttcaaaacctatttttatcataattctatcatataaaatgtgaaagataactgtccagcatgagggttattgcttttgattggaagtgaatctcagttgtcctatgtatgttggagaaatatttcattaataatttattgaaaacattttctttgtcatctttctgaatgaatgagtatgaatggcgcttccctgtctttaaaggagtatattactgacatacaaaactcaaatgttaaatttgtctgaaaaatatatttctacatgatctgataaagttcagataaggggcattctgttcctaagaatgtcctaaaaatggaaagctgataaaagattatgcttagaattatacaggtaaaagacctacaacagttgttctcttgttttgatcccataggttatttgttattactcttctttaacagagtgattttctattcttaaccttcttaagagccaatacagagtagaaagaaatattttcagaaagcctttttaatagtaacttaatgtaaaaattgtttatcctttggttgaggtttcccatttccatttttaagcttatctgaactgtgaacatgaaaaacgtaatgattcattggtcaagaagctaccatttgagggctctaaagtttcttttagatttccttttttatatcagtacaattaaaatttgatttatcaagtagcagcagcttcttgatattgttacatacattagcttgttcataaaatgttagagttaaaactcattaaaaatgctatcgttaaacataaactaattaaaattcagtatacgagattctcccttcaaaaacatcttatttttattttatttagtacttgcttcagtgttttctaggaatatctagtaaaggcctttactgttttccacatggcctaattttatattggactacaatttttgagaaggaatgccaaatacaaaattttgaatcaataaattacaattataatttttatacttattttcaaagttaatttactttagatggcagtaaaatcactgaacttctgattgaaagaaaattttttagtttgaaatttccttctggaaaggggtttgcagtccctttggaaaggagtaagcaatcctggaagtaattgagtatttaatcctcctatattttttctgaagatttttgtgtcagtatactttctttatgctggctagaaagatcagttctcaagagttgcaggataaaatcaaattaactttcatgtttcagaactaaaacatatccttgcatttatgggaaggataggtaaaaatggagatggtggctgataaaataaaaatctttgaaactatgtttttacaagcccaaagccttttggagttgaaagtattaaaaaaaagtatgatatgctatcttcaggttatgtatatgatcacagataatagctctgatggtcacagagcttgctgatggcttccaaaggatggctcctgccttttaccttgttaccacagctcctcatagggcactttgagtggcagttctggaatctgaaaaagaaaggatagtgtaagaatggtggtaaaataaaaagaactgtctttatagttcctgctttataggctcaataaggatttttaatacatccttgcaaaattgtttttgtagtttttgttacaaatctgttactttgcaattcctaaggagtagatttggtgctgttagtatgggtatttgcaagacatccctcaaggattcttatgttttgtgcattaactactgtcttcattacttacacatctaaaaactcccccttccttaggcatatgtcatttttattcaacataattttgcatatattgctttctttggctggaacaattatatacatgatgaaaatcagattttcttctataaatctatttgtaatttttacagtaactttatttctagtactgtatttgtcataatgattttgctctcgggggtctatatagaagaaaacttgattctttttggaatagtactgctcaagaaatgtggaagaagtgatatatggcactatacccatgaatcactaaagaaacagtggttttattttgaacatttttgaagaaattcaaagatttgggactaaagttaccaagttaatttggtatttattttgtcctttgtattcttattttttaggttaaagaataggaagaaaccacaataaaagctggaattataaagtcatagagtggaaagggatttagagattatctagtccaaccttttcattctgtagattatgctaaattcttgaaaagtcatgtaaagtccaggttatagaaattttatttacaatctggaagaaactgatagctagaaaaagaatgctgcatacttattcatattattaatgcctttactataaatttaagcttatttaagctcaaaattttattaaccactctgctctgaatttattttagttaaggattagaagcatcaaacattttgctggaaaacaaaatgacatttggggaaacattctttccccttttgctgttactgatagcttattaattctggctgtaatttttttgtctttatatacattaatcaaaaagacaaagatgttgtataaaatagtcatgaaaaagattgagtaaatagtttatagctttgtagtaacttctgggataggacactaatatagctgtcaggaaaccttgattttagtttcctatgtaccttcagttcgtttttcttaaacattggtataaaaatatggatgtaaaaggaagaaggtattttgtagggtagttgtaagttcctgaatgtgtggaatgatttatgtgcaaacattgtcttgcctaatggaaatagtcataattgcctagttttcattagtctgaaaaatgtcttaaagaagtattgggctcatcttaaatcaagagcaacagaagtctcttcatcagctgctgttagaacatgagtctgcgcagccatagagtagggatctgcagaccctgcaagaacagttcctgtcactggccactgtcagtggtcattaataattataacaatgtaagaaaacaagataatatagaagagtcaaactttgaactttaaacaaaacatgtttgctacattttaacagtcataaatagggcaatgggggggcggggcataagttttagaatatgttttatgtcatttaagaatctgacttgcaagtacctgaatgggagagaagtgctgattattacaaagtagtggagcaaggagagttgaggagtagttggttttaaggggtttgtaaagctgtgttgatgttttgggtaataaaactagattcggggtagaaatgctttttctacccacgtattcataaatttatgtaagaagaaatgctagtaagtgttaataacctgagaagctctagctttttccttcctttttttggggtaataccttcatatgttaatttcagattttttcatgagcaaagatgttcgtgaaacttagccataaaccatattctctgaatatcaagtgtcatccctaacattcaggcttaataacttaatgtttatgtgacttacgtgctagcaatgtggaagaaattttttatctagtaatgtttggtgtgtattatcttaacattagtgctgaattttagaaagcacttctattttggtgacttttggaacacatgggtagagcattgtcaagtggcttggttagtttccattacccttatacaagtgttgtcattctgtacaatttggtgcctcttccctgacagtgtgatagtttcaggagttgaagggaaagcattgcatgttaaaagctaaagtggacagaagttatctttatttccctcttctgtactactttacacctacagtcacttattttttttttttgcaacattcattgaaaactccacattatttcaaacattatgttcttttttgacttattcatgttgtcaatgcctttatgataattttaagcttatttttaaatatttcaagatttattacattcaaaactcttataaagcattttgttcatggtataatagtattttgatctgagtagtaatagatttatttgtttaaatatagataaaaattggtcagtgtgtgttctccaaaaaaaaatcttgataatggggaaaatcagagattagacaggaaaagaagatattgtggctaagatttgactgcacttacgctttcatctctcttgcctttttattctctgagaaggtccctaaaattgtagttaatgctgctttattattatgttcagtgacttaacttcaatgtgtatctaatatcactgaacagtaactagggtccgaacatttgctcattaactcctgaaagtagtctgttgtgatacgtcaccaaacaaaggtttcaaatgtagaagcatgaaaggttctttaattatttgatgtgaattagttaaaagttccttgaaattttattttggatgatcttaactcacttttttctaatgaaatttttgctttcaactggtagtaactggtcctgggcattcagatttttatatttatgtatgtatgcaagatacactattctcttttgagaaaatgttgtcttagctaatttctgggatttgtgaaaggaaatgtaatatgttaatagctattattggcactctatgttacaatattaaggatctaaatagattcccacttagccacgatgcttttcttaagcataattcatctctacgtaaatatcccatatgaaagaaaatttagagccctccatttaaaaaagctttcttgctctgcataaaacttgaaaataattaatttcaaagttatattgatattaaaacatagattcagtcttgtcttaaaagtgtattacaatttatttcttgccatttttgtgtaaaatttacagaaagagtgttacaccgtgcgctccaaaggtaatgtctcattactctaaggctctctctctctttgcctttatctctttaattctgttgttatgtgcattgaaacattttaagaaaaaaaaaaactttctgctttatctgtatagcagcagtacatgtaaaacaagtgcattttatttttcatggttaatcctgggaactatattttaacttcagtggcttgtttccaccaagttcctgtacatcttctggtgggggagtggggttattagtttatagtatggttttagttctcatttcagtgtggaattagtcatttctgtataagggcaaaaggttctctgataatggtataaaactatagattgtttttggagtagcagtgacacttgtcaatttctaagatttataaggcttaaataccttgcacacatgttttttaaagtagattcaggggtcgggaaaactgaaaaatcactgtctttaagtacaagagaaaaatggaaatgcataaatattgaaaggttttacaatttgaaatgttctttgtggttttttcttttttaggtatgttttcataagcatatataaatttaaacatttttgatagcctctggccttaacttactgagcatgtgtcaccattgcacagctctttaaacagccgcttttaagatcaatgcaatttttcttttaattgaagattttgaaagattaagagttagtgagatgagctctctgcctcttttagtagaattgaatagtctggattgtggatattatttctctccgcccttttgtaaccctctttggctaatgtcctctgttcatccacgtattagccaagtgccagtaaccctgctttacattgggatttctactcctggaatgtaggttgagaaccccagagggcttctttttgttaaatacttttagtattcttaatatgtaatctaatccaattaaagtgcagacttatatttctgtatcttgagttgcagatgcaagtaatggactttaatcattcatatcaggtttaggcactatgggcaggctgagttgtccttgaaatagtcattcgtgtcttcatttgttttctgcactactgctataaaggaccaagtttgcctattcttggcagttttcatttgaattaaaaactaaacttgaatgtcataaagatagctattccatcctcaaattgagtctcaagtagtatgttgctgcatcgctacactactctggaatgttttattccaccattttctccaaaggtttgccataaagtggtttttacagcctttctatcagccaagatggcaaattgaattgggctctttatgttttaagaaaaatttgcaggctttccccaatactgcaggatctgtgagtcatgggaggaacggatcaaagaaggagaaggaatgtatctaatcaggaaaccatacatcgtttttacttctaaatatttggggctgatcccttacactgtagaaaaatttacttttttaaaagcccttttggctgggtgtggtggctcatgcctataatcccagcactttgagaggctgaggcaggtggatcacctgaggtcaggagtttgagaccagcttggccaacatggtgaaaccccgtctctactaaaattacagaaattagatgggcctggtggcgcatgcctataatcccagctactcaggaggctgaggcaggagaatcacttgaatccgggaggcagaggttgcattgagccgagatcatgccatcgcactctagcctgggcaacagagtgagactccatctcaaaataaacaaacaaataaaaataaaagcactctttacatctttcatataatagagtcactagcttctgtaccaatttcttgtctttagtgtactttggtaaagttttataattaaagcacatttctatcttgaagttaccatccaaggtggtttctggatgctagtttaatgatttaaacactagtggctcactaattcactagatagtttttgttctgttttctttttgctgcctgtttttatttttataattacattggcatgaatttccacttttcaatcttctaaggaatatttgagatttttgcttttaaaacttaatatttcctttaaaattctggaacttcttaagttgacattttaatttttttaaattaaattctgtagtgctcttacagaaccgaatattcttaatgtaagtataagcattacaaatccttgtagaataaatatttttagcattgttacgaaggttaaaaactgggttttgttcacttacatgtcttaaaattgccttaaaatgaatacagaaat

SEQ ID NO: 105428 - DNA, 5675 bp, Homo sapiens
acgctgataaattttgagggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatgggtaagagttacattcttactacattggggaagtgtttgggtggccagccataaagagagattggaccatggttgagccctcaagggagcgctcttgatgtctggcttaatctcatagcaaaagctattccttaggatcacagaatatacttgttttgagaccccatggctctcatgtgactgaaggagtcaatctgtgctcatggatgggcttctcagcaatataattctttttattttttatttttctcttcagttttccaaaatgggtcggatagtaagcagtacaatatcatgtgtccctgtaaggaaggttcccaagtaccaagcgaaatctgaatgttaccagactctttaccctaaaatggttaagaaccattgttttaaaggcagaaaactgaggcccagtttgcataatcgtttccttttatgaagcagatttcaagttctcattccattctagttgcttcatacaacaaacagtttggttttattttcaggtctgtggacatgtcattgattacagttaattgtcttgattactgtttatagcttaattatcaaaccagttgtttcttgaatttgtattatgacagggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatggtaagaacttttttgacagtagatgaagctaagatgcaggtaaagcattgctgaagactgtaactagatttgattagtggaactagtggtatagcaatagcccttggtgcccctgaatcataccctacatgtttaatcttttagcatatcttgtcagatcttactttttcttatttccttgccaccagccttatccacaccaccagtattttgtgtctggattattgccgtagcgtcgtaactgtttaccttgcctccgttctataatcttttgtcagcagcaatagcctcctaactggtctcattgcttatatcctaggcccgctgtggtctgtccttaacagcaaccagagtgatccctttgaaccatagtttgcattcatgtcacgcctgcacagaaccctccaaggactcccatcttcaatcatccaaagcagaagtctttatggtggtctctaaggccctggctggtctggctctctgctgtctctctaaactcttttcccttattcattgccttccaggcacattgaccttttttcagacatgccaaccactcagggattttgtgctgcctattctctttgtctggaacaccctttgttaagatatctgcatgacactgtcccttgctcttaagtctctgttcaaatgttatgttaaactacccctagtcttcctattccctttacactgctttgtttttctgtcttagcacttaatcatttgtcatattatgcaattctttttttttttttttttttttttttgagacaagagtcttgctctgtcacccaggctggagtgcagtggcactatctcggctcactgcaacctctgcctcctgggttcaggtgattctcctgcctcagcctctggagtagctgggattatagggatgcaccaccatgcctggctaatttttgttatttttagtagagacatggtttcaccatgttggccaggctggtcttgtactcctgacctcaagtgatttgctcaccttggcctcccacagtgttaggattacagatatgagtcactgcaccgggcctatttcttgttacttgacccaacaagaatataggcttcataaagacaagggacttactaccttacaatcttgccagtaattttattataaacttgaaaaaaactgtctacatttcattttttgtttgctgtatgtaaagcatattttatgatattcagtaatcacattttttactctgaaaggtaggcactgaatttagtactaatgtttttattaatgtttcttaaaagtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaagggtacgtgtaaaacaccaatgtactcttacctaaaaacaaacactctggaatgggaaaagtatgtataattctataaactcaattttattacctgttattgaaaaaggatagcactttttaaactttaaattgaaatctggcaaatctaggagtaggtagcataggcatttcatttcaaagatttgtgtgttttcagttttcgggtgaaaatagtcctaagaactctttttttaagagatagggtcttgctctgttatccaggctggaatacagtggcacaattatagctcactgcatcctccacctcctgggctcaagagatctttctgcatcagcctcctgagtagctaggactacgggcgtataccactatgcttggctaatttttaaattttttgtagagacagggtcttccgctatgttgaccaggctggtctctgactcctgtcctcaagcaatcctcccacctaagacccctaaagtactgggattacaggtgtgagccacaatgcctggcctcctggaactcttaaaataaaaaagttaggatcatttaacaattttcctatcaaaattctagtctttgggtttttcactgggttgatattgttctctttgtgaaaatcatataactcttttgagtgagacttgtaagctatcgttaattatgctgttgttttagtaactaattttatgtgcttttattatgaaatgcaaacattatacattttaatcagtgacttggtttgttctaagtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgtaagtaggatgactaaactatttatttttatttctccgataacactgttccgtcagctcattgcattccacactcatgtatggaacatgatccatgtttgaagcacattgaaagatagtatgggagtattagattaatgaatgatacgtaggaaatatgggggataccagattattgagtgatatgtaccctacctttcagaattcacattctagcagggagaggaggttgggcaagttggtcagggaagcccttattggggatctggaaagattttattcctgatcttcttgcctttgccttttattagaggggtgaggttttagttatcagaatagagagttagttgaattctttggatccatttgagtgatgaagcatgggttccaatttgaatagtgcataattaattgcatgatgattggagatacaatttagtatcataaataagttacttttgttaacttgttcaacaattacttcctgcattggaaaagtgaatgtgtcgctttagatttggtctgagaaaatagtatttaatgtattttgtgtgttagactcaagtttagaattattgaaagaaaatgtttcatgaacagaaatatcataatggctggtgtcattgataagttccctatgaagagttattttgaaagctgaaaagtataagagtccttatttataattagctctctgcataaagttatcatttagttcattaaatattttttaaagcctgatattgtcttgttttaaaaagctattgcaaaatggcatgtatctttgaattaatagcttaacataatgtgttttcattattaaaaattctagcttctttgcttatttttaattttcatcacaatcttcttttcctaggaagattcctgatgttgcacccattgtaagtgatcagaaaccatctgtatcaaagtctggacggaagattaaaggaaggggcacaattgtatgtgtgataagactttttttgatattatgtatctaataaaaaatttttacctattttcaaagtcctagcgttaattttagatataatacaaaatctgttcaaggaactaattgtattttccatggttatgggaaggtattgctgttagatcaaagtatactgctgtgtttgaatgggtttaattgagtatgaaaggaggaacatgtgaaaccatcagtgagtatgctgagaaatcattaagactttaaaaaggaaaattttatgtggattacaggtgaatctcagccttgcccatctcttttaatgccttgtttgaaataacttcacctgaacctaaaataaaagttaaaaactaaaaaaaaaaaaaaaaaaaaagaactttagaccatccttttggtaacttcaatcattacctttgatgggatgatctgagattgggtcttttacttaactctgtcacatagcagactgtcgtggagaggcattttttaaaatactattgtttttgtttttaaagcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagtaagaactttgagtataagcacaatcctgtgtctgttatattttaaatgttaaagggattggatacaattctggacttttcattaaagattcagtgaaagattcacagtcagactgtgaccaaaggaaatacatttgggactacttgatgaaagtagtactgttaactagttgggcttttaaatcaaaatcctgttttccttaacaaaaactataagcctgtgtcttttaatgacctcttagtcaattttagaaataattaggacttagaggccgggcgtggtggctcacgcttgtcatcccagcactttgggaggccgaggcaggcggatcacgaggtcaggagattgggaccacagtgaaaccccatctctactaaaaatacaaaaaattagccgggcgtggtggcgggtgcctgtagtcccagctacttagagaggctgaggcaggagaatggtgtgaacccgggaggtggag

SEQ ID NO: 105429 - DNA, 3039 bp, Homo sapiens
aaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcggtgagcaatattctctttcctttcttctcccaaggagagtctgttattgtttagcttggaagaatatcagaattagggacagaatcactatttccaaatatctgaaaggaataagaagtcttgttttgtgtgattcagagagtagattgaaaacttagggagagggaatttcaggaggagaaatttgggctgggtttacaaaactattactatcagtttaaagctctctgtcactagaaatgagttcccatgataggtggtaaattctccatctttaaaggtgtgaggctgcttcttgccagtcaagtgatgccttagaagggaatcctgaattgacagaatatatagaatttgcagatcattaatctaaccttccattttacacatgtggaagttgagggccagagagacaaagttacctgcccaagacatgcatcttagtttagatggggcatagggataaaaatgatcatctttagatttttgttgttgtttgaaaagcaat

SEQ ID NO: 105430 - DNA, 2671 bp, Homo sapiens
tgggatcttatcagagtgaggcaagaggagcagtagaaatatttaagaagccttgacccctacctccacctcccccacatgcatcttccttaacctaagttttacatctgcattcacctcttgacatgggttagagattgggataggaagattgtagagaggggaccaagaggaagaagtatatatatggtgggaagggtggccccagatttctagttctcctagcttctttccctcttttgcatctgaggtattttctactgctgtcacttcactttacttacaaaggtcctacctgtacagacctttcccctaactccacccagtttagagcctccctagtgactatatgcatctcagagaagaactgcataaaacttgatcttatgaaatccaataggctttttaaaaaatccaatatacttttgatatgaaaacaaaacaaatgtagctgtgggatttcactgtattttcaccttgatgggcaaataaatgtctagatatttggtatagcctgtcctgccctgatctataagatgatggtccttcatgtgattaatattaggacgtccagcaggagcagatccaggagcagctcatatgatccccacagtcgatccaggtatgaacagggattgggaaaccaccagtggggcagaactgaaagatcttgttttgtaaactgtttgttcaaagtggtattttattgagtaactaaatgcatatatttgtctcctgaaaccataccttttctaaatgaggtctgttcgacaagttttatctgttggcccattgtactccagtgtcaaaaatgacaatatcaaattgtaatggcaggtgtttattgaatataattgcctacagagatccaccaggttcaaactaactcgttaactttgtgatatttttcaatgcagaaaagaaattaacatttttctctttaattatggtaagtctcatttggggcaattgttaaatgtttccagtacttgttttggaaatatatcctcatgctgtcacctagtgcccatgttctaagctagaacactcctgagatcctaaaaagaaataggaacatatgagtatctgagtgggaaaatttagtgtttgttgttgccgttaaagcaggtcctacacctacgatagctactatagcaggagtcggagtcgaagtagaagccagagaagtgacagttaccaccgaggcagaagttataatcggcggtccaggtgggtctctctcctttatcgtcctttatcgcactgtaggccacggtgggcacttgatgtgggagggtgatgggctgctagtggaagagaaagtggtataatcttccaaggacagaaatacttcttcctttaaatctgaacaacccacaagcagccactaaaagtggcttttatattaagagttgccaggtaatatttgttggttattattaatgtttgaatctaaaatgggtttctaaatattcacatatcttggacagacctttcttttggaaagaaagaaggccacccaaaccatggccacttgcttaaatagaaccacttgctagcagtagccagtttctcattttttttaaataaaaaaatacataatataatttgcttcagcagcaggattgaggtttatatgttgtcaattatttagtaaaatacattttttatgtattatatgtattatgtttaacatattttggcttctgcaaaagtctttatgttaacttttgtactgtccttttctggtggcttctggtcttgccttcccctgtccattgcaactgcaatgatgcttgtaaatatcagtctgatctggatactcccttgcttgaaactcttcaaggactccctgctgctttcatgatcaggtccagcctcctcagcaccaactccagctcacactctttctggcttccctcctttaaagtgttgggacttttccttctgcctggagacacacgtgtcctcttcaccatctccccttttgccacttgaaatggccagttcccatctaccctgcagatctccactgtccctgggcagccctccctgatgcctaatcctaggatacagtccctcccatgtgcctctaagacagccctttgctcctactgtggctccccttgctcctaaattacttgtcttgctgactattctattctgtccttgaaccccagagaactatacttggttttgtgtctttgtgtgtgtgtgtgtgtgttcccagcatcttgcaaaatgcctggctcacagtgaatgtttttcaaaataactgaatgggacccatgaccaggtcctcttgactcaatatcccagtggtcctgttcatgcccagggccacccccacccctcattggaccccattttggtttccattccttgagtgaaactatttgtgcaccttttccccattacttttctcaggtaatctattcaaatattgatactcattttgggtaatatggggaaactattctgctcattggttttttgtttttgtggtcccagcatttgcatgaatgaatttcacacaaatttcctaagatgtgatgtttctttattttatcttaatcttgacattactacaacttgtcatttaaaacagcttcaaaaagtccatagtgtgagtcgggcacggtggctcacgcctgtaatcccagcactttgg

SEQ ID NO: 105431 - DNA, 2884 bp, Homo sapiens
gaaaaagaaaagtccatggtgttgccatagtcagtaccctacctctgtgttatgctgcatcaatagtgcatcagttatatgagtggcttgaaaacactattgatgttttcaagccactcatataaaaaacaagctataagaggaattcaaagattttacagttacaagatttttatatattttgttttgttattacaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactg

SEQ ID NO: 105432 - DNA, 1010 bp, Homo sapiens
ccgtggcgctgggggctcacagggccccgcgggatcgcgctgcccccggcggccaggccagggccgctccatgaagcgccgcgctgggggccgcccccgcgcagggccccgcgaccatggcccccgggggcgcggccaggcaggcggaggcgcagggccgcggcgagtccagcgccaagcagctgcggccccagagcctcgggcgcggcgggcggggggcgcggggcgccgattggagcccgcgcgtcagctggggccgccgtctggacgcttaaagggccaggccgcctgcgtgccggcggggggcgcggacacgcgtggtgtgcgcggtccccgtgcagcccgccctgccgcaggctgccctccacccccagccccagctccagcccccagcccgtccccactgctcatatccgagcagatagaccccggccccaccctcccgtgctgagcctcctttctgccgggaagttcgtccgggagtcaaacatcgctgccctccggttgcgccacggagggggagccaggataggaagctgccgtgaaatcaggaagctgagcgcgccgggccccggatccgaacagaaaaggcttccacccgctcccctgagggatcccacgctgagggactgaaccccgcaccccagccgcgctcaccacccccaccctctcgcctgggctgctctgacctgggggtgagtctggggtccccaactggtccagtcccccatccctatcccagggcggcgcagggctcattttgctctgtgcctccaggacttggctccagtggacccatacctacctggcggcctcatgctgcatagggccacccagggcaggagatttaaatcccaggactacaaccgcagcgatcaaatcatctaaggtgactggcccagggccaggagacagagggaccagaggagtagggaccagaggcccaggccccactgtgcccctctagccgtgtgacctgaccactgctgagtggcccccttgctcagcct

SEQ ID NO: 105433 - DNA, 1013 bp, Homo sapiens
gaaggggtgaggaggcccctctcagctaggaggcctggggaggttggttccagtggcaggtgtagcctggacaggctctggggccagggctggcatgtacagttgggcaggctgcacattgcacaagggtgcctggacaagatggcaggtgggaaccggaatcaagctggcacactgctaaccaggctgtgcatcctggcacgggctcgtgtccacccagggaaaagaataccttttcctaattatacaaagtgctgtatgggctggtacaggccctgtgtcagtttgatgacagctgtgcctctgattctttcttaccttctggtcctcatagggcttcaggcctctctgaatgcagcctcccctcagggttcatgcctggacacagtaaggaggtcccccaattgtgtgttttggccacgccactgccccaggcaaggctgcccacctgctgtatgtgggcctggcagagcctcatgtccctacagccctgccttccttgcccgctccaagtctgggccttgagggggaggggtagccaaggcagacagtgagcccctggccaggtcctaatccctttctccatgagacagtgctgggggccctccagcatgaactgactggaagctgggaccctgcggcctaggtctcagccaggagcatgctgggtaaaccaggactggtgtctgtgagcttgaaggtgagccttctgtctccagtggccacctaccagatccttgaagagtttgttagtcctcacccatccgtgggtgctgggaggagtgcagctaacttcctccagactgctggctagggcctgagaccagggcctttctgcatatgtcccctctaaagcccaccacccctgaagctcaggaccactatgagtccctttttataggagaggaagcggaggtccagagagactgagtgggaagccagtggtcgggccgggatttgagctgaagccaggtccacccagggtccttccatccttccctgaagctttgggg

SEQ ID NO: 105434 - DNA, 1037 bp, Homo sapiens
gttaagctctttcctattgtgtttatacagttttgtttgttatactctttgcaccttaaacccccaccactccccgacactattgccttcccagcatggctggagtgggaagaggcttgggccccgggggaatggttagggggactgaacccctctgaccttatgaggcccatggcactggggcagggagctggggacattttaatcatcaataaacgaagcactttattctgtacagatttgggcaggcccaaggtgcccgagtgatctgaggatttataatccaagccacaccaccctggttgttctctgggcttggagggtacagtgccagcagcttccttgcccaattgatgttggagctgtagacgtacgctcaggcgctcctgctgtcctgggggagagaaggttcgcccctccccgaggaagaaggcttctggtcaggacccccaccccaaggctggggactccaggctcctgctttactgtagctctttttcttccttgcactccttgatctttgggcttccgtgatgtcctcagggtccccccctccctgttgctatttttaatctctagtcccagtgcctggcagctctttggagctggctcacattttcccaaaaaaagttgatctctcccagtgggctgtaggcagggtcctccatgggtttccaacccccatcactggcaccaggatctcccacaggcactggtggtgtcatcacctgctggccccactacagcctgagtaggcctgagtggccgtggccaggctgagacctgtcaggccatactgacaagcagaggtcagagacactggtggggagctggcaatgaaaccctgtcctgggacatgggtttcatgttcttgtacacttcccctctgggatcaggtgaggggtccagacagctgaccagacagcttgacagctggtcaagacggtcacgggagctctaggtgggcacaaccaacccctctcctgggaggcccctgccccactggggataggagcctgtgtccctggtgctaagca

SEQ ID NO: 105435 - DNA, 1019 bp, Homo sapiens
aagttaactatgtggtactttgaaatgtggaatcttaggactgttatcctagctcctcctctgatgttccctcgcccccaggcaactcttaactgggtgtaggacctggacaaagtgagtttgtaacctcattggcttggccctgctttttcatttgtaaaatgggtatcactcttaaggaattaaatgatataatgtaaaaagtgcagtacatacatagattcctagaaattaaaatctgttttctcattttgagacctgcattcaaacaaaactggaattctaatggccaactgaggcagcaaaagacattttaaaaattagaaataagacaaaaatccatggttttgctttactcgtttctgtataaacctgcttaggttactaatagatttttagtagtatgtatatgggtgataacgagagagatctattaagccacaacaaaaatgtagtgttttatggaactttgtagtgaacaatgaacttttaaaatttgtttgaattctctaataagcttatttctgtgttgctttcatgttaatatgtaaaggattttcctctttcattgaggctctttgatgagaagcttttcctgtgcattttttattctttaatgacgctttgactaaacttaagtataattcaaacacagatatgtggtgaattagttagtatggcaaattttccatttgttttgtccagcacggttgcttaaatgatgagccagtaggtattcttcagaatcagctgtaggtattcttcagaatcagctgcctctcttaaaatttatctgacttccactcccaaatcatcacttcacctaaactggtgttctttcctaagccagccagctgtaggcactcttactttgtttcttgtttaccccactttcaggaatggtgttcctctactcctgttgaaggataagccctggtctgtgggctgcaccagtccttggtgagcctgccatctatagtgtcctctattcttcctctgacatgcctcacctaggctca

SEQ ID NO: 105436 - DNA, 1032 bp, Homo sapiens
gaatattggtcgtctgattttggaggaaaacttatattctaaatgaaatgtttattatagataagctatagaagtagtacaatttttgtgcacagccctttttgttcaactcctctactttctcatgccatggattggttcacagtggtatccaggcagagctgcctttgttgagcatactgttttgtccctacctctctctaagaggtgtgaggaagaggcatttgtttgatgtacagatgagactgcaatggtgatgatgttgatgaaaacctaaaagtgagttttaacaagaataacagggtgaattccaaattgatagtaggtttaacagaagctggttctacaactgttttcagcagcttgcaaaacgtgtgtagggccacccacacttccttcctcttctccagccacacccacatgcttcagttgcttctgctgtcttcagtaggagaacatcagtatattcttgcagcacataacagtacttgtttctcagacataagtttttatattatgagcactcttggcaagttggcctatttcatttaggtccagcctagttatatgcctgtgctaaataaaaaggttgctctagaatggcctatctagtggttgctgtgtaaagacatgttatcttagctgtatagtcatttaaaatattgatctagaagaacttagtgcatgggaaaatgttcagtttataaaatagaggaaaaagtagttatcaaacttcatgtcgaaaatcttagctttgtaaagaactgttaagtatagaggatgtacactcggacctgatgagaagtcatcatagatgagcgtataggtgatttttactttcttctttgtgcttttatgcattttctaaactttctaaagtgaaagtcttgtattaacttttccagcttgttttttggagagaagtattgtgaaaatagttacaaatctctttttaccctgacatccccccaagcccgtaagtattatccccattttattttttaaaattgtgtctggccatatattatgaat

SEQ ID NO: 105437 - DNA, 1057 bp, Homo sapiens
ttcaccatattggtcaggcaagtcttgagctcctgacctcatgatccacctgtctcggcctcccaaagtgctgggattacaggcgtgagccaccgcacccggccttgttcattattatttcttcattccagtggaataatttttctgacctgtctacctggaacaatctctgttcactctgaaatccctgtttattaaatttcgcttaaaggagttgtaattcacagaaggcagaaggataataggagactgggttactaaagacaaattttactatttttatacatgtgtctagatccagccttagagtatatactttgactttaagcaaaattcaaacaaatagaactaaacctgtatctttttctttattttcttttaggaaaaagaagcaactaacaaaacactgtgataataaggattattcagtatgcagtttgcagggtatgtcttggagacagtacaaattcacctttactttatataagccacatcttaacattgggcattgatgttcagaatgacttttgggagctgcaagatcctcagagatcaaaaaaaatgatttagttactttgtactctaactcaaaatgtacttaatagtaggattagacagtagactagtgtttaaaaagatgttcaggaacaaggatatttttcgtctaaactttcagttaatcattgtgtcctgttcttagctatacaatttaattgtggtttcatagactatggaaaaggggtgctcatataaaaagtaaattatttggtagtaagagtgattgtttcactatagggtactcattgtgaagataccaattagattatttctatttaatctatagcttgctatagattaaaaatcatttcactgtgccctcttgctggcaaaggtttgggaagagaaacattagggtttaatagtacttatctctaggtgtctgaggctctgaaaaaaaagctttttcatttatttttgtaataaaacttttattttcaaaaatcagattcatttataaaatctgatttatatgtcactttccaggaacacatctaaa

SEQ ID NO: 105438 - DNA, 1641 bp, Homo sapiens
atcatttctgaagtggtataaatataaaagtgactttatgcttcttttatagttggtattttaactctaaaaataatattatcctaaatggggcattgattagagtggccaaatgtttataaacaatgtgggctttgaaatgtattaattaggtgtgaatcctaggttttgtagttaatgtcacttgtacctagagcagcctattgccttagctataaaaatgagaccagtgctgactggccaggcacggtggctccagcctgtaatccttgtactttgggaggccaaggcaggaggattgcatgaggccaagagttcaagaccagcctgagcaacatagcaagaccctgtctctaataaaaataaatagcagtttttaaaaattaaaaaaaaacttacctattatatgtcaaatttcgttttttgggatatttttatctaagtggactcaataattaatgctcttaatatgtaactgaaaatgtgaaactgtatattgagagcagtagaaaaagcttcgtcaaagggatagatactgactaatgggagagagctagccttaggaggttgctatattccttgttggattttgttactcagttctattaaatgttggtcagaacaaaagtgagggttcagcctgtgagatataaagttgcatcttgtttaattttatacacgtttgtttttctgagtcattgtcatttataaataggaacctatttctattcatttattgtaaaagttgaaatttttaagtacagtacgaaatgtggttcttaaaaaccaaatgatttttaagacttaaatcatctgtaagaatgcatgcctgtttactcttggaatataatcacgttatgctgggttgtgattgacagttggaaaacaatcattaaaaatcagcataactgctgagtaccagtaaattaacaaatatttactaagtacctactaccatatacctagaaccccctcaaaacatttatataaattcaattataagtttaaaaagtcaatgttaatatgtttactgatatgttaagcacctactatgtgccaggagcttatcctaaacagtagtgatgcaagagcaaacaattacctcctaaacattttggaaaaagttgcatttcaaaatttaataagacagttttgattatatgctatttgtaaccactgttctaggtgttgggggaaagtagaagaaaaaaaaatagaaccttagaatagaaaatccctgagaacctgctactgtcaggttagaggagatggtgtacccaaatacctgtagaataagaccacatagaatagaggtgtcccaaggtgctctggggatattgaggagagaaggtaattccagctgggagagttagagaaaccttcacagaatggatttttttttttttttttgcacttaaaggaagtggtgttggtcttggggaaactgaaaagttgttgggtttctgtgcaaatgtttattctttgtgttttcccttgtcaactgttgcgttattttttaagacactaaaattccttttagaaaatgtttgttttttaaacatgcttatcaaacttgccagttttcttattactcacatcaccaaaaaattgcttccaatgaactaatttttttttcagttt

SEQ ID NO: 105439 - DNA, 1487 bp, Homo sapiens
actaccggccccctgccaccacgcctagctaattttttttttatttttagtagagacggggtttcaccgtgttagccaggatggtcttgatctcctgacctcgtgatccacccgcctcagcctcccaaagtgctgggattacaggcatgagccaccgcacccagccaacatttatataaaattttaaaacatacaaagcagtgttatatattgtttaggagtacatgaacatgtagtacatgtagtaaactctgaagaatgcatgagagcaagataggttacttctgaggggcaggcatatctgtaggctttcagctgtattggtgatgtttatttttgaagttgggtggtgggtacacaggagttcattgtaatgttcctttttcttccccccttatgtcttaaatattgcataataaaacttttaaaaagctattaaaaaaggaaaagaaaaccacttgggaagatgttcaccagtctgataaatgattaccgtgtgttggtgaagtaggcttgggtggagttcataggtaactttttcattttcattatttatagttatttcaatttatattgtgtgatgtgtgattgaaataaatatagaattgctatttttaaaaaaaaggacaggtgtctttctgttaatctacattagtttatcatgccaaaattagtcagtgatttttcacaaatgtttagtaaaatgagcatacacaaatattaaaatctgtcattatattgtgagatgttactaaataaaaaaactttggttcttttttttgaataagtgttttatagtatactggtcctcagcattgagacttagctgaggaattgtctattttattattattttcaaaagatcagatttgattttatcaactatactttttgttttagatgtcattttttttctttcatctttattctttctaggatctttgaggtttcctattttttaatagcatcatgtatcaaaagcttatttctgtgtgtcttgatttctaacaaatggtttattaatgctatttagaagacaatttggcaatatctgatgtgtacatctttaactttaatgctatatgatgccctctcccacaatccctgatgacattctaggggtttcactctgcagttgtccttgctaaaatttgtctttggtttcttacttaactgaaaagttatttagaaaggtgttcctttttaaaaattccaaatggatagatttatttttctctttagttgtctggtttttaacttctaattttagtacattgaagttaatttatgcccaattgatttctgcttcggatactatttttagattttctttgtggcttgatacatggtaattcataccatggtgactgttctttatgtgattaaaatatttgtatacttggagtttttatacatacttaagattatgcattatgcaccttgttcctttgtacccttacatgtttttattctgacctgtcattttc

SEQ ID NO: 105440 - DNA, 1043 bp, Homo sapiens
gataaagtacttagatttataaggcagcttcccctgtagtgataaattacaagcagacaatcttattttgtaatgtgatgaagtgatgatgtcttaactctacttagagagtgtatgtctgtctaacagaacaaaaagatgctctgtgtaaattccttcctgtagggcacactgcaggatttccatgtagatagaagaactatagggcctagtacagaaggtgcacacaaatgttggcaaagtcaaaaccccatgaattaaaacctactggaatttggtttttaggagtttggtaattagattatctcttttgttattttcattcagttatatcctttggctcagctagctttgaaattggctgatgaaaaaatatacataaaagggtaaaattcacacatacagcaaacaaaaatgcacaaagcctgcttcgtaacttttttttctggaattgtttttcactttgcctttttctgccaaaacaataatcaaagaactcttgctttaacctattcctgtacaaagactgtttttgaccagataatcatctgttgtggcattctatcttgtaggacactgtatattgcaaattgctgattatggaaggggccagttgctgttttttcatgcagtgccctgggagtcttaaaagcagtgcttagcaacattggtgatagcatgtggctgggacccagggcccttccccactcttcagccccgagtcatgtgtctgaggtgacggactgagacgcatctggtcctgtaattcagagagtgggcacatcaccaaagaactgcattgctgtggtcactgtttcttcaagtacacactgactctgctactttaggataaatatattttactcagaactctgaatttcacagtatacttactaaactaagtaaaaatgatacttaaaatacttattttactttctagacctaggctagatgttttaagctacagctctagttcattgtgatatttataatttgaaagctatgagaatagatgtgtgggtgaagccatagaacatatttgc

SEQ ID NO: 105441 - DNA, 1013 bp, Homo sapiens
aaaaaaaaaaaaaaaaagaattaagcaaagtcagtaattactgaatgtaccacaacagggtggactcactcagtacaactcatgggcctgcttggtctttgatacttcacaggccaatacttagaaattacccaagattaatataaataatcctagattgcttagatatcaatttatttccttgcatatatggtctgatgtatcacatcaacatgtactctttcttgttttcagcacgcactcctggctttaaagtttatacttgcatttgccatacctgataagccacggcatatccagatgaaactagccagactggaatttgagtctttggaggcactcaagcagcaggtgagagcagctgtcctgaaaatgtatgtattgctttagcaaatgacaggaaaaataattcagaagaatcagtctcagcatttttttcagccttgaagttaccagtttaaatgaatacagaggactccagttcaggatgacataacaaaaccaaaatcctaacaatatgagcaacaaataggtttaaataactaaactaaagaaacaaaaatattcaggcaatgttaaataaagaatagagctagcattcagcaaaagaacaagacagacatctaagaatcaacctggggcagctccccacagcttccagttttgccatctactgaaacattaagtgaggagaagtgaatgaataaaatcctgaataatagctttcagagagcgagacagaatgagatcaggtgtgtagaagcagcaaaattgccctgaaaggagaaactgtgcctcagtgacttccacattctaccagagactacaaaaaaaaaaaaaaaaagccatgctggagttgaccattttggtgattttctgcttgtaggagagtgggagtagacagaagatccctagacacctggagtatctctcacttgttatctttagtgctgcataggaatttaagaaatgagagaatcagtaaggcattgccatctgaggggacaagctct

SEQ ID NO: 105442 - DNA, 1028 bp, Homo sapiens
tcattgggtcaattaacatgtttctgtttataagatttttctcttttatctgaaaatcttttcaaataaggaaattaaatcttaaaattaacgttaaaatagaattttttactggagtctacataatgttcttattgatttaaaaaagttttgctagtagcatattaaattaacagcatgctatactttcatatgtttattcatggcccctataagagcagaaattttactaactcaaaaaatgccatagtctataaatatataaaaattctcataaatttttaacgtcttgatggaaaaagcaatttaagatgctttttttccaaattaattaaccaaataaatatctagatacatttacatgattagaatttgttaacagaacaaacacgacttagaaaatgtaacaattttataaagttgatgttgagtgttaatgttctcaaaatttaaaattggatgaattgatagtttctattgcttttctggatcacatttccaaagccaggtcactttattttttacgcaggtttctgattctttttttttttttttttttttatttcagacagagtcttgctctgtcacccaggctggagtgcagtggcacaatcttggctcactgcatcctctgcctcctgggttcaagcaattctcatggctcagcctcctgagtagctgggattacaggtgcacaccaccacgcttggctaatatttgtatttttagtagagacggggtttcaccattttggccaggctgatctcgaactcctgacctcaagtgatctgcctgcctcagcctcccaaagtgctgggattacaggtgtgaaccaccatacccagccctgattcttcatttttttttaaagcttgatttagtacagatgaaactgagtaaaggcaaaaatgatcactgctgtattatgagaactgtgtcatttgtcacaacttttgtgtatttactgccatctagtgttgcctttaaaaattgatgacacttgaacactactttcatttgcaaaataa

SEQ ID NO: 105443 - DNA, 1041 bp, Homo sapiens
tgagccctagagttcaaggttacagtgagctatgatggcaccattgcactccagcctgggcaacagagcgagacactgtcccttaaaaaaaaaatcctattcaaaatcaaattccatacatttaatatgtatttttagtctattttagagaaaagacagttctactttcttaagcaaatcctaaaaacactttttgataatgacttaagtctcatttgctacaggtgtgaaattcattgtgaaacactctcaaacttcaaaatgtaatttgtaggacgatagataatttcacatgcaaagcccaagcaggctgtctgtgctctttttacgtttttcttttatcatgtttcagaatatggatccctgtaacatcttggaaattaagcactaaccaaatgtaaatggaataatttgtaggaattttttttgttgcttgtaattatagttgtcaagaatattgtaaccacctttcatttttagatattttaaaaacaaaacagttatggaactctataaaagcagaacttaggaggatcctgaatggtgtttcatatacttaaggccttaggactcagggctgaccagaggaaaggaaatcatgaacttgcacatttccagtgttggctaaagaaatatattctgctttgctctttttggctcttattgtatttggtaggaatctgtgttcatgatagatgctatatgtggaatatgcattttggagaatgattttagacagcagtgagtgggagggaaaagaaaatggccctgacagatacaagtagtctattttgaattttgtaagttgaatagaattttggagagctatttgcaaggctgatttatgacctgtggaagtgagaaaacaagacagagttacctttgacagggagagaccagctggctaggcttgtagtgtgctttcttgatttagaatatggcacttcacttcacagatctaaaaatttgtctttgccagtatactcagagttaattaaaggcttttgggactgactgaaacttaaaactcatgaaacttac

SEQ ID NO: 105444 - DNA, 1025 bp, Homo sapiens
aaacattttgttccaaattaattttcttaaattttcgtctatttatattaaactgcaatctttgttctatatttttatttggtgcacttttatacctagagctcggaaatattgaattctcgtctcatctacttctcatttgaataagtggcaggctacttagtggtacatttttcagtttttccatttattgaaaaactataaagaactgccatccctaatgtacttatgttatttacttggaagatggatttaaattgctaatataatttctttttcttctaccagactagaaacattatatttatttagaaagtttttagttttgaaacttttatgtttgtctaagattgtgcttatcttttgtttttgaaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatggtaagccctaagttctttgtctctgttagaatccatttatcaaaaagaagtttatgatgaatagatcagggatcagcaaacttttttcagtaaagggtcaaatagtaaatattttaggttttgcagtccgtgtggtctctgctgcaattactcaacactgccattgtgaagcaaaaaagcagccatagaccataagtaaatgaatgggcgaggctgtgttcaataaaactgtatttataaaaccatgtggcaggctggatttggcctgttgccatcctttgcctcccctggatgaacacaaattagaggaacacatgtaacttacttatattattctattctaattcttataatttgagtattcagtagcttgatacagaaaaatccttttttttgaaagcagaatgattgtcaccaatcaattctaagtcaacaaaatacaccaaaaaaag

SEQ ID NO: 105445 - DNA, 1258 bp, Homo sapiens
cctttgctttgtggcacttagtgaagacaggcatactgggatccattttgctttcaacatccaacccctttcagttgcaatacagttgagaaagctaaatgtaatgagagtagagtagacttctgtgaattgctttaagttgtcctagagaatgatttagtgtcaattgagttgagagaaagctgtcacagaattgctcagttgcagggtagaccataaaagaggtgatttgcagttgtgtgctggagttgatttgtaccagcaagccattgctaaattttcaggaattttgccaacggttggcagcttgaaattggccatggtgggagtatttacaccacggaaatcatcaaatgctataaataaggtataaataagggatttttctctcccctccctgcttcagtttgtttgccagctccccactgggtttacattagactgtgaatgtaggtctttgccttggagataggagagtggatttctctatctaatctttttaaaaactggcaagatatgtgcctttctctctgctgccttctctccttcccaaacctttgccacctgatatcttaaaaatcacaaaacttttcactgccacatcccaatggccttctagtttttttcagtacttcttcttgggtcctttttggtgtttgttactgtaatgatagctactactttttgaaactcttattagacattctaggtcttaatgacattttgccttttatcttaccttacctgaccaacaataacttttattagtttctcctcttttttttttttttgcattctctaaatgtagtcattttccaagattctgtcatcatccttgtttttatttttcatcttgtttactcaaacgtgaactgtcttgtctgtggagatgactcagatctcattttctttctggagccctcttctgtactctggtaatgtttctaattgtcagatgtttgtgcctgattcctcaaatttaacatgtccagaccatgatcttatttttaccttcctgctcctaaactaaacgatataaaaagcttagttctggccgggcgccgtggttcacgcctgtaatcctagcactttggggtaacaccgtgaaaccccgtctgtattaaaaatacaaaaaaattagccgggcaaggtggcggcgcctgtagtcccagctactcgggaggctgaggcaggagaatggcgtgaacccaggaggcggagcttgcagtgagccgagatcgtgccactgcactccagc

SEQ ID NO: 105446 - DNA, 1047 bp, Homo sapiens
tagaacacctgacagtattctacaaattctctgcaaagctagagaccttaaaataatgggttcggtaaccactaagttccttttcacttctaggagtataataccctcatttgacagatgtggaaagaagttagaaggtaatatgacttgccaaagaccttgatcacaggttacttgaggtttgtctgaggtaggtcttcccctttaggtgtaaaacatggtcatttaggattatttacttcaataaaatgtgtactttttaaaaatagctgacaatacaagctaaaatcatgagattggatactagatgatttgtaatttttggttgctctgagaatacttcccttctcagaagtaataaaatgaaacagaatttctcttttatgttttcattaggtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaaggtaagtggtggtgacagaagagagggattataactgtgcttccaagtaccagactctagttcccatctttggtggttgttagtgtctgagccacaaggcagacattctcttaaaggaccctatagaccacaccacaactgatgaccaatatagtagctgaaataatcatgtcagatcttcctattacacgtactacatgttaataggcttgggaaaggggtttctatttgttaagcttagaattgtagaaactttaatgtataattttaagccacaag

SEQ ID NO: 105447 - DNA, 1050 bp, Homo sapiens
ataagaatgtgatattgatctttagccatttttgcagtgtcaacctagacatacatggaaccattggatttttctgagtggccagtgatctacatcatctgccagagtgtaacttaaataacaaatgcccttttttctttttctcaagaaacacacagttctgtactctatatatcttttattattcacatttagatatattaaaaataaagccctctttctaccatacacctcttagatcctactgaatctcaaaagtttacacagaataagagcatgatacgatctatttagcactaatctttaacgtgaaggtttttgaaggtggttcattctacctttattttataaatcatgttagctctttatagtcttagggtgattttaccaaatgaacttaaatatattctttcccccaacagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtgagtgcttatgttctaggaaagcaaaatgtttgtaagttatgagaagagcagaattcactattgttagtcaaaatcttaaaaacaaacaagaaaaccctgaacccttactttttctcctcttcctctaataagtaccatgtcttgcacaaagacgaatgcaactaggttcttctcctcaaaggagagtctttatattgtaaacattgtgaataattagcaaagcagaaaaggagggaatgctgaggataaggttagtcagtcctcaacactctaaaaaaagccaggcaagcagagtgttttggggagtatataaggacctctgctagtccagggcctgggagaagtgtagcatgttgccctgctggtgagcactggagagcgtttggccaattgatgataccatttggtaccataaaacctgatttgattgaccctggggataacaggtaccaccacactcacagattctt

SEQ ID NO: 105448 - DNA, 1052 bp, Homo sapiens
tgtaaggttgtgtcactgttgattaactgccagaaagactgaatgttctattttcaacatttctcccctataaaagaatagacaaattatactgaagcatgatataaacatcttcccaatgaacaatttgtctcacttgtcagattaactaggttagtgcaggaagcaacatgagcgccaagatgtgttgtctgatttctctaccttaagaacaataatagtctttttagttagtattttggatggccaggtttcaaacctgtatgtggtacaaataatttgggtaatatttttgtatttttgttttacacactctctaatctcaattatcctttgctgggagaatgacaggtttcacttatacaggaaggtttttgcacaggaaatttggtcccagcccttggaaggaagaagttccttcgtttacttagtgaatggagtttctggccgcagatgtgccaagtgattgaagaaagatataccccaatatcaagtgataatttattttcctacagactgaatttgctttatttgaaagatgttgtaactctttttaaagttagattttaccctgaggtatagtatatgtaattttgtgaagattgagctggaagggaagttcacaatcctcacatttaaaaaaatatagtgggtgctaaatgttttcttaaaaatctagtacagcatttgatctttgttatgcacagcatacttttattttacagaataaattttcctgtgatagtcacaacaagacagctgtatagtttcttgagtcttttgtatggaccagtctctgtataatagttaactacaggactgtggatccagcaaatgttcagtaaatgctgctgttgttcttagggaaggctactctgggtgttgtggccgccatacatggctttacctgggtccatgcattcccttaagatgacttctgttttcttcttttttcttctgattttccaaaaaaaaaaaagccttgcctaaggttggttttagaatatgatttgcagaacacttttgaaatgtcttcattcatatatgtaata

SEQ ID NO: 105449 - DNA, 1081 bp, Homo sapiens
gccaacaaaagcaacatggcaaaattcttgaaaaatgccaaattctcttaaattgggaaaatcagtgttctaacaaattcagatagtaaagtaccctaatattctgcatcacttaaaacgccagggcaccaactatgggataagattgatgaacaagtcagcaacaatcttgagtaatgagtgtttttaaacttctacattgctgatgaaaactattcatggttctctaaagctaacccataaataactctttaagaggtgatgttcctgatatgcttcctccacacctccactctccaaaaaatgataaaggaggaatttggaaataatgagatgacaccaatcagggcttatttactacccagagactgatgaagtgggacctggaattctgagcattactgttatgtgactgttaattaccgctgtgatgtctgcctcattgttcattaatctttgaccgtggggacaggagccaaccattaagtaaatcaggtatcacacacatacctattaaacaacctccactaacagagatagatctgagaactaaggaagaaagaacaaggcctgagcgcctagagtggacaccagtgagccttacacgtaaagcctgcgtgcttcctggttgccagaaagactcagaggccctccctcagcatttaagcagtgggcattctcactgcacttccaaattgctctttttaatctgctgagtggattagaatcccatgtaaaagtaaggatttcctggtttctaacatgtttgctgggagagagacttagcaaggagtaacaaagaataagctggtgtattttcaaatatgagcttttaaagtttttgtggtgactctaaccataacagcctgagacagaggtcccaggagatccctccttgtggaaaagcagtagttctcttccccagaaaggactggggtcaaaggatgcacaacagtaacgactttgtggtgaggttggcagagaatatacgatggggagcttgatgtgtgagaagtggaaagaaggtcatcttggatgattggaggacaacatcccgcaaacgacaacagggaaagcacag

SEQ ID NO: 105450 - DNA, 1101 bp, Homo sapiens
gggcatgaaagacaaaggttgtcgtgcaccccgcttcattttctagctagtgaccattgactttgttgttttgtggaaggctaattaggaatggaatatttttttttcccagaggaatcgctgaaataaatattagtgtttataaagcacatagcttttttttttttttttaaataacatttgacaggtaactactactgaggtgtattgtaaagactggacagtgtggtgtgttgtttcagtttagggatgattatgggattgatgttatgtctgtgggacagtcactggtatgctcccatcaaggtacatgaaaataaatgctgccttttcattacaaaggataccacagtgaacagggagacatcccttcaactgtattttctatatccttattttattcttcaactttggttttcttcttccatatccctgtatccatccatacacaaccccatcattaaaaaaaaaaatcatctccacagactctgttatttttcaggaactctattatgcctataaacttgacctggattgtgttactaatttggtaggttattttgtcatacaggaaatcacagcctatgggtcgatatgtgcatatgaacccctcagctaaattatctaaattgtttttaaaagatatttttaggccagtgaacacttagcaaaaatatctttacagatctcgataaacctatttttagtgtcagtactttaaaagcttgctcaacccaaccggttctaatcgatgtaaaatgtgcttctaacaaaagatatttatattgttgttgattaaattattctaaatttcctttatggaaatacctgacctaacaacaatagaaattttactgtgtaaaatattactctgatttttaactctagaaaatgtatgcatttattatatttttggaggaaggagccatgtaagaatggataactaaagtacagtaacatttgttctgggttcatgttttctgtaaacttgcatattctacttgatatacttctatcacttttaacaaatccacttaatttttcatgtactgtgaatttatattatatattaaatagatgaatataatatgcatatataca

SEQ ID NO: 105451 - DNA, 1112 bp, Homo sapiens
ggacacctttgtgcaccactgcagcctctcagcttgtagccattgcagaacctagttataagcagcttccggcagcttctggcagcttccctcaggcacaaccaggggtgccctcccaggagcaattcctgcctctcacttcctgccctgtgctagccatcaccctggagtaggaccctctccagtgagggctggcagagatctactttccccatttatcctctactgatagttctgaaacccatttgtttaggttccccggattgtccttgtaagatccagtccagtcacccatagtggcagcgaacccagtgatgcctcctgtacttccgtgacctcctcccccatcccattctcctgtccccagtcctgctaaactgcctgccttccagccactgttgtaggcagtgctctttggggaacccagactaaattggatgagcaccattgcagaggcaaagaaggtacaataggtttcatgatctttttcttaaaatatctcattcaataaattgctatactatccagtctatctggtaacagctaaaagttaataagaacttacagttttaagtcaaaacatttaatcctcatggcaaccccatgaggtatcgttcccattgaatagatgaggaaaccgaggcacagtgacattgagtaactggctcaaggtcccacagcagtcaggggcagagctaagtgcaggcaagctaagtgcaagcaagctaagtgcaggcgagccattaccaccgattctcttaacctccttatgtgaccacactctcctggctcttgttacccacagcctcagtccctccttctgatccctctgtctctgctgtttttctttgcctgaatccttaagtctctcaaagtggcatgcatacccaaaacactgggagaccatgatctagcgctaataattcatttttccccattgactacaagagttaatttgtgacaggacaagcaggagcccacacaaagctgaccccagcattcagaccagctgtgtggtccctctttcaccctaaggattccagttctgtggttcagcgcagtagtgagggctttggtgatggggtatctgcactgccctgtccagccttggg

SEQ ID NO: 105452 - DNA, 1084 bp, Homo sapiens
gagactctgtgtcctacttaaaaccacctctagtttcctcactgcctgcagggtagaatgaaaatgccttagcttgcgtggtgcttcccaggcaggcaaccttttcctttgggcctaagcactttggacttgtcacccttcccagtcacactgtgcttctgtgcaccccacgagctgattgctgtgctgggaatggccctccagccccagctgcacaggctgaccagttccctcacccatcactacctggccccaagggccaggcccccaccgaaacctttctgcacccatgttaagcattcctccacaacctcctgcaacgtgttcagaccctcgtgagagcaccctaggttgatgttctctgctcaccttctttttttctcactggtctgtgagctctttgaagttagaaggcatcattactttcatctgtctttccagcatctagtaaaaataaataaataaataaagcctctaaaacaaaccactagaacatataggcttacgtctgtacctcaataatgaactccaggctatcaagtgatcattcgtttgctcattcattcttcagcagagggactgtgttcttgctttctgctagcactggatgttagatgaggtgctgggaaccccagacactcttagagcttctacttggcaaagatggaattgaaggttaacagacattttatgagacttggttttggagtcacattagtttagggttgattattttttaaacttctaatctccccagaattgaacttaatgagctatcccctgtcactcagaacttgtttggaggaactagaaaaccatgcagattctcagcattttttattcacgattttaaaggcaaatctggatgtggcattacaccgaggtgtttttagctttcctgaatgtcctaattgacatcaaatttttatgaaaacattccaaaacctatgattattattactctgaccactgtttatatttgagtgctgagcagaaaaagaagaatcaccaaagcttttctatttagtcatcttctagacaaaccatatgaaaaaatagggaagtgcttcattcgcagaggttc

SEQ ID NO: 105453 - DNA, 1077 bp, Homo sapiens
catgtgaatgattccaccaagccttaaagaggacagcaccaaagacaagtgacaggtatgctttccattcaaccatcctcaagcccttcatgtcctttatggtaactgtgagggtagaacgttaaacctatttggtgtcaggacaggacaggattttccagccatggaaaagagatgtttagctgatcttcctgttttaacccttttcacttagcgtattcagctgacgctgggtggggctgccagaaacagtttggaggcatgctgagtgccgtgacatccttgtctgaaagacatggccgctggctggcatccaacactgtggttgactttcaaaccatttaattgaaatcatttttttaaaaggaggggtaggtgccagagtaggagaaagatcttggcaaaaaccttatacgcactttttccaccactggcttgaccagacagggccacaaagccgatacaacaggattagcaaaattgcattgttggacataggcacagcgtgacaggtggtacagcaaaggcatttggcaggattaacctgccaaggataaagatgtagcagacaaggggctgaattaatggattggcatgaccaaagcagggaaatctatttgcatgcaatattaactgtgctaataaactccaggctgagctcagcaggccaggcagcctctttgaaccaggggttttatttttcacctagaaggcttctgccaagataggctaaaacaaacaagctttacaggttgccttttggtttttttgccatcatcttaaagtagacatgctgtcttaaatgcctacaataacatgtatgctttactgaccatgtagaatgatcctaatacctcagaatttggaagccaaaaggtcctccatttagagggtgattgtctatgaaaaagcagtgaagaaatatagatacggcacactctggaaaacacctacttgggataggttgttttatctgagttttatattctgatttcctgaaagtcgggggggtctggagtgagcaggcaagatgtccaagatgcagaatctcaggaagcacccatggtctagctcaga

SEQ ID NO: 105454 - DNA, 1022 bp, Homo sapiens
tattttaatccattttctatagcctccttgttcgataaaaagttcatttttcaggggacagagacgccttggaaatttttatttgaagtaattagggcttgaaagtagagtcaaaagttaaactaattttcagagataaacagcataaaatttattcgtggttttacttttaaggcaatggttttaaatgatgattttttccctcaaataggactagtttgcccaatgcaactttaaatggggccaagtagtaaccttcatgctcaggaacttaatctattctgtttggccccaaattgatttaatattatgtcatattttacttaattttataattcctgaagccgttatttatataatacctgaatatcataatattttgtgaatagactcaaagaaaaatgaaaacacttttcattaagattcagtggtacatgacttaagtttctctgccatttatttgcagttacctttgtggtatcatactcttcttgatggtcttattgttataagaacttgaaacttatcaccaaatataatgctgtctatgtgccaaatggagaaccaagagttttattgatttttttaaccatgtaatgaggtagcctggtaatctgcctgttttgaagatggaaaaaaatgaagacaaatttgtcacttgcccaagatcacactcctagtaacagaatctggatttgaacctagccctgtcttactctaaacctagtgattgtctttgtagtctgaccttggtttttgaatcttcttgttaccacctaacaactatgtgaccttttaggcaaattatttcatctttctgtaaaaagggaaagtacttgcctcagggttgtgaggattaaattaaataatgaatagaaaaggtttgggcatttttaactgttataccatacttccttggaggaatacaaaggaaaatcagagtaaattctgcattcaagagcaaacttctctgttgagtgacaagatgttgacagtgagctaagccaaatttagaaagagat

SEQ ID NO: 105455 - DNA, 1118 bp, Homo sapiens
agaatgtttatagcatattatatacattcattttttcttctggtttcttataaaccataggacagattaattagaagcagcagtgacttttaaggggtgaatatagtataattaactcttttcttttgttaaaggttacagatgagacgatttaaaaagaactggaagtgtgatttagattcagccttgaataaattagaggtatgacatttattattttaaatacattgctgggatctctgaaaatcaatagcaacaaaaaaggtttgaataataaccccattttatgaaaagttttagaaatgtggctgttatacagagaaaatgctcaaggaaaggaagttttgtttttcttacaagttaatattttgaaaggcaaacgttttaatttctagagttgtggactgtactaaaaataattctaaaaattgttcagtttcaaaattatattaaagtaaaataacaattcgaagcttagtctttaagttttgagactgggcagactcgctcagtgcataagaaagctgaggtacttgtcatggatggctacagtacatgaaatggtgggagaaagcccaggtcacactgaactctccaaccatttagagtataagaaatgaggaccttcaggatgatttttacttttaaatttaatatcatttttgtattcatgtagtaattgttgctctggttttaattagtacttttatattcttaagacaactttttttcttgatgtgaacaacttctttagtttataacagaaattgtagaaagataataagttgattgaaatttactttgtggccacttttgtagaacgtagtgtccaaaacgatatgtgggcccaaattataaatggccagataacattaaaatgtactttctaaaagtagtaaaataatgcattgccatggagacagttcaaattatgctgctcatcatgttttccgtaaaatccatctccactgtcaggttcagttttgggggtgaatacagttaaatactttaagacctggataattaaaacaaatgtgcattgttatttggaatttatagaggctttactatagccagaaaagcaaagttacaatagtgtgttgttgatgtgatacttg

SEQ ID NO: 105456 - DNA, 1054 bp, Homo sapiens
gggactacaggcacatatcactacactcagctaatttttttattttttgtagacacagaatcttgcttcattgcccaggctagtctcgaactcttgtgctcaagggatcctcccacctcagcctctcaaagcactggtattacagacataagtcacagctcggccagtggcagtgttcttaacaagaatgtaaaactaaaaaaaaaattaaaaaaagaaagaatgtaaaacccttgaatattttccatgttgtggataaattaatgcaggctttagatactcttccttctctttctgaatttttccatctatttattgttagattatggtaaaaggtcaagaattggtgttttagtatcaaacgtttcacattcttatttttcttttcactcagattggtaaaactattgctaacaaattatagtggagcacctgaatttttgaattatttaagttgttactctctttactattacaagtcaacagagtctatatagttttgaatttgttttgtttttgacctgagctctttactactgtagcctttatcaggggttggcaaactttctgtaaaaagccggatagtaaatattttaggcttcgaacacaccacatgtgatctctatcacatagttttattttctttttaaacgatgctttgaaaacaggaaaaccattgttggctcctaggctatacaaaaacggggcacagtttgccaacacctggtctttatggtagtatcaataattctgtattagtttgcctcttccatcattttaagtgactattttattttcttttgtatgcctatttgtgtttcagttagcaaagatccacaaaacagtaaagtagataaaggtgtactgggaagaattggaatcagtgctatgtacttctatcacaagctgttgcagtggtccaaggtacttcattaagtttttgtcttggcttggtatagagactactagttttaaaattatgaacagaatataagttaaccctgcaaattaggagtttgctaataatcattacaattgataaagtgggacccag

SEQ ID NO: 105457 - DNA, 1044 bp, Homo sapiens
agatcagcaaaagaattagttgggtgtggtggcacgtgcctgtagttccagctacttgggagggtaaggtgggaggatcacttgacccccggagatcacaccgctgcactccagcctgggcaacaaagcaagactctgtctgaaagaaaaaaagagagaaagagatagatatagacagatatatatagaaagagaattacactattggatattaagattttttgatctgaataagaaacttataaagaaaattgttatcatttgcagtgaagtcagctgaatttcaaagtggagtattgaggggaaattattatgttatttaatatttctcattttgcaccagaaaaatttataaccactgttttagaaaccatgtggtactcactgcttgtaaaactaatagatttcagaaaaccacaaagtatctatcttgtttctgctgtgcatagtacgtttagttttattgtcacttatacattgaggatttgtgtgtgtgtgagtgcctcaatgaataaccagtccacatctttttaaaaggttatgtctagagaagatatttccacactggtttcccttttcaagagctttatcgggagctgaagcagtcaatgccttgaggcctttctattttgcagtacatccagatttctttggacagcaccccgtagaaagggtaaacatttatttatttttaaaccattagtgtacatttctgcttatttacctttgatacaatataatacatagagttctataaatgtggattattctgttgtggtgatataatcaatgctttgaactaatttgaaatgtagatactgaaaattgaaaatagagctttttttatgaaagctgtcattgttttgtgcaggcaataaagctgtcatttaaactctttagagtactagtaatcatgtttttggtaccaatttttgaagtacagttgagggtttgaaagaaaacttgagacctttattatcatgatcaatctctctctcttttttttttttaaggatgatacatggaagagttttcaatgcccta

SEQ ID NO: 105458 - DNA, 1010 bp, Homo sapiens
aggtcaaggctgcagtgagccgtgattacaccactgcactcccgcctgggcgacagagtgagactctgtctcaaaaacaaaaaagagaacctgataaacctaactggaattcgtagttggaacttgaatctaaaacaaaaccatcgtcattgtaacaatgtgaaaaagaaaaacacttttttcaaagttttcccatttcatcatcttatttttaaatagaaacatcttatatttgcttattttaaatctttggatacctgaacatagtagtaatatttctgccctctggtaaacaattcattttccatttggttgcttttttaaaaattagctagcttagaaacatatgatcaatcaaaacatgttatgtgtgtgcttcaaaaagagactcattggctttccaaggactccagtagttgtggtgggtgctcgctccgtcttcagggtgccacttgttaacatgagtgtgtgctctgttggcctaggtggcagaggagctggggcatcgcccaccgctgtagccagctgcatagtttaagccgcttagcacagcagaatttggaaacacttaaaaaagcaaaaggtaaacattttccattttcttttaaaaaatcacttagctgctatgtacgtctataaattttaatggaaaaaccaaataactttatcacagctgaacttttaaatctgttctttgaataaagcagtggcataaaattagcctttaagcttctactgaatttaatcctgggtttatacactatttgcacaatgctgaaagaatgaagcacctcgaccatgaccaaaggttttgtgttttgtcatcagggtgtacaatcatatttacagaccgttctggcatgagtgcagtgggccatgtgatgctaggaacaatggatgtccatcaccactggacaaaagtaagaaagagccttaaaattaaaaactccttgtcattcataaactttcatttccaacaatgctgtaatgttaagggactaaaaaaaggt

SEQ ID NO: 105459 - DNA, 1066 bp, Homo sapiens
atgaaataccaggccacagtttttttaaaaatgaggatgttctctatatactgacgcacagtcaccaagacatgcactttataggaaattataagctcctccttgcctaaatctccttaattttgcttaataaataacaagtgaagccagaagctgtaaactcataattttaatgaagaaatgggatccagaagatggagatgtttttcattctactttattagatgaggaaaaggagagtaaatacttgtatgccagctaccacaccttttaaagttaatgttaaccctgctaagaacagcaaggagattttatatcagccaggttttagttgccagaaaccacaccagttattttagcaaagaccttataaagaagtgtactatatttaagtagctaaaaaggcaagaagaaaatgccaaggtgtcttggaggtagcaactgctaagcagctgccaccccaggactgggggagctagaatagagtctccccatgtttgacgtttgtctgctaatagcattcaagctctccccctcagtttgcctggatctggacaagctgataagaaagcccagccacttcctctttgcgtcagaggggaagttcaaactgtgcaaaccctgactgtcaaatgcactgagctctcataaccacaacaaaaaccagagccacttgttcgtcctttcactgaagcccaacagactggcgtgggtgcccgctttgctttccctagaaggcctcatgtgagtagtaaactttttcataacctcttggtgtctgcagtgtcatcagtttcaacatccgaaccagttttgagtgatggtagtttattgatcccacctcatgtggagcaaagtgcaaagcaggaacaaagagacgtggctagaattgttgaaaggtgggagattggaagagggaccttgtggagctgaactcagacctatggtggaggagtggactgctgggctgacatagtgtctgtgctcagggaggggccctgtggcctttggatctgtgcttctgtggagaggtcccagctactaatgctggggcagggagcagaag

SEQ ID NO: 105460 - DNA, 1089 bp, Homo sapiens
tgagtagaaattgtgagaaatattgtgccaggcaatttgcaaaatcttggaaggttgtgtgcacttaaccacccagcaactactcctggatgcatcctagagaagtgccatgtgaacagagaatgattttaagacttcactgaagtattgtttaggtagcaagattgggaaaagcctgcatttcatcagcagaagaatggataaataaatgggttgtttttggtccttggaaagtgaatatgaaagagttacgtctcaacacagatagatgaaaaattatgctgagaaagttggtgaagctacatacaaggtacccttagtgtaaagttaagcatactgtgtacctgtgggcacgttacttcaacttgtttttcactttttctgtaaaatgggatagtagtggcaatctcacagggtgattgtgggtgggggggtggtcaatgaagtaatgcatgtaaaatgcttagaatagtgtctagcatgtaagccttgtggacatatagaaagtgttattgttttgcacagtaatctattttctgtggattcaaataatatgaaatgagtataaaatcatgtattggaacgatgtgtgcaagtcaccattctgccttcctaaggcaggagacctgatggatttggggagggtacatggggccttcagttgtgttttctttgtttttttctaaaaattgatgcagaggcatcacaatgttaagatttttacagggtagtgtggtgggtactttttaactgtttgcttaaagtgtttcaaagtaaaaatatttcttaagcatagtctctgacatcttatgactttatagaaatccctgccaggtacatgatgttacttagagtgagccacctaatctttcaaggcttccatttcctcacctgcaaaaattgggagtgtcagaggcgtttgaaccagagtgactccatcttgaatagggaactgggtaaaataaggctgagacctactgggctgcattcccaggaggttaggcattccaagtcatgggatgagataggaggtcagcacaagatacagtcataaagaccttgccaataaaacagcatgtggtaaagaag

SEQ ID NO: 105461 - DNA, 1075 bp, Homo sapiens
gagaccactgccctttgtggttggacagaatatctgtggcatcatgggctatggctgctggaaaggggccagtgggatcctagatttgtcttcaagtttggcctgtggccatgcctattctgttgactttaaaagcagcagcatcaagaactcctagccttcccaaatgccccctggggagttctggctggggcttcagccttcctggctggcttttggatatctgctagggggttagagtggtctcagcggcaggtggaggagagcaggatgctgggctcaagcgcttggcgtgtggatctctaccagtaccctgttgccatccccatcccacaggcctgcataggcagcagcggtccatctgtttaacagaaatgtgctgagcactcccatacaccaggcgctggtgtgtttgccagagacccagcagggaccagaacagatgaaaatcctgccatcttggatctttacagatgacaaacaaatgggatacgcagtattctggatggtgatgtgtgtagtggacaaagtgaatcagagaagagcagagggagtgctggattgggagatcagtcgtgattttagatagtctggtcagggagggcctcaactgagaaggtgaaatgtgagcaaagacgtgaaggaagccagggaggtagcaggtagctctctagggagagttgcaggcagaggagattgggtcttgactggtgtcctcaggaaggaagcccctgggatggagtgcagggagccagctggaagggaaggagaggggccagggaggccacaggcccggccatatgagcatcatgggtcattacgggggcttgagctggctcagagggaggcagggagcttttggacaattttgagttgaggagtgatgtggtttgaatctgaattatattttataagggttaaccacagatccaaggactcagtaaaagggtgaaaggcttctcatgcagttagccttgctgccagttcccataaatcagactcctccccactccgtttctgaattttctataggatcctcggcctcagcagatataaacgcttaccattgttgtgt

SEQ ID NO: 105462 - DNA, 1102 bp, Homo sapiens
aggatcaatgtgaaaatcccatacaagtaagagttaagaaagaagagaccaatttcagtcacaggacaggaaaagactctgaagtatcaggaagtaatagtcttgacttaaaacatgttacatatttgagagtttctggaagaaaggaatcccttaaacatggctgtggcaaacacttcagaatgagttcacaccactatgactacaagaaatatgggaaggggctcagacacatgattgggggcttcagcctacatcagagaattcatagtggactgaaagggaacaaaaaggacgtgtgtggaaaagacttcagccttagctctcatcaccaacgtgggcagagtcttcacacagtgggagtgtcatttaagtgcagtgactgtggaaggactttcagtcatagctcccatcttgcgtatcatcagagacttcacactcaagagaaagcatttaaatgtagggtgtgtgggaaagccttccggtggagttccaactgtgcgcggcatgagaaaattcacactggagtgaagccttataaatgcgatttatgtgagaaagctttccgacgcctgtcagcctaccgtctgcaccgagaaacccatgctaagaagaaatttcttgaattgaatcagtatagggcagctctcacctacagctcagggtttgatcatcatttgggagaccaaagtggggagaaactctttgactgcagccagtgcaggaaatccttccactgtaagtcatatgttcttgaacatcaaaggattcacacccaggagaagccctataaatgtaccaaatgtaggaaaacctttagatggagatcaaactttactcgtcatatgaggttgcatgaggaggaaaaattctacaaacaagatgaatgtcgtgaaggcttcaggcaatctcctgactgcagtcagccccagggtgctcccgctgtggagaaaacatttctgtgtcagcagtgtgggaaaacttttactagaaagaaaactctcgttgaccaccagagaattcacacaggtgagaaaccttaccagtgtagcgattgtgggaaggactttgcctataggtcagcctttattgttcataagaa

SEQ ID NO: 105463 - DNA, 1090 bp, Homo sapiens
gctatttgaaatgactgggcctccttcgctagcttctgctgcctgccttcctggtctttcccaccttcccaccaggacttcaggcccagaggtcctgaagagtagttctgtgtcatccatctcccttctcatgccattctcttctcttctgcagtgggaccattcaccaaacctgctctgatctcctggttggaagcaagggagccatggggcctgaacatgcaggcagctcagcctaaggggaatccagttgctgctcctacaggtgagttccagagaacctgccaggtcctgctcctcctgcttttacttttctctttcttaaggtcagttacatcactgggaatttactccattgtttgctggaaggaagatctttaacagtgttggtaagggtgcttgggccactgggtctcttccatcctggctggcctccgagaggtcattcatttccggccatgtctattctcctgtccccttctcacagcagccctctcaataatagttcttgcctgctggagggcttcactgttcctgtctttcactcactgatgctcctcctcactcctggcctgcactcctgctgaactcctgtactcacccctttctgctcttaggagccctcatcccactcctgttctttcttttcttggtccttctttttgtaataggctgatctccagccctttcagccaagtgctccttggagccccaccccttggcttttgggtacctttctataatgccatgatttttctcccactctggctgtttaacactttcttcttaatcctttttatttccctgctggatgtgacgtctgcatatctctagctgccctgcccatcttgcttttcttctcccttccctgtaatctgggataatcttccatgttttgccttatgtttgactattttataaaggtattggcagtcaggcaaaagcctcaccacccagacattttattgccctttggtgctttctgcagttccaagtatgggaaaagagtacattctcttgtgttatattttttgtcaggagatgacctccagagtaaaacaaacaaattcatcttaaatcaggaaccttt

SEQ ID NO: 105464 - DNA, 1379 bp, Homo sapiens
gagactttcttctatggttccatggctgactctcatgattagcattgcctctctatcagtgttattattaaaaacaagtttacaatttgggagctagcctgcctctttgagttcactttgtacatcagtgcctagagcagcacttgacagtagatattacttgactgtatctccactgtgaaccattatgagtttaattctcaggaactagttccttctctctcatttctaagttacaggcctggggtgggagctgaggggtagtgggaaggtggcactgtgtcatctgaggcctgacaagagtgctgtactgagttaccatgtgcttccttgtgttgagctggagtctgtctctacctggactctcccatgaccctcattagagcccaaggaggctgaggtggttggaggtacctccctgggcgttcttcttgccctttcctcctgcctggaagtaataaaggacctggcttacctatccctcggcctttgtccttcagagattggtcatgtggtctcttctctgagtttgctttctgattcccagaaagatcctctcacaacattttcttcttgccaggacccgggccctgcccagagcccagatgtgcattggatgggtacaggagccctgcgatctgcacagatatggtcccttgcttcacctctcaggagcagctctgctctgggggaccacctggagcctccctatgaaatagaagcacgtgacttcctggctgggcaatccggtacttgctgcctggccttaagaccccagccttatgccacacttcttgcatttcctgtagtgttgtctttccacatctgtcctctcatgagaatctccttctgtcctggcccttagctctctgtcctctccatccattctataacctatatgtggcttgctcctcccccattacaccccccatcccactacccctttcctggccccagtagactgaggacatgtgagatgggtatttaacaacattatgtacctgctcatgggtccaggagtcctctactggggggaagagtgggcttctcactgggctgtccagagctgagccgctctctcatggctttttctccttcagatactcctgctgcccagatgcctgcccttttcccgagagaggggtgcccgggagaccaggtaacaccaaccaggtccctgacagcccagctccaggtgagccacagaacatttggtccttcctgatgtccccacgtcgctgcctaatgggatagtgcagcttccccatcctgggtttctctgtctagtaatctcacatccaaagacccgtgttccagagaccagattatccccctcaagcccagaggtcttctgctgggtgatggtcttccctttcacc

SEQ ID NO: 105465 - DNA, 2904 bp, Homo sapiens
ttccaaagtgctaggattacaggtgtgagccaccatgcctgacctgtcataattttagctattctaatcccattgcctttccacataaatttatctatgtctacaaaaaatcttgttgagattttggtaggatttgcattagacctgtagataaatgtggagagaatttacatctttactgtgtcacatcttccagtacatgcatacggtatgtctgttcatttatttagatcttctctgacttttttcatcatccctttgtgttttttacgaagttttaatgtataagttcagtatatgttttattgtggggtattttcttagcttactccaataggggacagcctagctctggtctacttgatactggcatatacctttgtgcaaacgctcttcttatatatacaaagatgatcccaaccagcagaatccaactgcaccatgtataatggacattattctctcatcccctcctgcacagaaatgctggtaatttcagtcacttgctgatgacttctgatgtcccagcaaatgttggcattgttgactgctgagaagatacttctgaggacccacgtctaaggtggacttggttcgcactcttctggttagtccctgaacaggagtgatgcctccaggcaggtggcatgctgcctatccagctcaggcccagtcttcgagggagcgagggcggcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggaggctgtggccttgctggaggagctgcagagggaccttgatgggacatcctggagggtgagtgtgagcaagtgtgtggtgcccagggaactctgcctgctagtgagccagcttgtctggggatgggggtggccctctaaactgtcaatatagaggagtgcaggggaagccttcctttcttcccatggtacctgagcagctgagaacgggaccctgagccacggaccctttagcaggtatcctttcctaccttcccagaggaatatcagctccagatagggtcagcaagtctccataaataacagcaacttctgggcacagtggctcacacatgtaatcccagcactttaggaggctgaggtgggaggattgcttgaggccaggagttcaagccagcctggacaacataggaggacccccccacactgtctctatacataatttaaaaattaggccaggcatagtggctcacacctgtaatctaagcactttagagtccaaggtgggcggattgcttgagtgcaggaattcgtgaccagcctgggcaacatggcaaaaccctgtttctacaaaaattagctgaatgtggtagcatgtgactgtagtcccagctacttgggggactgaggtgggaggatcacttgaacccaggttaggtcaaggctgcagtgagccgtgattgcaccactgcgctccagcctgggtgacacagcaagaccctatctctaaacaaaaaagcccagtaactagtctttggacacagtggcttacagtatacaaagtccatctccacatattatctaatttgacttgagactaaccatagccctgtaaagtggtgggtgttgggacagcatttagggttagggctcttggcttctcagtgggagagtacatgttaaaactcagaagagcgctctgcaggcaccatgtagcttccttctcagtaagcttttttttttcttttcttttctttttttttttgaggcataccccaccactcccagctaattttgtttgtatttttagtagagatgaggttttaccattttggccaggctggtctcaaactcctgacctcaggtgatccatccgccttggcctcccaaaatgctgggattacaggtatgaaccactgtgcccagcccttctcactaagcttttgaggaccttttctatgtgtgtgagatgggaggcagggaagatggtcatgagtgctgaggggcagagctgggctgagaaataggaagacctcgattttagacttcattccacaacctcaacatctgtggccacatagttgtacctttcagagcctctgttcgttgagaagaaaatgcagaaatggtttaatcgtgagaatttgttcggtaaatattcaagtgcttatcatgtgcctggccctggcagagttggcagtcccaggcctggcaggagagcagcagctggtcagttcaagtgcgttcgttcttcctgcccttctcctgcacacaggggagctgatgcttcctgtattgttacagttttttaaaaaagcatttatcacttttttaaggcttctttatataaaaatacatgattctggccaggcgtggtggctcactcctgtagtgctagcactttgggaggccaaggcgggcagatcagttgaggtcaggagttcgagactagcctggccaacatggtgaaactccatttctactaaaagggcagaaattagccgggtgtggtggtgtgcacctgtagacccagctactcaggaggctgaggcaggagaattgcttgaacctggaaggtggaggctgcagtgagctgagatttcaccagtgcagtctagactgggcaacagaacaagacgctgtctaaaaaaaaaattaaaaaaaaaaaacatatatagacataca

SEQ ID NO: 105466 - DNA, 1005 bp, Homo sapiens
accctccagggaaaattcacaccactcttgggataatgccttatggaagaggttaagagtcagtgtgtgtggaggtgcctgggttctcttgaatccacttattgggaatatagatcttatgggagccagaagcagggcttgtcccactcatagctttctttcctccctcagctcaatgtacttctccagttcctacccttcctcaagtggggaactcaggagaccaagcaggggcaactgtacttcggatggtcaggccccaggtgagcttggttctttgtgtttttaccaagtccccatgagtctggtccaagaatggctagaggtctcacccccaggactctgccccatctaagactattcctgtggctctcctgcctcattacttcccctggaggtaatggactctatcttgccctggacttgtccttttcgaggtgtcatctcagctcctctctcccatacttttgcccatgaagagcccataccctgtgcccttcgtacccctgatgactctgcccttcaggctgtgaatgttcctgagcgattggagcttgtcattccaggatactgtggcatatgaggacctatctgtagactacactcagaagaaatggaaaagtctcacactcagtcagagagccctgcagtggaacatgatgccagaaaatcaccatagcatggcctccttgggtaatgattctgtttcctagtcacttaaagtctgcatgctgcacaatctcttttctatattccttgtctctttaaactttttaccatgaaaatttccaaacatagttaaactagagtgaataatatagggaccctttctgcattcatcactgagattcaacagtgatcagcatactcttcacctcattatgaattgatatagtgtggtttaggtagggcttcttagttgtaaggaacagagagccactcaagttattgtaagtaaggagctgtgagtcataggcttaaaggaatgagaacctggaagaaact

SEQ ID NO: 105467 - DNA, 1035 bp, Homo sapiens
gaatgcaatgagtgtggagaggcattcattcgaagcaaaagtcttgctcgacatcaggtcctgcacactggtaagaaaccttacaaatgcaatgagtgtgggagagcattctgttccaatagaaatctcattgaccatcagagaatccacactggggagaagccttatgagtgtagtgaatgtggcaaagccttcagtcggagtaaatgtcttattcgacatcagagcctccatactggggaaaagccatacaaatgtagtgaatgtgggaaagccttcaatcagaactctcaactcattgagcatgagcgaattcatactggagaaaaaccttttgaatgtagcgagtgtggtaaggcatttggtctgagtaaatgtcttattcggcaccagagacttcacacgggtgaaaagccctataaatgcaatgagtgtggaaaatccttcaatcaaaactcacaccttattatacaccagagaattcacactggtgagaaaccctatgaatgtaatgagtgtgggaaggtattcagttatagctccagccttatggtacatcagagaacccatactggggaaaaaccctataaatgcaatgattgtgggaaagcttttagtgacagctcacagcttattgtacaccagagagtccacaccggagagaaaccttatgaatgtagtgaatgtgggaaagcctttagtcagcgttccacttttaatcaccaccagcgaactcacactggagagaagtcctcaggtctggcttggtcagtttcttaaggtatggttctctgagacagagagcaacgacctttgagttaagctgtctttataagcaggatgctcatagtggtttcccggagccagtagtcacggtggaccattccctacttgcttttccttggatcactaaggtgggagagtaggagtaacttattccagttcttacccattattaggaaggtaaggactacacatgtcattgaattgtaggtttcctttttttttctttacttttaaattttaacttttaaa

SEQ ID NO: 105468 - DNA, 1059 bp, Homo sapiens
ggtgtatgatgtttgctacaactgaatggtttttcacatatcttaagaattggtcatttgcagcggccgcggggcgctgagggcagctgtggcggcgcggacgagccgggacggcggcgaccggagcttgagaggcgggccgcagcgggaagcagcgggcccgaggccgcgtccttgggcccacggcggctgggcggcggcggtgcgggcgggagctgggcgtcgcgcgcgctgtgaggcccgggcggctcaggagcctcggcgcgtgcagcgagccgcccgcagggaaggaggccggtcagggcctgtggcagggccggcgagggatgcggcggcggccgcgctgagcccctagcccgccgggagcgccaggccggccgggcctgcgccgccgccgccgccgcgccgaccatgtcggcagccaaggagaacccgtgcaggaaattccaggccaacatcttcaacaagagcaagtgtcagaactgcttccagccccgcgagtcgcatctcctcaacgacgaggacctgacgcaggcaaaacccatttatggcggttggctcctcctggctccagatgggaccgactttgacaactcagtgcaccggtctccgaaatggcagcgacagttcttcatcctttacgagcatggcctcttgcgctacgccctggatgagatgcccacgacccttcctcagggcaccatcaacatgaaccagtgcacagatgtggtggatggggagggccgcacgggccagaggttctccctgtgtattctgacgcctgagaaggagcatttcatccgggcggagaccaaggagatcgtcagtgggtggctggagatgctcatggtctatccccggaccaacaagcagaatcagaagaagaaatggaaagtggagccccccacaccgcaggagcctgggcctgccaaggtggctgttaccaccagcagcagcagcagcagcagcatccccagtgctgagaaagtccccaccaccaagtccacactctggcaggaagaaatgaggaccaaggaccagccagatggcagcagtctg

SEQ ID NO: 105469 - DNA, 1040 bp, Homo sapiens
agaatatgattaagtaaatgataatatagccacaatttagaatactatgccagaatgaggtagttctatatgtgttgtattgaaagattgttaagactattgtgaaatacggaaattgagttaaaaaacaatgcaggttgctgaacagtatataactgtgatgatctaaagtatgtttttgaaaaataagcaatatgtgtgaaggtgaacatataagtatgtaaatgcagagaaaatgggttaggactcccatctaaactgataagtactttgtgtgtgtgtgtgtgtgtgtgtgtagtgtgtgtaggttatatatttaattctatatatttctgtattacttgatcctttttcaatgagagtgaagatttatcaacaccataggttattgtgtagcatttaaaataagcatgaagaatggcaacatgaaagtaatctttttttaaatcttaagtgtaatattttatctcacaggacatttggaagctatggaaaatgtaaaaatcaaacaaaaaaaatgaaaagaaccttaaaactacctgtaattacaccatccagagttaactacccactgctaacacgttggtataaagactcccagtctttttcttgggatccttttgttcacattattttgtatccttggcaataaaaaatctttttgttgtaaaatccttttttaaaaaatgctatgatgataattgtgaaaatatgtatccccaaagtcaaaaacaagaatttgtaaaatcataattattagtagtatggttggagattttcctttgaaagaaatatcttaaatcttaaaatgtatagtggttatctctttggaggtagaccgagatgatttttcttaatcatttgctgcttttaagtttttacaataaaagtaagttaacttttaatcaggaaaaaatcaataaacattatataaagctgtttgcaatgtggttattatgggaagatattacatatttatagtccaaccccttcatcctatgagggaggaatagaggattccatgtcctacattggcccct

SEQ ID NO: 105470 - DNA, 1020 bp, Homo sapiens
tgaggctgtacactgtgctgtccttaatgtttcaaacacaccccttaccattactagtcaaatgagggcagaggttcccccagagcctttctgtaataatatcatcaaaaccttgctgctttgatctttagatcccacaaaagttcactctgaaaattcttcccatatgctctctcctcttatcatgtactcactggtaagctaggtttagattctggagtgagcagtgaggtgcaatcaaagtaataaggaagaaagtagctagcttgtttctctgcccaactcaccctgggggttggaggagactctggcttccttttctgtttttaaaaattgttctatggcctccaggaatagataattatgttctcattctcaaaattgtaaccacactaccccctaccaccagttccctcttaaacatgtgcctgcttgtctctagggtcagaacatatcctgggatatggcggtagtcctgaaagcaactcaggaggcacctgctgcttcaacccttggcagctactcattaccagggactctggccaagagtgagatactggagactcatgggaccatgaactttctaggtatggttcagttccctgattctgaatctgaccattggggtttctcaaaatcttttcagagactggtgggcatccagtctcctaggttgaccaacagagtactgaggtattgaaagtgtccaggaaagctggaaagaggaatgctgaaatgcctgtgcatttgtcatgggaagtggcttattttgcacacaggctcaagacactagacaaacataggtgttgtgctgaaacctgatcaacaccaatatggtaccaggttcaagaggctgaagaagagacccagagccagcaaacaacatagaattttactaggtgtttatgtacagggtagacagtctagaggcagtggactgggcacgggagaaccacatggcccagtggcacaggctggacaggagagctgcaactgcttgcaaaaggcatgcggtttatg

SEQ ID NO: 105471 - DNA, 1053 bp, Homo sapiens
tcatatatcgaaaaccagtcaagcatccctcagatgaaaaatattcaggtttaacagcaagctcaaaaaagaagaagccaaatgaagatgaagtaaatcaggactcggtcaaaaagaactcacaaaaacaaattaaaaatagtagcctcctttcttttgacaacgaagatgaaaatgagtaagtgtaaatattttgaatttagtctactttgaaagtatatggagtgttcattaaaatcacattttttcctattataaagatactacaagttctttatagaaagtttaggaaatagagaaaaaaatttaataaactacatctattcatcaatacccctctgacttaaaatgccaactctatagaaattagctagtattaacattttgttatttcccttgtgtggttgtatatatatgtaaattatatttttaagcaaaatacattttttgtgtgtaaacaaaattttataaatacaactgtattgcaaatgttctttgtcctgcttctcacttgacattgcattacgagtattcttccaggtcagtaaatttcaaaaacctgacattaatagctacagataatttcataaacatctcattgtatctttttcattagcaatagctccactttgggtgggggagatgataatgtgccttgttaaaaatacctccccaactcctgctaagggtggccatgagactcagctctggcaagttaagaaatacaggtggaattctgcttgataaagctgctgggttttttgttacaaaaggacagacttggcaaacatgagcctttgctcttatcttttcatcctacttggagtgcagagataaaacctgagtaccagagccacttttaggcataaggaaggcagccatgtgctttgggtcatgttagtaaaaagactcagagcttggctccttgctgacatgcctggaggagctgctacaccagcttggattgctgacctctgacttcttggtagtgagaagaataaacactgtgcttaattaggccttggtcaggtttcttttatatgcagccaaatg

SEQ ID NO: 105472 - DNA, 1138 bp, Homo sapiens
caagcagtactcgtgcctcagcctcccaagtagctgggactacaggcgtgcaccaccatgccctgctaattttttgtattttagtagagacagggtttcaccatgttgcccaggctggtcttgaactcctgaactcaagcaatccacctgccttggcctcccaaagtgctaggattacaggcgtgagccactgcacctggcctaagattccctttctgaacccaatcatgtttgggcaaatgactgatgagtatttatctagactgcagagtaaagcatccaatggtctgttttaaagcaggaagactctttaaaagacttactgttttgttgaggtatagcttcatgcagttaagggcacaaatcttaatattattcaacaaatttttacatataaatacactaatgtaaccaccatccagatcaagaaatagaactgttcctgtactccagaaagttccctgtgacccttcctagtcaataactacctgatccccaaccattactctgattattattatcactgattagttttgcttctattcttgaacttaatataaatggtacagtatgtattctttttttattctggtttcttcaactgaacattatgtctgtgatcattgtccatcattgtatgtagcagcagttctttttcattgctgtgtagtgttccattatgtgagtataccatgatttgtttattctcctgttgattgacatttgggtttttattatagttagggctgttatgaataaagctactgagaatagacttaagcatatttttagatggacacatagaggacctcaaagttgaaagaattttacagtgaatgcctatagacttcatttttttcttttcttttttgagacagagtcttgctctgtcacccaggctgaagtgcaggggtgcgatcttggctcactgcaacctccatctctgttcaagtgattactcctgcctcagcctcctgagtagctgggactacaggcaaccaccaccaagcctggctattttttatatttttagtagaggcagggtttcaccatattggcaaggctggtctcaaactcctgacctcaaatgatccacccaccttggtctcccaaagtgttgggatcacaggtgtgagcc

SEQ ID NO: 105473 - DNA, 1164 bp, Homo sapiens
aatataatgatgtgttaaaactagttatcagctgagcacggtggctcacgcctgtaatcccagcactttgggaggccgaggcaaatcacgaggtcaggagatcgagaccatcctggctaacacagtgaaaccccgtctctactaaaaatacaaaaaattagccgggcgtggtggcgggcacctgtagtcccagctactcgggaggctgaggcagaagaatggcgtgaacctgggaggcagagcttgcagtgagccaagatcgcgccactgcactgcagcctggacaacagagtgagactccatctcaaacaaaacaaaaaaactatttatctagattttttttacttttaggtatcttatattgtattaaaggataatagcataggaaatttacatcttgtgaagcgagtgcaaaattaatgctcatgaaaactaggtatgaacacatgaaaataatgtatctaaatgaggcttcttttttacaggctggagctggaaagagtttcctttgtaagtgttcctttattgaaatctacaacgagcagatatatgatctactggactctgcatcggctggactgtacttaagggagcatatcaagaagggagtctttgttgttggtgcggtggagcaggtggtaacctcagctgctgaagcctatcaggtaccctgccatgagtacttaattggtgcttaggcaacaaacctgctgtgaatgcaccccaaactccaaaaagtgacaattgaggtaccaaaaatatgtcataaaggcataatacagaatgttcatgggaagtaaagataaaataatatggcagtattttcttttccaagagtctttcaaaatggaacctcgaaagggcaatttatacagaaataagatgatacattgtatcatcagtttcttacttgtccatatgtttttagtggttcctcctgggagatgcctgtttgaggggcttctgggaactctggcctttaaaccagctggctgttcttttctacgttgcttgcttgttaggtgtcaaaagctaacttaccttgagcattcagctcaggacaagcaaacctcttgacaggaatttacaaaatattctagatatgtttttatgaaatctgatctggcttaatgatttgaaagttttttattatgaagcatttga

SEQ ID NO: 105474 - DNA, 1050 bp, Homo sapiens
tttttgtagaagtattcaggcaaacatgcttgtatttgctttttccccttatgttacacaagtgacagcatactgtgctatttttataccttgccttttttattttggagaccaagtctcgctgttttgcccaggctggagtgcaatggcatgatctcagctcaatgcaacctccacctcctgggttcaagagattctcctgcctcagcctcccgagtagttgggattatagctgtctgccaccacgcccagctaaattttgtattttttagtagagacggggtttcaccatgttggtcaggctggtcttgaactcctgacctcaggtaatccacctgccttggcctcccaaagtgctgggattacaggcgtgagccatagtgcccggccgctttttttagataatagtattttggaatttgtctcagtttggaggatctctctctctctcttgttttttgtagctgtatgaatgtatcagatgtatttaatatgtaatatacagtatttaatgttataaaaagaaagcataaagtactatccaagaaacataacagatacaaatagctgggcgcagtggcttactcctgtaatcccagcctctttgggaggccaaggtggtggatcacttgaggtcaggagttcaagaccagcctggccaacatgatgaaaccctgtctctattaaaaatacaaaaaaattaggcatggtgatgcatgcctgtactcccacctactctggaggctgaggtgggaggatcatttgagcctgggaggcagagatttcagtgagacatgaacatgtcactacactccagcctgggtaacaaagtgagactctgtcttaaaaaaaagaaaaaagatacaaataatttcagttttatactgttgctgattaatagggttataacagctacgaattttttttttttttttgtgatgagacagagtctctgttgcccaggctggagcggaatggcccgatcttggctcactgcaacttctacctcccgggttcaagcgattctcctgcctcagcctcccgagtagc

SEQ ID NO: 105475 - DNA, 1969 bp, Homo sapiens
ctttatgtaaatatatttctttttccctatgaaagtagataattagctgtatgttagtatttttcataataaaatgagtgattctcaagtgcttattttacattttaagtgtacctattcttgttcctttttttttctcttttccttttttttttttttttaagataggatcttgccctgctgctcaggctggagtgcagtggcacaatcatggctcactgcagccttgaattcctgggctcaagagatcttcccacctcagcctcccgagtagctaggactacaggttcctgccactgtacatagcaaattattattttttgtagaggtgaggtctcacactatgtaggtcaggctggtcttgaattcctatccacaagtgatcctccagacatggcctcccaaactgctaggattacaggcataagccactgtaactggtcctctcatttcttttaatatgttttccttttgcataggtgttgtctggaggatggaggaatagacgtgtggcatcaacatcaatgaacagagaatcgtctaggtctcatgccgtctttacaattacaatagagtcaatggagaaaagtaatgagattgtgaatatacggacctccctactcaacctggtggatttagcaggatctgaaaggcaaaaagatacccatgcagaagggatgagattgaaggtaagaatgaaattatggtcttcaacttgtgtgtgagttcttactagcagtcaatacagtcgtgatgcatgacagtgtctcagtcaatgaggaactgcatttatgatgggggtcccttaagagtataatagctataccacatggcttaggtatgttgtaggctataccatctcggtttgcataagtatattctatgatgcccacaaaacaatcaaatttcctaacagcacatttcttaaaatgtacccctgttagccgggcgcggtggctcacacctgtaatcccagcactttgggaagctgaggcaggtagatcacgaggtcaggagatcgagaccatcctggccaacgtggtgaaatcccgtctctactaaaaaaatacaaaagtcagctgggcgtggtgatgcgcgcctgtagtcccagctacttgggagactgaggcaggagaatcacttgaacctgggaggccgaggttgcagtgagctgagatcgcgccactgcacgccagtctgggtgacagagagagactctgtctcagaaaaaaaaatgtatccgtgttgttaactgatatatgaccataccaagctaagtgttttgagggtggcaaagaaataagaaattgttcctattgaaaaggaacagagatttcttttgtggaacagtgaacatagatgggatagggcaagtctgtcagtagcaaaaatgttttaattcataccagaggggataagggtacaagagacaacaggggtcagaggaagaagggtgcaatatggactgcttgtggaacatgtggaaaagaagtagttcttgacttgtgaaggatttcggtagggagagagaaacaggaaatgcatgcctggcaggggggcatctcaagggttattgtggatgcagaatgagtgtagcatttggcatttcagcatggctcaatggatgggttggttagagaggcaagcaggcccggattatcaaggaccaggagtgccaggccaagtttgtatcaactctgcgaatactgggaaacacttaacatttcttagcaactaagtgattcatgaagaaagcctgttttatagaaacttagtcatctgacccactgctgttaagattttagaagggagagcccacagaaaaagatgaccacttacgctgtttaatatttcaggtatgaagggttaagtatctagtcctaggctaaggtatcaacagtgggaccagaggttctatgtaatatgtattgtcaatatgtgtttatatatatatatatatagtaatacg

SEQ ID NO: 105476 - DNA, 1299 bp, Homo sapiens
tcacccaggttgtagtgcaatggcacaatctcagctcactgcaacctccacctcccaagctcaagtgatcctcccacctcagcctcccaagtagctgggactacaggcatgtgccaccatgcccagcagttttttgtatttctttgtagagatggggttttgccatgttgcccaggctggtatccaactcctgagctcaagcaacctgcccacctcggcctcccaaagtgctgggatgactagcatgagccacagtgccagcctgtgtttgtcttctaatactaaaattacagtgtacatcaaataggaaaaggttagggatagttcagcacttcttttttatttgttgaatagttgttctttattaacattgtccctgacttgccttttcatccagaattttcctctgctagatatattttcattcaaaataccaaagagtaaccaacgtacctaaatttttgttcttttccgtcaacactttaggaagcaggtaacataaatcgatcattgagctgcctgggccaagtgattacagcacttgtcgacgtgggtaatggaaaacagagacatgtttgctacagagactccaaacttaccttcttactacgggtaaagtagatccttgggttcctgggctccttttggttatgctaaagttgatagtgggacagtctctcagccttggtggcaagagtatacattttctttgcttaaaaaggtcttgtgatttctcaccgaaaatatgttcattcctatcattaaacaggattcccttggaggtaatgccaaaacagccataattgcaaatgttcatcctggatccaggtgttttggggaaaccctatcaacacttaactttgctcaaagagccaagctgattaaaaacaaggtaaaatactggcgtatacttcattaaataaatgagaaaaatactaaagcttacagtatgccatttttgtgattgccctaatattaacattaacttttatttatttctcattgtatgcaaaatttctattttatctttcctacccttctatatcacacatgtaattagagacctaggttagatcttatggttgttattgcttgactagttttttctttttttttgagacacagtcttgctgtgtcacccaggctggagtgcagtggtgcaaacacagctcactctagcctcaacttcctgggctcaagcgatcctcctgcctcagcctcctgtgtagctggaactacaggcatgcagcaccatgccaggctaatttttttatttttttaatttttattttatttatt

SEQ ID NO: 105477 - DNA, 1076 bp, Homo sapiens
tagtgtggtaaaaaattaaaaaaaaaaaaaaaaaggaagtgtcaaaccaacccctccttccaagagggctgttaaaaaataaaggtcggattcctctggagaaggttgcttctgccaagctcaagcccaccctgcaagtcatcatgcacttagaggctaggctccttccccgtagggagctaggaaagaagggaaatgatactcactgaggtattggctcttctccattgggagggtgggggaaggctgtcgttctcagggaaagaagtattaggtgaacacacccggatcctaagggtgacccagcctaaaagctcagggctagtcagctggggggcagagagcctggctggggctgtctctctctggctccaggtctgaaggcacaagaaaaggaagcttcctccccacttgagcacactgtgattcctgtgtccttttgactatgatgtggtcttgaagttttgtttgatgttcatcactacaaatcataccaaacaaatgtaaacacaggactatactactcaaaaagcattattttaatgctttttaaaaaattcctgaacaggcagtagtaaatgaagacacccaaggaaatgtgagccagctccaagctgaagtgaagaggctcaaagaacaactggcggagcttgcttcaggacagacaccaccagaaagcttcctgaccagaggtaggatgagcacacagtcctttatcttggggaagactgtacaaataatagtttaagagcccttggtgatagacacaacacaataaggcaacccaaatttttctgcaggtatctctttctgcttatttctcctatataggaacatagtggtttgtttataatcagatacagataccataggcagtgagaagggggaattaaaataattttgaataatgtataagtgctaaaaagagattaatttcatttagatctacttctacgtagcatatgtaatctatatatgtttactataggataagagagacttatttttcttcaaagaatagctagtagagaattaattaactggaaatccataaaggcaagagggtgaattattaa

SEQ ID NO: 105478 - DNA, 1272 bp, Homo sapiens
gtctcattgttttttttttttttgagacgcagtctctctttgtcacccaggctggagtgaagcagtgtgatctcagctcactgcaacctctacctcctgggttcaagcgattctcctgcctcagcctcctgagtagctgtgactacagacccacgccaccatgcccagctaatttttttgtatttttagtagagatcgggggcggcgggaggggggggtctcaccatgttggccaggctggtctcgaactgctgacctcaagaaagatatccgtctgcttcagcctcctaaagtgctgggattacaggcatgagccactgtgcccggccacagtctcattcttttagattagttgagagcaatcaattaaaggctatctgttctcttggttttgcaatgtgataaatattttttttcatcttccctttcttattggatcaattacagacaaaaagaagactaactatatggagtatttccaggaagcaatgttattctttaagaaatctgaacaggaaaagaaggtaggaaatggaattagtaataaaggagattcaagatagttagttttttgctgtgtggtttttattgccttactaagtgaaataaataataccaagtcaataaagtaatggaaggctatgaaaaatcaaattttgcctttaagattaaatatgaaattagtatttgttgctggacttacgaaaatttagggaagtcaaattatttttcatgtttaaccaaattatgaatttctttaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaagtgagtatacggcatctataatatttctaaaaataaaagaagttcaaagcaaatctaagtttgtcagcaagtacttgttctttaatacaatggaaattgttttaagtgaattcttctgacagtgtgattgcataattcctttacctgtctttttaaaatagttaaagggaagagaaggggagaaggaagaagttgtggtgacattgctacatagtatgctactctagcaggccacgcagaatttcacccagtgggcagttgtggttatctgagtcagtaggctctttagggttgtgcctt

SEQ ID NO: 105479 - DNA, 1027 bp, Homo sapiens
gagtttttaatgaatattcaaactaatatgggtggatatttgtacttttgtttctcctgtacacttttttgcacttcgcctttttcagttaatcttggttgacaagattaatttggtccttgttcttttcagtgtgttgatttaactagtctcctttgcatgaaaagcctgccacaatgtacacccttgtgcttacctccttaggtgggtgaacatttcaagggtctagactccaactgagaataggagagttacaggacatgcatattttcaaactgatcacaaatgccaagttgctttccatggtggttgcagaagggtaccaccagtagtgcatgtgcatacctagttttctaatggctttttagaggaactaattcactaaggaaatgtttgtaaatatataatgcgtgtaattcttctatgtcacagatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaagtaagaaatgattgttgtatatacgtgccatgtaggaaggggctgttttaaagagcatttttagtgccttgtgactagggtcttcattttagcctccaggcctgctatgctaatgtcttatacacatattcttttatattatagaaaggtatttactaaacttttctttttctcaaaaatcacagagcataaactacgtaagctaatagatataacgagaaaatactcattgtatttgttttattgataaaaagattgattcagatactatgttaaatttttactaaattttcctgtttaaagtatttgaaatgaaaagtctttaactaatcaaacgtgaataaaaatagagttgaaatgtttatcaatctaattagtcctgtgcagtataagagatatagaaaggtcagactcata

SEQ ID NO: 105480 - DNA, 2583 bp, Homo sapiens
gtgagccccaacgcctgacttaggttttctgttttatttaaactacttttccctacagtgccctttattttgttggccattttgttgtggcctccataataccttgacttactcccttcagaagatactaatgtctggatctcatcagtttctaaacattgatcattctctaaacaacttttacatgatcttttcccacactgaaactcagtggactctcttcaacatattcagtgttctaggcatttcctgaaaattaatattttctacctgatagatgataccgggttcttacaacctgctgcccttgctatttgtttccttttctaaataattccttggctgttaacattagctgctagcactaattcctacaagattcactggctgctgtttctctgtctagcattaggcgtgccacactttcgtcattgtttgttctttctcctaatgggaaaggtgttgccttaactacacttctccatcctgtggcatctgcttcttaaacatgacttctaatcccctttggcacactgtgtcacatcctgtgccttctgctgagttataagcttttgtattttagggctcgctttccaacccatttctcacttttcctccttgtggcccaaaattgatacctgacagagaacttagaaaatgtgtcctgttatttttgcttgtcaaacactgaagttgtaaagctaggcatggtggcatgcacctgtagtcccaactatttgggaggctaaagcagggggttcacttgagaccagaatttggggctttagtacactatgatcatgcttgtgaatagccactgcactctagcctgggcaacatagtgaggccctgtctcagaaaaaaaaaaaaaaagactgagattgttttcttattaacagatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggtaaagtctaaatacacatgcatgcacacttattttctttcagtgttcatttgctgtagtgttaatatcgataattcaattgggcattttactttaaatattaaactctcatagcagcaactactttgacatgaagagaaagagcatgcttctagctctttactaatatattcaatgaactaggtaatacaggtgttttaagcagttttttcctgttgagagtctattgaacttgcatagtaaattatttaaatttaaatttgataatcagagttgttaagacttttaggaagtataggtttgttaatattcctacttgattctcactatgtaaaaacaaagataaatcacattcatattataactaagatcaatcttaccctaaaatataaacaaatgtttggttcaaaaatgacatatcacatatggtataatcatggactatttgtttgggcttttgaatttgagccctaccatttactagttgaatcccttaaacagtctctgagctgtagtttactgaactggagaatgatgggaataatctgagagaatagagaatatctctgatttagagataactataaagttatgtgagagcataaactgtaaagtattctataaatgtttgacattacttattacctgaaatactccgttttacaatatctattaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaaggtaggtcatctgaacaatacctccaccttaaatcagtgcaatgtcattttattaataatggagagagtctgcatggtctatctccagatgcagatgacatcccatgcaggtaattaacaccggtgtcacactggtctttgggttactgctagcaatcccactgatgtatccccccagtggtagggtggggtaggaaagaattcagcatttgcaatcaaattcgaatgtgccattaactttagtcagggtttcctaacttctgagccttatctttcttttctctaaattggaaatgaaggtaatttacttgcagagttttagagtactaaatgagatagataagctgcctggtaccttgtagatatcagtaaaatggcagctattactacaatataacatgtcctcaaagttttcagtagaatagaaaccctaatgggcaaagaccgctaagggatcacaggtgccactggaaataacatgagagggttttgtcctaaataaccacatccctcataaaagaaaaaaaaatgtgtgaacaactgagaatgaggagagagaaaggaagtacacaaggaaaacaaaaggttgaggaggtgatactgatttcagcttttgtatccaattttttgaaggttaaaaaattttttccttagctgggtgtggtggtgcaggcctgtagtcccggctgtttgggaggttgaggcaagaggattgcttgagccca

SEQ ID NO: 105481 - DNA, 1028 bp, Homo sapiens
ttgtctcttcttgtacatttattctttgtatgaaaatagatatcagctcattaagtttatttttaaaaattgtattagaattttgcttgggactgcattgaattgataaatttatttccacttgggcatttttgtactgtgtctcaagggtactttttcctttcttttcatgaatagtatttcaattttatcctctctattcacaaaattattaaatatgccctttttaaatatgtgctaatgttttccataatcattttttgctgcagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggtaatgttttgttctagaaaaaataaataactggacatccatttaaatacatttgctttgttattttaattccctataagttacagtgttcaaaagtgcttagtattaaaatcatatctttttaagtgtgggtttataatcattcctagattggaaatcagcccactcttgctttttgtctctactttacaatctttagcaagtcattctccatgggtttttgttccttagtgtataaaatgaccagttggccactagctccaagttccagaactggtttatatagcaaagtgctgtatctgctaaaaaaagttaaaagaggccgggtgcggtggctcacgcctgtaatcccagcactttgggaggctgaggcaggcatatcacgtgagatcaagagtttgagactagcctgaccaacatggtgaaaccccgtctctactaaatagacaaaattagccgggtgtggtggtacatgcctgtaatcccagctactcgggaggctgaggcaggagaattgcttgaacccgggaggcggaggttgcagtgagccgagatcgcgcc

SEQ ID NO: 105482 - DNA, 1337 bp, Homo sapiens
ggttttctactgtccagtaaaagttggagtgggccagaccaccccaaaccccagtattttgtcctttccaggccatggaggtaaccgcttgcagccctgaggaagcttcttagaagtctcaagatggctctgtcatgtaatccaggattttaattttaatcacttctttcctttgtatttcaaagtgtctactttaatggaccacaagtgtaaatctgaaacattagcaatcatttagtatataaccttttgatgatgttttctggctccaaacaggcctttgatacctttgttcatatgaggttttgaatttgttttgttttgttttgttgtctctttaatgcagacgaaatggtggaatgtttgagaattccattaaaataaattttgatgactgaagtttttgtgttgcaggaacaaatgagtgctcttcaagccaaactggatgaagaagagcataaaaacctaaagcttcagcagcatgttgacaaactggaacatcattctacccaaatgcaggaggtgagaccaagagcacagcctcagaaaatgtatgaagtaccctcaaatgttaccttgaggaaacatcctcaaggatcctcaaacatccttgagtatgcatgaaacatattcagagagtatcacagaaagaaaatgttgtcacatggccttagtgaaggcttatttgagctgtattctctaccttgttacttagcatgctgctctgataatgagacaggcatgcatagtctaaacctggctgacttagtcaataatgcaaatggatcccttgctatgtgtttagaagaaaccaagatggactgtccatggcttcatagttgttaatcatctttactgtagttcatggggacagccaattttcttctggtcagagacgttaaagctagactttaaaaacagggacaggttaatggggccaggcacagtggctaacacctgtaatcccagcactttgggaagccaaggcaggtggatcgtctgaggtcaagagatcaagaccagcctggccaaggtggcgaaaccccgtctctactaaaaatacaaaacttagctggacgtggtggcgtgggtctgtagtcacagctactcaggaggctgaggcaggagaatcacttgaacccaggaggcggaggttgaagtgagccgaggtcgcatcactgcactccagcctgggtgacagagcaagactctgtctcaaaaaaaaaaaaagaaacaggttaatgatttggagtgcatcttagcatgccagtattccttttccagtaaatttatcttttttcccaaagcttttctcatcagaaagaattgattggacc

SEQ ID NO: 105483 - DNA, 1826 bp, Homo sapiens
tatatatattatagatgtatatatattatagatgtatatatattatagatgtatatattatatatgtatatattatagatgtatatatattatagatgtatatatataatatatgcatatataatatatgtatatatattatatatataaattgatactaatgtgacatacgatcttttactaaaataaaattgacttatattgccattaggaaagataagtgatttaccatttaaaaattttcttctccttaatgtcattgggtatgaagatattatttctgtcctcatcagaaagttgtagctgacctcatgaaccagatccaggagctaagaacatcggtctgtgagaaaacagaaactatagacaccctgaaacaagaactgaaggacataaatgtaagttcggtcaccaacaagatgttaaatttgagcatgggacacttcacagacttttcaagagtttaacagatgctccaccagaaaaaagattctgtggtcaaataagtttggaaattctagttaaataaagctcaacaggtttgtgtgtttgtaggacttgcagagtcattatggaagtgtgtagtatgtatctctgggggacaatgtaggctgcagtgtttctcaggtttcactgatctgggacaatgttctctgtgcactgtttgggaatgccggtataaactgaataagaaacaggctggttgctggccgtaacagttaaggcaaatgtggtgttttttagtggctttgaggaaaaagtaacacagtagcacattgcagttaagttcagagacattaattagaaagtgagttcgtttccgcaatattggacataatatcatttcctaaagttaactacttattttgtcagcatgtatctgagttcagtgttgatgcttttctcctctgggtcgaggcgaaggcttttgtcactcctcctcactcctctgctctacagggagcttgctgcactccatgtttatttctgaaggcagtagatgacaaaccctgtgtttttttcactgatacttagaggacttttccatttctcttcaccattcatgcacttattcttctattccttcagtcagcaagtatttattgaattatcttgtgttaatcttgtcatcaccttggaacccagactcattcttgttattttaatctagaaacaggaaataaaatggctcttatagcatgactttcttttctacagtgcaaatacaactctgctttggttgacagagaagagagcagagtgttgatcaagaagcaggaagtggatattctggatctgaaagaaacccttaggctgagaatactttctgaggacatagaggtaggtattaacgcatcacagcttctttgtttgccttattacttgtcaatatgtgtatttgtgtgtggaagttattaatgaataaatacaggatttttaaagaaataattcttatacagctgatgtgcctcaagacgcttcactacacaggctcattctacctctacctcactgcctgcacctcatgctgccaccctgactgcttgctgtgcctgagatactccacacacgttcacgctgccaagcttcctcctctggcagtcttatacatatactgtctcctttgaggagatagtatttgtatactactaatgtattattgtatagtgtataataatacaaatagtcatgtataataatttcaccaaaattattatattttatctagctaatctattttccgtcatttttgctgacaccacgttaacttcctataactgacccctgtaaggggagcagagtggaaactgcatttaattggatgc

SEQ ID NO: 105484 - DNA, 1086 bp, Homo sapiens
tttgatggtctatgacaatgaatcacaatctggtgcaaactgcccaggccctcctcaactggctgatggaggctcatcttcacagctgtttactttccagtatataaaggactagagtcaattggtgagacaacaacaagtaaccaagagacctttgagtcctccccaggagagggagattggcttgagatcctgggggtgaggagagaatgcaattagacctcaaacctagagtacagttaaacctcaattgggatacctatatatgtttactgtaataatgttaatctctagacctgttcatctaaatattaactgattactttgtcttagaatggattagcacacaagcaaaagaaataggtttttacataaaacttccttagtctgttaaaagttgtacatagtaatgatttgggaatccttattggaataccataattaagaaactgtgatgattgtctcctaacagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaaggtgagaaacacacaggtgtcactcaagatgggagacaagagaccaagtgtagtggctcactcctgtaatcccagcactttgagaggccaagggggtggaccacttgaagtcaggagttcaagagcagtctggccaacatggtgaactgaaaccctgtctctactaaaaatagaaaagttagccgggcgtggtggcgctcacctgtaatcccagctacttgggaggctgaggcacaagaattgcttgaacctgggaggtggaggttgcaatgagccaagattgcaccactgcactccagcctgggtgacagagtgagaccctgtctcaaaaaaaaaaaaaaaaaaaatgggggacaggaggaatccacagttgaggttgtcatgacattcctgcattggccaacttctccatgtacaaaggggaggctaatggagtatccttacctggactgagacttgctcagctgc

SEQ ID NO: 105485 - DNA, 1624 bp, Homo sapiens
aatggctgtgctaatttacattcccaacagtatacaaggatcccttttctccacaacctcaccaacacttaactttcatctttttgatgatagccatccctatcaggtgcgaagtgatatctcattgtggttttcatttgcatttccctgatgattggtgatgggaagtttgtcttttctatttggaccatgtaccccatattactaagttgtaaccttgtatctgttcaattttcccagctaaaccaaaagaaagaggaagtagaacagaagaagaatgaatataacttcaaaatgaggcaactagaacatgtgatggattctgctgctgaggatccccaggtacttttcagaaaaagattatttcaggaggaagaaacagttttgtaaatgataaaaatttggaaattaggaagaacatacctttgtctttttaaagaaaaagattttcactaataccctctgtctgctttttacttgatgaaagtagcagtcttttatttccttggaaaagaattagaataataagctaagcagcggatttttttttttttttttttttttttttttggcagatggagtcttgctctgtcacccaggctggagtgcagtggcatgatctcggctcactgcagcctccgtctcccaggttcaagcaattctcctgcctcagcttcccaagtagctgggactacaggtgcacactgccacgcctggctaatttttttttctgtattttagtagcgacagggtttcactgtgttgcctaggctggtcttgaacttctgagcttaggcagtccgcccacctcggcctcccaaagtgctaggattacaggtgtgagccaccatgcccagccgtagctagaatattttttatgtacttgacatttacgtttaaaagaaatctttataatatcacttaattggatatttggatgagatgtgattttattttagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggtaattggattttttttccagtaaatttaattatttttaaagagaccaagtctcgctatgttgcccaggctgggctcaagtgatccatttgcctcagccacccagtatctggcactataggtatatgccaccatgcccagccagtaaatttaatttttttttttttgttttttttttgagacggagtctgcctctgtcgcccagggtggagtgcagtggtgtgatcttggctcactgcaagctccgcctcccaggttcacagcgttctcctgcctcagcctcccgagtagctgggactacaggcgcccgccaccacactcggctaattttttgtattttctagtagagacggagtttcactgtgttagccaggatggtcttgatctcctgacctcatgatccgcctacctcagcctcccaaagtgctgggattacaggtgtgagccaccgcgcctggccaatttaattttttaaactaagcagcatcctcatggttactg

SEQ ID NO: 105486 - DNA, 1009 bp, Homo sapiens
actgggtcaggtgaaacgaaatcagataataggcaagtaaatccaaaaggatattccttgcagacaagtatttatttcttccagatagctatgctcatgattttcaagttaggatgcaattgagtattttgagggatgagctgtgacgtcaattttttgttttaattagaatctacgtaataaatagaatcgaatagttgagaacatttttcaatatagagatttttgtcatctttattcacaaaggaattttaatttttaatgaattctgtgatattgattttaaaaatctgtgttcaagacactgtggatgtgatcatgaatcaccattctaggcctccaatagcttgtcacagtctgcttttcatgcagcaatacccagtgcagtgtctctgcataggaacttaaaagaggaatacctgtctcagtggtggccttggggagctaaatgaagcctactgtaatgtgttttttgaaaagatacgatttgatgttattaggagcagttgcgtgaaatggaaaacctacgcctggaaagtcagcagttaatagagaaaaactggctcctgcaaggtcagctggatgatattaaaagacaaaaggaaaacaggtgagaaagaaccacgagaactctatgggctaaatcttggcctgcctgtgtggagttaaatgaggttggaattggtttcacaggtttcccaaggtgtacaatgtttcccactaatccaggagatggtcttttggttgattttgaatcaagtctgatctgttcacctttgcattgctctgcagtgcgtttttggcattgttgcatttgttttaaagtgattgaaatgaatttaaaacatgtgagatacttaaaacaaattacttatatttaaaaaaatttttttaaggtatatataatatcgacaaggttcaagaagccttgcagagaaagggagaattccctactagttggctttgcttcgtaactcatggtccagggaaagcccctgggcaggacaag

SEQ ID NO: 105487 - DNA, 1651 bp, Homo sapiens
acaacctgttttgtaaataaaattttattgagacatagtcacaccctgtcattttaatattgttgtggctacttttgcactacaatagctaagttgaatagctgtggcagagaccgcatggctcccaaagcctgaaatatttactgtctcgttcttgacagaagacgtttgccaatccttggattagtggacagaaaacatatctttccctaatgatttggggtatttcttcattgaggactcattaccatttttgtctgggctgccagatttgttaagggaaagaaacctcactgtagcttctgttttccttcaagaaatggtcttttactcaccagtgagagagatattcctagagaagcctacaacattcaggaaggttctccaaggagggagggagggatgtctctctggtccaggggctgcacacagaaactcaacttattatcctcacctggtcaggctcacagagatagatgtattatctagaatgtaattttcttactttatatattggaacattccttttccatgaagacatatctggtgcttgggacatctggccctggtgtccacatacacggaaaggcagagtggttatcagaaaatgccaactgactatggaacctgagcaaaagagagtcaaggactccactagcctgaggccagagcgaccctgcctacccaaaatgtgccccctcccagctgatcacattcataccaggctcttggctctttctttcagcccccttttgttcacattcgatcttcagatgttaccacttttaactaagtttctactgtattttactttcaaccaatccttgattatatttcccacctcatctcatcttgcttttgtactgggaggaatcctgagttctggggaagtgccttatttcatccccatgtgtcaatcacatttatcaactgtactgacttgacccaatcacaatagagttagcctttctttgtacaccttggcattgctgcatataatggatttgaatttgaaattgatacttgaatatacttagcagtgttttcctatgcctcctcccacccctgttaatctatgcagtgatcagaatcatccagataatcaacagctgaagaatgaacaagaagaaagtatcaaagaaagacttgcaaaagtaagatttttttttatgtaatagtttcttcttgtctgagcaatgcttttatagttagtatttatggtagtatattttagaaatcattttactattgaaattcctgtcttttctgcatttccactgtttagcatgatatttaccattagtatttagacacagctgagaattaagaatttgtcttcatgcctacatggcaagcctactgctcagcatgcacacatataattctccatttagaagcaagtaccaaggcctgtttgaagccttagagggcatagtgcatgaagtcttggaaataggtacttactttatgtatgtgtagctggcactgtggaaaaggatattggtttgattttattcacatgaaggagaatgggctggttcctttctatcttttttaagcaatgttatttaagaacctaagcaatctttttattttctttttttaatcttcttatagagtaaaatagttgaagaaatgctgaaaatgaaag

SEQ ID NO: 105488 - DNA, 1061 bp, Homo sapiens
attaatcagtgtgccttaaatttactggaaatttttataagtaattattatacttagggaaaattttagtggaaatgcatctcttaatgtattttaacctaatgctttttcttcagtcagctcatttttctgttgtacttctcaaatgagacaggattcagcatcaactctattcgtattttctgcttttatagatataaatgctgagaaatcttgttcacatagttaagtaaatggcaatgaaggagttttgatagggtactgtattccagttatttgaactttatgcaagtaaatatgtcaaaaattacatggtgatttaccatcaaaaattctttttaatgatcagctgacaaagaccacccaatttatgaaagatttgttacccaatcattgattcatttgcttcatagaatcagagtatacataggaaaacagccttttcacctgtgtatgagccattcagagtccggctcctagctaattagtggtaaagctaagtcagaaacccagattatttacaggatttttgagaatccagctagttggttgaattacagctattttagaactaatatctatttgaggtcttctagcaaaaagagtaaaagctatttaacttggtgtatagtttatttcatagtctagtaaccaagagtcttcatgatatgctgtctctggaacatacagcaggccaaacttcactgcgggcaagtgaagcacacttcagcaaacggcatgcactgttttatcaatcccagcctacaacagcaattttaaacgttacgttacccatatatttgtgaagatgcttttaaaagtaatggggaaccaatacaaagccaacaatgaattgggagagcatcagtgcccttctccccagactgtccttctgagatccacagaatgtagtccaaaaacaacttgcctagaaattagctggccctttgtgtattaaattttatgtattatatcatcttagcaatcaaccgctagaaattagctggctttgagtggtgtattaaattttgtgtattatatcatttcagtaatcaacagct

SEQ ID NO: 105489 - DNA, 1370 bp, Homo sapiens
aagattcagtacgtagtgcgactaaagaaggaaaatgtcaggcttgctgaggtaaacctaaaaattattctgaataaattctgtctggtttaaaaatgattattttattgaaaccaaattaaaacttaattattgaatcagttaactgcttacttcagggagcttcctgaattaaaaaaaaaaaaaaagttggtcgttgctattctgagcctaattcaatcagtggcatttcatagacagcagattcttgtttaacgtttagtttgcacattgaaaattccagtcttaatttgaaatatacacctaataaatgcaaaaaaaaaccacttcctgtaagaattagagccttattttttttctttttgtttttttaaaattacttaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggtttacagtggacattagccagatcattttcttcttagattatgccataatctcctttgattcttatggaagttctaacaatatatggtggttccaacacctgcagtgagtttaatgactgacttagtagcaggtacaagaagcaaacttgttaatatagattatttttgtattcttactttaggtattttcttgagcattttccatgactgtaaataaagccattttttaagataataattaaagtgacttacattgttcattctgttgttcattgaacacatacttaatgaacacctgcaatatgccaggcactaatcatcagtgaacaaagcaaatcttgccctcaaggaacttctgtgtattgggccttctttcttttttattgagacaaatattccattttatggatatgctacactgtccatccaacagctgatggatacttgaattgtttccagtttaggactattataaataatggagctataaatgttcatgtgtaagtcatggtgtggacatatatttcatatctcttgagcacatgcctaggagtagaattactgggttatctgaaaagcatgtctttactttttaagacattgcctgttttccaaatttaccatttaggtataccatttt

SEQ ID NO: 105490 - DNA, 1042 bp, Homo sapiens
cacaggagagagtcaattaatgtaagaaatattcaacctcacaaataatcagatgcaaagtaaagcaatgagattacttaaccactagattggcaagaatcaaaaagatctgtcggtagagcataaattgatgcaatcttttctcaaagtaatttggcactagcaaaatgtatctacattttgaccctgtgaccccatactgggaattcacttctcaggaatatgcacacatgtgcaagatatatgtccagaagcatatttctaagaatacctcaggcagactcacccatggtcagaggtctgtagtgaggagatgcccaggctttccaaagagaacttgacgtcagtcaaagggatggccagggtattcttgaagatacaattgcagacaagtagctggccaattctgcctgtgttaggcaactgtagtagggtggggaggagagatggggagagaagatatgcatgagccaaccaaggaccctcagggttcttaggggccccgtcacactccatggccaacttccaggcagaaggagccctttatggcctgcaggaagctcacctctatagagaactcagggtactggaaagacgtgaatacttcagaggccatgatttccttagactccacaatttccgcaatgatgaaacctctgataactggctcatcatctaatatagccaggctgttgatgtaggtcttggagtccaaggtcagagtcacttctgatactgccaaagagtcagggtggaggggagaggtcattcatcatacccccccagtatgagttctcctcatcaagcacagaattagattaactttgtgtgaattgaactggataactttggacatgtcccatactctctttagaaaacaagacgttgggctcaagatggaataataattggccaagttctccaagcttacatcctgagtccatgacagacattacccgttgtcatcaggacatcccacttgttcccaacactgtgccttgggtactcataatcattgatctgactgggcatctgagattaa

SEQ ID NO: 105491 - DNA, 1067 bp, Homo sapiens
aacttgacgataaatttcttgggtccagtttttattggggtgcattttatttgggattggatggtctcaccaggctgcaccgtcctggaaaattcaaagacatacggacatacaatcagccaaggatgttatgggaagagggagaagatgagttgggtgagaagccaggaaactgagccttagctcagcctctttgaaaagtcctggccattccagggcatggcacagtgtacctgcaccctgggtgctgctatcagttttctcagatgtaaagcaagacgggtgaaccagctggtttccagaagctcttccaactctgacatttcacaaatcttccctggagtcttgcctgactttactacagatgttcttgtttcatgagtattagcaacagtcatctattacataaaatctaagaggaacatgtattttatgttgaatccacatgcaaggaattggctagcccctcactactcaaagtgtgttctggggcttcgcaatactagctgagcttgtaggaaacacagaatctgaggctccaccctaaacctgctgaatcagaatctacactgtaacaatactccccaggtaatttgtgtgcacattaaaatgtgataaatcgtggtctaaggaaaataggagtctactcatttttacttggaagattcagacatcctgtaagaaacagaccatcagaaacctctcagaaacaaaacattagagttcagtaaagttttttgctggatatatcagcatgccaaaaatcaatttccatatagtccagcaaacaattagaaaatacaatgaaaaatattccattcataaaagctataatattgatgcatcttggaattaacccaactaataacgtgcaagtggtatataaagaaaacaatatagcttttctaaaggtgataaaaaagactggaaaaaaatgggaaaatctcatattcctagatggcaagacacaatattgtcatttggcataattctcccccaaataaataggtaaattcaatgcagtatcaatctaaatcccagctgttttaaaattatatgacaagatg

SEQ ID NO: 105492 - DNA, 1089 bp, Homo sapiens
ttaatgcattcacaatgttttgtaaccaccaggtctgtctggttccaaaatcttttcatcaatctttgacccttttgaagattgtagggcaggtattctgtaggctgtccttcagattgtgtttttgatgtttttctcatgattagattgaggttaggcatttggggcaggagcactgctgaagcaatgtgtcctcgttgcaccgtatcaggaggcatatggtgttgatacgtttcattattgtgatgttaactttgatcattgggtgaaggtggtacgtgcaatgtttcttccctgctattaaggtactgtttttccctttgtaattgataagtatcttatgaggatatacttttgagatccaatttttttaacttagaatttattcaaaagtcaagaatcttaaatctctgaaatggcgtgggaagaaaaagtgctagatacacagagatctttcttgagtcatgtgaaggagcagtgcccaagcccagcaaacccacagcaaattcccttggcttccagaagagatggagaaagcagtgcccccagtggagggtcaaaggcctctgtgcagggtgttgtgggcctggagagctggcctggccatgtctttacctcctctgggcatctccccaccccaacaccctttctgtggcctggtggctgagttgcagccgacacccagaggcaggtgagttgacagcttggaagaggctgcagggtggatctgctgcatgagcaggcctgagcccagccttacctccccacagtggtcctgtgtgccctccggctgcctaatgcatgttggcacttgctgtacgagcacccgcttcttcacctcgcatgctgtttgtgtcctgcactccttccttaaccccatcgtccttctgctgtgtttgcagcccctatctaccctggtgggagtggccaaaaatatttaggaggggatcaccagtttgtagtggcctcagaggatgtgtggtcccccttatgcctcagccactcatcagcctagcccctgcccatcatctggcattgcacttgtggaaggaaagaaggggagggctgggtggtgggtggagaacacgt

SEQ ID NO: 105493 - DNA, 1052 bp, Homo sapiens
aatatgtatctggcttaggatcacctcatagaagagaaagaattcacagtgaagcagaaacaagccactgaccagcgtactcccaacctgaaccttctttttctcaccctctccctcaagtaaacatcttgctgacttgagcagtgtgattgccgtagcaaagcagagtggcccccagggatcccgctctgttgggcccacaggaggagccgatgaagctgatccaaggagtgaggacaagcgctgcagagggacgttcgctaaaagccttctaggggccgcacatgctctaacacggacataaggatgccctgaatttctgcagctgaggccatatagtctggtgaccaagtatttgggtcctggcttcagtctttggttgaaatgtctgcttggctacttattaccgcacctactaccaaaatatgaccttgagcagtaacttctttaagcctcagttttttcatctgaaaacgggaatgataatctaaatcacaaagttaatggaaggattaaatgagggtgatgaataggaatgtatagcgtctggccctggtatggctttataaatgttagctgtgttggagctgtgcttttcaaaccattggtcacagccattcatggtttgcaaccagcatgtttttcaagaaaaatgtttaatgcattacatattgcaggataagtattgttttatgaagcttagggagttgtgtgtatatgtgttctggaatgcaacagaaaaatgtttcctcttgtgggttacaatatagaggtatgaaatctctgatgaggagagacagtgttatctggcccgctatgaagagacacatttgcataggctgctccctgaggctctggctttctacatctgatgatacagggagcagggaacagcctgttctcgttctgtggggctcagctgagtctgttctgcacagactcttccttcctcgggagccttagtcctaatacattcattttggagtgttggtgagtttgttcacagatcacagctcatgtgtcacccagactgacctgggccaaaaggccca

SEQ ID NO: 105494 - DNA, 1011 bp, Homo sapiens
ttttgccaagagcacaatgactgaggaatgtagccatcatttgcagggtagtgattggttcccagcctggcttccacacaggacaggaagggaaagcatccctgagctctcctcagtatttccggatgtaatgaaagaggacatctttctacacaaagtcagccccaacttttggcttggtcacaggagttctgatagtactgtttggtgcactcatgggaaattgaaccagtcgtagccacagtctttcagagcctgggctctggggagtggaagtgaaaaataaagatgtggcttgttggattgtgatccccagcttgctttccttctgtcaactctgtcaggtttgtgttcatagcaactagactgaatatgcaaaaggcttagatccaagcaaatctataatctatgcatatttgcatgggcttggtaatatcatgtacacaaaacacatttgggtagaagtgcatgtgctaaatctccttttagtcccaccattttgtcttcttcatactgtacttcctcttttttgtttgagacaaggtcttgctctgtcacccaggctggaatgcagtggcacaattagagctcactgcagccttgaactcctgggctcaagtgattcttgtgccttggcctcctgaatatccagggctacaggcacgtactaccatgcctggctaatttttttgttttttaatagagtcagggtctcactgtgttgccctagctagtctcaaatgcccggcctccagcaattttcctgccttagcctcccaaagtcctgggattacaggcgtgagccactgggcccagccctgtacttcttgaaaaagccccaagtattagcttttgctcatctggctaggccacttaaatagttagaatccaccgtcccctaatgcagaaaccgtttaggtgaggtaaattaacaaacattttaagccgggcgcggacacttctcactgtggacatccctcacgcctgtaatcccagcactttgggaggccg

SEQ ID NO: 105495 - DNA, 2469 bp, Homo sapiens
aaagctggagggccctgccccacctgggaaggggtgtcttccctttggcctgtgcccttcccaggtccctaggctgtgaagaaagacccagactcagctgtcctcccagcacccctttactagagaccacagcagacagacccctggccaggcttctgccaggctgctcctgtcctttccctctgggcaggggccccgttctcaagccctgccctttgaccagctccatctgaagaagagagagagggaggaagcagctctttccccagccccagttttttcctgagacttagcaggggaagcagcgctggctccgtgacagctgctgcataggtctgcgccatgcttctccccaaaggagccactaggaggacctttgccatgccatgctggctggcctggccatgccaccctctaacctgtactaatccctcctccttcctcctctggtgacttctcccctcattcgtggtctgtcactcctattcaaccttctcagtttgtgtctcaccaggcccactaagcggggtgctgcttgatcccccaggctggtgagacacacaacgccagagcagtcatttgatttgttactttttttttgtctgcaaggtggtcatggtagcttcaaacttcctaggaacctatcccaaattaatggccatcattggttatgatgattgcgagctccccaacagctctgaggcctctcacgccaaagccttcatagtactccatccacagcccagcacagagtttctgaagagtgcctctgcagagctcaacaaggggccagggctggagagacgcgctccttatcttagcgacacaccccggcctggcatacttacaagcagcagtttctgcgctgctgatagtgcttctttttccctcccttcttggagggacttgtgaatgagtgcccaccaaaaaaaggagaaatttttttagtaacactttttatgagaaagatatattaggtagatagctttgttgctttaaaaaggaaacatttactccattcacctgtcgctgcggacatccctccccagaaaccacagcaatgcagtgcttgactgaaagtatgattgttcttgttttcagggaatagaacaattgaaaaaggaagagagaagatgggctaaaaaaacaaaatggatgaacatgaaagccgtttttggccaccccttctctctaggctgggccagcccctttgccacgccagaccaagggaaggcagacccgtaccagtatgtggtctgaaggaccccgaccggcatggccactcagacacaagtccacaccacagcactaccgtcccatccgttctcatgaatgtttaaatcgaaaaagcaaaacaactactcttaaaactttttttatgtctcaagtaaaatggctgagcattgcagagaaaaaaaaaagtccccacattttattttttaaaaaccatcctttcgatttcttttggtgaccgaagctgctctcttttccttttaaaatcacttctctggcctctggtttctctctgctgtctgtctggcatgactaatgtagagggcgctgtctcgcgctgtgcccattctactaactgagtgagacatgacgctgtgcgtggatggaatagtctggacacctggtgggggatgcatgggaaagccaggagggccctgacctcccactgcccaggaggcagtggcgggctccccgatgggacataaaacctcaccgaagatggatgcttaccccttgaggcctgagaagggcaggatcagaagggaccttggcacagcgacctcatcccccaagtggacacggtttgcctgctaactcgcaaagcaattgcctgccttgtactttatgggcttggggtgtgtagaatgattttgcgggggagtggggagaaagatgaaagaggtcttatttgtattctgaatcagcaattatattccctgtgattatttggaagagtgtgtaggaaagacgtttttccagttcaaaatgccttatacaatcaagaggaaaaaaaattacacaatttcaggcaagctacgttttcctttgtttcatctgcttcctctctcaccaccccatctccctctcttccccagcaagatgtcaattaagcagtgtgaattctgactgcaataggcaccagtgcccaacacatacagccccaccatcatccccttctcattttataaacctcaaagtggattcactttctgatagttaacccccataaatgtgcacgtacctgtgtcttatctatattttaacctgggagactgttgtcctggcatggagatgaccatgatgctggggttacctcacagtccccaccctttcaaagttgacatatggccatcccattggccagaatccacagacacacctaagcctgtggcactgggacagaatagattttccatttgagaggcacttcctgtgtcagtcttgtttgaaggaggt

SEQ ID NO: 105496 - DNA, 1057 bp, Homo sapiens
gccaccttgcttcagggccttcccctccctgctcacccccaccatctccacagcacctttgcctttctcttccatgcgctgggtttctgacttagactttgttcagacaaaagattctgcttaaaagcaaaccatacctctagtcaaatctcactgcttcacagtgcagtgggtggaggcctgaagatggcaggactggcctcaggtccccggggctggaggccaggacagtgaaagtgcctactctgggcccatgcctctttggtcgactccctggcctttggcactgttggcctcggtgctgcaaatgtccctgggagcgggggcagtgcattacctcacactgtggtcaaggctgagacccagtagttcagctgcccctgccaagcttaaaatcccaaagccaccaagtgatcctccacagctgcctgtgagctgatggggcacagaggggcagcacgtcatacaggaatgcccagaaaacctatggccatagcaggactggacaggcctctccacctgtgtacctgcattgtgctctctgaggagagcagggtcccctgtggtgtcgtcaggcgttcatgcctcacttcagaggccttcctgggcccttccatgtgtcaggcactgtgcttggcactgggggcagtgaacaaggaatgatttgtgttagggaagggaagccctggctggggcctggcctgttgaggaggcctccctgagggattgagagatagccagtgtgggccaggatgattctcaccgtagcctggaggccagagacctatggcacccaggaggaatgaaggcctgcaagcaggaggcagagtgggcgcctagtggggcagtgagcctgggcagcaggcagtgggtgacagtaccaatccctgtgtgctgcttctctttcagagtgcagctccttctctccacccaccacagtgattctccttatcctgctgtgctttgagggcctgctcttcctcattttcacatcagtgatgtttgggacccaggtgcactccatctgcacagatgagacggtaagcaggtggctctg

SEQ ID NO: 105497 - DNA, 2554 bp, Homo sapiens
cctggccaacatggtgaaaccccatctctactaaaaatacaaaaaattagctgggcgtggtggcgagcacctataatccaagctactcgggaggctgaagcaggaaaatcgcttgaacccaggaggcagaggttgcagcaagccgagattacaccacaccactgcactccagcctgggcgacagagcaagactctgtctaaaaaaaacaaaaaacaaaacaaaacaaaaaaacaaagaaaagaaaagaaatcaaagaattaatgtggcctaatggcatctcctcagaaaaatttttggtcaataaatattccttaatgttggcataattctgaacacagagtccacatgttgttggtatcaaagtgtcctgtccatgtgtgtgtgtggttgctgctttcaaataactatccccactgtagaatgttagagctgatagaacccccagcccaaccctgatacctttcatctttcctacagggggcagtgcccaaaggaaatgccactaaagaattcatcgagagtttacagttgaagcctgggcaggtggtgtacaagtgccccaaatgctgcagcatcaagcccgaccgagcccaccactgcaggtacactcactggggctcgcctcctctcttctcccactgtcctgcctccctccatccccgccaacacctgcctcctggagtagcacacacttccccaacaggggccaagtcagcatcgggattccaaatgtcccctgctctgggcagagagtgatcactgtgagtctccttcctggtccctgtgagccctctagattgcaaagagcatttggtttggcctcaggacacctgtcccgggacttggctctgccacacctgacataggacctgggcagggcctttgtttttatatatgtaaaatggaggggattcctgcttttcctacctcacagctttattacaagggtaccatgagaaaaagctttagaaaatcattctgtgaatgtctgggacttgaaatgaagcggttgtccttgaatgaagactttcttttaaaacttctaaaggttatgatagttgcagaattaaaccaaaaaagaaagccatttccccatcttatctgtggtcagttttctgttttgttttcaggtttctttattaagtttttctgatgagaagacatctagctaaaagttgtactttattggctgggcacagtgacttacacctgtaatcccagcactttgggaagccaaggcaggaggatcactggagcctaggagttcaagaccagcctgggcaacaaagcgagactctatctctacaaaaaaatttaaaaattaggccgggcgcagtggctcacgcctgtaatcccagcactttaggaggctgaggcgggcggatcacctgaggtcaggagttcgagaccagcctgaccaacatggagaaactctgtctttactaaagatacaaaattagccgggcgtggtggcacatgcctgtaatcccagctattcgggaggccgaagcagaatcgcttgaacccgggaggcagaggttgcggtgagccgagattgtgccattgcagtccagcctgggcaacaagagtgaaactccatctcaaaaaaaaaaaatttttttttaattagctgggtgtggtggcacacatctgcagccccagctgctcaggaggctgagggcagagcatcgcttgatcccaggagtccgaggctgcagtgagccaaggttgcaccactgcactccagcctgtgcaacaaagtgagaccctgtctctaaaaaaattttatttatttattttgagactgggtctcactctgtcatgcaagctcatagctcactgcggcttcagactcccaggctcaagcaatcctcctgcctcagcctccagagcagctgggactacaggcatgcaccaccacacacaaagggagacacagtctcactttgttgcccaggctggtctcgaactcctgggctcaagtgatcctcccacctcagcctcccaaagtgttgggattacaggtgtgagccacctcgactgacatacaaggaaactttacatgctgaattacagaaatacaaaaatatcacttggtccccttttcagagggtatgtgtttgggtggggaggggttatagaggactgaatctgctccaggtgttggacatcttccttgtcaggcttagcctgcggagacatttgggtgtgtgagagatctgaacggcgatttctgcctggccttgctgcctgtctttcagaggagagtggccagtctccagcactcagattccggagtcagctccccagtacctgtgtgctgtgcccacggcacctcagcctgccctgcctcagcgtcagtcatctattttcatcttcctactcacccctggaaatcgggattgctgcagggatggcctccctagataaagaaattaaggttcaaaggggttgagtgctccacggtcacacagcagtgagtactagagacaggtttgggtcccggcagttctggctccaggtccagacagggctctttccacaggaactcca

SEQ ID NO: 105498 - DNA, 1075 bp, Homo sapiens
ccactcgcaaatgtagagctcagatttaaagcaaggccaggggacttccaagccagctctaaccctttgtgctatgccactgactgatcttctctcttacttcttggacctatattcccagctaccttcctgggtgtccctcaggcacttcagactcagcataccctaactgaactgatcagctcttctcagaacttccttctgctctcttaatggttttgacgtgccaccacttaccagctgctaaaaatggaaaccctactggggctcatctcctccctttttgttaccctctccaccacccaataacaagttggttccctaccatcatttgtagattcagatctcagaatttcctctccacttctcccgctccatcctcgtaattcagtttttccttactggaccatcaacaataacctcctacgtggtgtctggaattttcatctctccctcttcttatatgatccacataacacaggcaactgagctctcttcctgaagcaccagtgttacctaatggctctaggctacctataaagaaaaatcccatcccaacctggtattcagcgcaccacatgggctggccccggcccatcggtccggcctccccgctgacactgcatacgcacagttcagcacactgatattctccctgtctcccagatatgccatgctcaccctcacctctttgtcattactcatgccctcctctgctggaatcccttttctcccacaggtctacctagccagcctctatacattcctcgagacaacccttgaacatcactacttaaaactcctctgattcccctgattaattggctgctggctcctctgtgctccctcaacacaaataccttccacagcatgtaacctcttttactagaatcgtttgtcagcctccaaaacactataagtcttggaagcagggacctcctgtgattcctgagtccatagcagtgagcatgagagcacagggctcagcaccaagcaggctcttggtgaaggttggttattaagaccctacttaggcctgtgcactgcctgttttccttctgtttggatgggtgca

SEQ ID NO: 105499 - DNA, 2093 bp, Homo sapiens
ttataaatcccaacaggaaaagctttctggcttcagagggaggaaagcagcccatttggggaccaactagctaccttttacttttctgtggaggagacacatggccagtgatgcaggcctggggttggttaccatgctcctgggagagctgttggagtttctacccagactggtgggtgtgcacgggctttgatcccatggccctgaaacaatttaagcaggttttcattcttgttgcttgaaatggatggaatgttgagtccttgaaattattggcatttctttagaacctgtctccactactttccattgtttctttttatattatcatattatcctagatacttattgaaacagccttagtatcctaggcctgtttcaatcttaatactagtgtgctgaggtagttggtggtggtagaatgatgttgtgacatcaggcaattaaaataaagttttttccaagtcacttaacagaaatacctggtaatgatatgtttgtcttctgatagtgacataggttctagacttggattgtctgggtcagaaccctacttctgccacttattagctgtgttaccttgggaagatgcttgacttccctgcctttgttacctcatgtttaaaatggggaataccacaatctctacctcataggtttgttgtcagaagtaactaacacatacagttttgtcacaaagcatttggaactatgcctggcctgtaagtgctcaataaatgtatcattattcagcttgagttattgaatacattcttcgtgccaggccctaagcagtttgctgagctacaagttgacagatgttgtcttgtcctccaggaatgtcttgtgatgtaggagagatggtgtgtaattaaatgacgtgttccatactatacatacaagctgtggtagcacaaaggctaagtaatgggttctgccttggatgtggcctggggccatgaggaagtagcagagaaggtgatccctgggtgcattttaatttgggtgctagaagcaaggaggtgcctggcaagttggagcgggtgagggtttggttggtgcttaaatggagcccctgagggtagaaaggaaaacttagaatgttgcctttgggaaactccaaatagaccacagggagggactgtttacggagggaggtggcactggattggtagtccagagctgagatatggtggcctcaagagccctgcccaggagcttggactctggtccatggtccctagggagccagtgaaggttttaggccaggggaataatgtgatcagatttccatttaagaaagtttactctggaaattagttgggagaaaggatagaagtgggttgcaggatttgagggagagactagaggcaggaagacctgggagatgctctaatagtctggggcagatgatgatgggctgaactaaggcatgatgatggcatggaggggagagcatgggattcaaggcacagtctgaggcagaattaacctggtggagtgaatgggatgtggggaagaggattagaggaattggtggtggttactggatttctaccccaggtgacagggtacatggatatgccatgggccaggaaagggagacttgagggaacagtttggggagaaagcagcaggttccgttttagctgtgcacagtgcctttgggacagccaaatagagagatctgcagattcaagaggtctgagttggagcttgtgattggagcattatcaccgagtgatggtggaagtagagttgaagattgttcaggagagagtgcagaatgagcagggaaggaaggagtcttggggtgaaaccctgaaccctgaggaacaccagtagcctggatgggcgggattccaagaggaggggagaggcacagccccacagacagggagaaggacagtgaggagaccccaaggaagacaagggctaagaattgacttttggatttggccacagtgagttgctcagtgacctggtgcgaacagttccctggtatggaggggacaggtgcatgaacagtaagggagaggtcagcagagacatcaggtgcacaaggcttcaagcagcttagctatgaaagggca

SEQ ID NO: 105500 - DNA, 1008 bp, Homo sapiens
catagagcttgaaaagaaaagggaagtgggaaatgactcacagatttgtaaacagcccccttggaagtgagacagccgtttgagaaatagggcaaaagggacaggtctctaaacagagggaggaggacaaatggacagaggagcagggcaggtgcctcacttgacaggcaggctggcctggaggcagcatgggtgtgggcaggagcacaagtcaggctcatgtttggtctcctgacgccttctccttgcccactctgaggttgtgtaatgtcattataggggctttctgtgttctggaaacactttagacgtttataagtctagaatggctccatgtgtcctgaggaggcagcctcttgaagacaaactggactcagaaacccttatcttactacccttctctctcttttcctcatttcttggtttcaccaccttttcttttccaaattcctcattctctgagctccctcaggaatcctgaggggcttctttatttctgagacaatgtctgtctcccagaagatgcttaaacgtgacagatgtagattgtttctttttgtcctggctgccaggaagctcaaagccaagtgttacacaatgacagtaattgtataaacccttatgatcagtatatttttgcccctccttttttggatcttatcgtttattaacttcataaattatttcaaatctgagacttgagaaaaggaggaatatacagtcatgtgtcacttgatggggataagttctgagaaatgtgttgttaggcaatttgaccattgtgcaaacatcatagactgtacttacacaaacctagatggtacagcctactgcacacctacgccgtattgaatagcctcttgttcctaggctacaaacccatgcaacgtgttactgtactgaatactgactgtgggcaactgtaacacgataatatttgtatatctaaacatagaaatggtacagtaaaaacatagtattataatcttgagggacttgtcattgact

SEQ ID NO: 105501 - DNA, 1049 bp, Homo sapiens
aggcatttaccctttagaggctccctttttattatctgtcatgtgaaggccctgtttcaagaaggctaaattgactctcagaatcagggaagagaactcatgttttaaatgaacaaggtgattaggtggctttgcacacaggggttgcagataagtaatcacaactcactatgggagcaattttgtcaaacctccttgatgacaagacaacaccaagtttctggattctttcctctctctttcagatgccagtatggacagaatagcttatgatgcttatccccacccaccacttccgaaacattgagcggaaaccagaatacctccagccagagaagtgtgtcccacccccctaccctggtcctgtgggaaccatgtggtttatccgtgacggctgtggcatcgcctgtgccatcgttacctggtttctggtcctctatgcggagttcgtggtcctctttgtcatgctgattccatctcgagactacgtgtatagcatcatcaacggaattgtgttcaacctgctggccttcttggccctggcctcccactgccgggccatgctgacggaccccgtgagtatgtctgggcttgttttgaccagcccacactctcctcctctggctctggcatggccacagcctgcatgttccccctggaccttgggaacttggaggataggagggccaggggagggtgaggaagtagatctctgccttgttcagagttctgtggaattctggccagggaagaggggtcaacacctgtaccacagcctatctgtcttggttaaatgatactataagtacatggatatatacattcattgggcctgctctgggaggggtttggtctgggggaaacctggcctctggttaaaaagacacagataaccttgaagactggggccagatgatcagagcagaaagcatgctggagggttgggtcaggattgggcttcccagtgaagacagtgctggagctaggtggacttgaaattaaagccacatccaattccaggaacctgcacggaaatggccttcactttg

SEQ ID NO: 105502 - DNA, 1073 bp, Homo sapiens
gtcatgggaaaacagagctcctctgtacactctttggtcccacgttgtttgaagatagaacattccggttacttgagtaagagtcagtccacttacctcatggtcctacttgacacactctccaccatgcagaatatggtcacagtcctgaaactaagcagacagtgcctctaagaagtgggcctgggatcacaaatctcatgcattcatttaatcaacacatgtattaagtggctactctgtgccagccactgggctaataagtcctcctctcaaggactatatggtgaagagcttagcagttgttccctgaaggcctattacccaaaatgactacccttttgcaaataaatctaacaagacttagtttatttgcttttctagcccacagccaattagcagtagtaaatagaggatatgtgggtatgactggtgaccgtagacacagaaatgagtaggcaggaatggaggaggaagacaaaggatcatatacagagatgccagaacggcaattataacagtctgagcaagccagttgatgtgaagccgagacccagtgaatttcagtagccctgaggacatcattacctaacacactccagtaggtgatgttcctggtaataactctaaataaatcattccagaagaaatggttgattattgtgcttaagggacaaacagctataatacccctcccctccccttccttccttccttccttccttccttccttccttccttccttccttctctctccctttctgttttaagatttccatcttaaccatccaaatgattaaagtgtgtttctacttggaaacaagtcacatttatctgggaagttacttacgtggaagggcttattcctcaacaaaaccatgcacatgaaacataactcttgtttagtcgaatcattgtcataaatacaatcaagaatgaggaattgtcattcttgattgtatgaatgcaaccactctgaatattctgtgaatataatttaatcactggaagtctctaaggagaattgctctaaaatttattttcagtgattatccatttatgaaaaccatacc

SEQ ID NO: 105503 - DNA, 1031 bp, Homo sapiens
acccagtccctggggctcatggagccccagactccacttcactaagtatatttgtgtctgtcagtgtgggttagtggaagagcacacttatgataaggtataatgaagcacgtgtgttatgtatggatctggaggcaattctctggaccacaggcagtttttgttgttgcttttagaatagcactaatttcaggcatttcttggttttggtttctagaactctatgaaggaatactagctgatttcctttgacttcccacacactgcccctcacagagctcagatcatcattttgacaccacatcttatcaggattgctggcactagggagctccagaacacctctgggcctgtggatccgtttcccctgtgacttccttacccccgcccctccccaggcttagttcctttgcctttctgggcttcagtgaactcttctatcaggtgaaaataataattactttgaacatggaatactaatatatggaggcgctaactctttttaatgctataaaacccttagccaaaaaacttcaatatagattactataattcaagttacaaaatgatcattgttctagatcttccttggaaaactattagccacttagaggaacagaaaacctaataccaccaaaatgagactcaggcctgttgcccttgtgcctccctggacttgtcggcctctggacgcagacctctcatctgtcttgcctgtcacttctagagtggtcttgccacagcatgagtactattcctgcacaactttcctcagaaactttatggctcaccagtacctttcaggatgaaatcccatctcattatgaagtttagaggctttctaaaacacaactttctcctacctataaagcctcatctcgaatcacctcctctctttcctacaaagcctgcatctgtccacagacacgcacacagccctggtcatcctgcccctcctcttccccactagtaccaccaattttcctgccaggcccacccggccccccttgcctttttgtaagcagtatgct

SEQ ID NO: 105504 - DNA, 1163 bp, Homo sapiens
aaggtgctgggggaaggatgggctgcacaggaccttccacctgatttgtgatgtttattttctgtcattgaaaagttaaacgggtgaaagacctgaagcaagtatggcagagggtgatcattggtactgtgtggtgctgcagtgttttgcttttttctgtttaatttctcaaaaaagtcagtcacatatgcagttagccaggcagtttaaagataaactgtcagtcacatactttagagcagtgttttattttattttttatgtttctgggaagcatcaactccttggagaatctgattaagctaatgattctttttctgaaaaaaactgcttttgaaaaatgtttacaaagaatgagaaggagctccatgagccaacgtggaatgatttcctgcatatatatagttaagtgttaaaaaaaaaaaaaaaagtaagagtatctatagtattccacccttcatataagaaacaaggagatattaaaaaattcatgtatttgcttatttgtgcagagaaaatacaagaaagataaacctgaaactgaagagaaacctagggtgaatgggaagaaaggggcatgaaaatagcataatacggaggagagtgacatttctctgagcatacttttctgagttttctctcagaactatagtgatagctcacaaactcagaaagtaaataagtaattaaaagtaaccatgatgtgggggaacccaaaatggaaaacaaaaatttacaaatgaaaattagccaggcatggtgatgtgcctgtaattccagctacttcagaggctgaggcgggagaagcgcttgaacgcaggtggcggaggttgcagtgagctgtgccacactgcactccagcctgggcgacagagccatagtctaaaaaaaaagttacaagttacaaatgagcctgtgttacaagtgagtaatgtaaccacactgaagggcacgtagaagaaaagaactgaagtaactggaaaacagtattttgcctggatactctgaggctaaagacagaactttacacaaatactgtgtgctattagtaaatttgtttctcacaggggtatgggttagaagttcagaaactgtgtatactaagattgaacaaatacagaaatacatgttagataataagagccagctttctccttctttga

SEQ ID NO: 105505 - DNA, 1141 bp, Homo sapiens
tttggaacactttgagcagcaaaataactaatgatagtagtggattataaccatagcataaaagataccaatgagttgtactgatacaagtaattgaaggagtaaataaatgggcagaaggaacaggcagcgcgtagaccaccctgaaaaccatcttctgccaaaagagtcagcaaacttcctgtaaaggactggatagtaaagatttggggccttatgggtcatatctctggcccaaccactcagctctgcttttgtagtgcagaaacaatcatagacattacctaaacaagtgggcatggctatgttccagtaaaacttatttacaaaaacaagggaccttagtttgttgaccctgttctagagactgcctctttagaagattaggtgtctttcactatttacacagtagatcttgttgagttttaggggtaggagggcttcagttgagatgattgtactctgtagctctgacaacatatacttcttggtgcaatttaagaattgcagatttagagagaggtggcttattttgtctcttgttcagatcttgtttttgtgtgcatattctatatagtggtatgtagtatagattttgcaatcagacacaactggcatggaaaactagctttgttttcactagctgtaggaccttggacaagtcgctcaacttctctgagtctccatttcctcatatgtaaaatagtaatgttgttgttagctacaaggacagaattttagatgatccactaagaggaaaagagatattctgcatatatcttctctagggggaaaatgggtgagtccgtttaggagttattgttgatctggggtgactataggactgtggttgttaacacctaggaagacctccgtgtggatggccgtggctgtgaggactaccgatgtgtcgaagtggaaactgatgtggtgtccaacactagtgggtccgccagggtcaagctggtgagtactgtgaccatggttcaagcccaggtggagaaatgagtaggccctaaggaatgagctgctgacgctgtctggcttttggaatgcaaattgctcttggggaaatcgaagatccgagccaaactcagggagggggggtctatccagatctgaaaagactgctcacctcctc

SEQ ID NO: 105506 - DNA, 1035 bp, Homo sapiens
tggcacactttaccttctttaagtggctcagctaatgtaatcagccgggcaagtagaatcaccatgagagagtcacaaaaccccatttcctacagagatgggagaggttaccaagcactgatcgctgccacctgtatcagaacctcaattgagtcttcaaggagcataattattttaattgcataaacaagtgtgtccttttattctgaatcagtgaataggaatggcttctggacacccgtggatgtgcccagcaataagggtgccacacacccactcccacctggactccaggcatagggcctctgctggagagctcaaggcatttgcctatccacaggctgaaacatagttgctgcccagtggaaggaaataaattggtggtgatggtggtggtgatggtggtgagggtttcttctgctgctctgagtctagtttgatttaacttcttgttagcaacttccagttttaattaaattgccaggggtagagaggtctcagaaaactaattgattttctgccaacccatttcacttggttttgtctacttgggatgataatacatggagccaagatagacactgtcgccacctccataatttaccctgtttcttgggaatgacgaaaaatctttgatatagccctcacagccctttggaaagactgctgcactgaccctgagccctgttccagagatgcctggcagcactgtcactaaactgggagcaaaatctgaccttttcatgtctttggtttgctggttgtagctgagagtaggctattttaaatgagaatttggaaactttaggaaaaggtggtttctatctaaagcccaaaggaagggaagattttagtgagctggtgtgtcaccctgcgctgccactaggcggcgagccatcaagttgcttctcagttctccgaccattgtgttgatgggtttaggactgtggtttaacctcttagagaggcttgggtttttaactaggggagtttaggagaacatttttcattcataaatgtttcagaatactccgc

SEQ ID NO: 105507 - DNA, 1021 bp, Homo sapiens
ctagatcactttttctgctgtgggcctggcctgacctggacgtaagacttcatagatttgtaggctagattgattgccaggcaagcaacagtgggcccagtgtctagagtccctttccaggtaggcatggccttgatctcagcctaccccagttaaaccagagatgttccaagcaggagggtagaggtgatgagtcagaaggggtggagagctgggaggggtagcattcccaggatcttaattagtttatccagctcagtaaacaatttcccacaactctggaagagggactggtcatgctttatgaagggtcagaattggttttggtaaatgcagaaagcatttggttttatgcccaaaagaccaagtgtgtacaccccccactgaaggagtagattgtgatgcatatgagcaggcagctacaattaccagcctgtgttttctttctctctctaacagagcagagcagctttttatttagggcttccttggtcaacattccttgactccaacatttgttgtctagtgataagttccaagaccaaagcatacattcatttccctgaggcaaaaggtaaaaccaaggaaagtgaacctgactaatgttagactataaaccaagcttgccaaattacagattcaaggagagtacagggaagcatagaagataagggccaggctgcctgggttagaattttagcttaccaggcacagtcatcatgtggccttggacaaattacataacctctctgtgactcagttttcttgtttctagaatggaatccatacctcctagggttgttgtgaacattaaatgagttaatacacctaaagtactaagagtggtgtctagctcatgctaaacattaaaaaaaaaaaaaaaaagataaggtctcccttcttgtaaaatgagagagttagaccatctggggtttcacagtgtcatcccacaggtcagatcccacctgggagatttttgtttcatgtagggattttttttttttttaaggtggaccttaaa

SEQ ID NO: 105508 - DNA, 1036 bp, Homo sapiens
gcagtggtgcgatctcagctcactgcaacctctgcctcaggttcaagtgattcttgtgcctcagcctcctaagtagctgggattacaggcatgtgccaccacgcccagataatttttgtattattagtagagacggggtttctacatgttggtcaggctggtctcgaacccccgacctcaggtgatccacccgccttggcctccgaaagtgctgggattgcaggcgtgagccaccacgcctggccaggggcatgcatggttttataggtagattaatttagacagttggacctgggaagctctataaatcatctcccaaggctgtagaagagttagtgcattaatcccaaagaaattagtcacacccaggaggatgtgcccactacattcagggaaaggtaaacattttgagtgtaagcatctctggctggatttgtgtacacagaaatctctgtagatgtatttttaagcacttaagacctgggacttaatattgattgcttagtgtttaaattagaaacaggttgtgttttgctggctgtgcaaagtaaaaacctggtccctgttgacttgattatttcaccataaatgagctgcttttcttggctcagtgcctgagtccagcaaaggcagggaacagcgaggttgctatggcagtaatgaagtctctcttggggactttaaaggggattctgctggctcacagtggtaaaggaggagtacataattagagaggcaaaattttatgtaacaacatagtctgattaatttgggattcattcttccacctatattactaagtgagatttcttttagtgttacacaaatagggtgggcactgccatgggcgttcacacaggttttgctttgcctggaatcttcctgcctctctggcctgaccagctctgctcatcccaggtttgaggtcgcctttaaacctgaatgctaattgacactcctgtgcccctactcccgcttctacctcactgtttgctccctatggtgaaactcccctacctcactggaactgctggct

SEQ ID NO: 105509 - DNA, 1048 bp, Homo sapiens
gtagtattttatctccccagattatatttttagtttttaaatgatgtcttctgatatacagaagttcatgatgttataattgaatatgtaacttttttctctttctgtatcctgttcaagaaatagttgtctactccaaggtcatgcagatgtttttttctaaatgctttattgtcttgtcttttattttttatatctatggtctatttggtatggcttcgtgtgtgtggtgtgaggtagggattgagattcttttttttccattgggatatctgattgacccagcatcattttctaaaagatgcctttcctcattgcactgcggcgcctcctgtgtgcttttgacagggatgacagggatgaggatgataaagaataggcatagcgtgtctttctcttgtgagacacagggattccaactcctattctcaatcttaaaaagaagttatttttcctcctccaagtgggaattttactagtgcttctgcttccaggataccaagggttcgagttttggaggatgaagaggggtcgaaggacattgaattgtcagatgacccttatgactgcatacgactaagtgtggagaatgtcccctgcattgtcactctgtgcaaggtataacttgtattttatggtttttgtcttccctgtgggtgtgggtctcctctaatcccaacctgctgaggttacttaataagttaagaagttgtaataccacacaccatatagaagtagcttttacccaaatccaataatttggttatactagaaaccactaccacgagtagctctttcttttctttttaattggaagatatgatgtggtcctgggagccatgagtgtgtttgtagtaatagtagccagagtttgttaagctccttccacataccatgtgcttcactaaagcaccatgtcttttaattacctcaactctatggggtctagggtggttgagtagtggcagggtggcgaacactgtcccccctatgaaatgggaggttggagcaggtcttgggtatcatgagtggttttcacatagagggc

SEQ ID NO: 105510 - DNA, 1027 bp, Homo sapiens
tcaagcattccattttcctcagcttcccaaagtgctgggaggcatgagccgctgcgcccagcctttggcttgttcttgagtgtgtcccttagcatggaccctcttgattcccccttgccatcagtgaaacgtccatgtggccttgtgtgtgaatttctcccttgtgcccctctgttggaaagccttggtggcctttgtcttggttggtctctgaattctagttttaaaccaccttgccctgtttttccatatcgtgtttttattgtaccacccacacagtggcctgtgagaattgttgaacaatccctcagctgttttcctcgtgagcagaatctaaaataagacctggaatgaccagtgcaaatacttttgcctggtgtagagattcccaccacgaggccatcaggggtgggactctggggcctgcgtgacccaccgtgtgccacgcaccctgcctttgcagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggaggtgaggccttagttctgaggaaggtgcagggacctggccggggtgcctgctgcttcctgctcccttggtcataccgtggggattctccccattcacagccttgaccccaaacttggagatttgggaacagctggtttgagccaggggtctgctgacctaatcaaggggggttgtgggggtggatactctggactgggaggtaaggagcctaccagtaaccattaattgtcctcagtaagtaccccccatctcatttctatgtgtctaaataagactgttggactttcataatgtaaagagccactcgtaactccaaaagtgcaggcctttgtgacttgatgagggaatagaattcttggctcactgcttcctgtccctagaagtgggtgagtaaaggtggaagcacgg

SEQ ID NO: 105511 - DNA, 2702 bp, Homo sapiens
agtaaacaaatagctggagtttattgtgtgcgtactatgtgccagatactgttttcactgctttaaatatatcatttagtcctcaacaacctgtgaggtaactattattattgtcctcatttttacagatgaggaaactgaggcacacagaggataagcagcttgcctacaggcctccctgctcataaatactggagctaggatttaagccaagactgtgtgcgtccagagcccctgctcccagccactgtgcaatgtcagccttataaaccagatctgccctggctgtcatagatggcagaaccagagctctgttcagtgagctgagctttgtcctcccctcaggtttggggagtgaggtctgctaactctggacaggggactatagctctgtggccctgtcttactgtttatctcacacagggatgcagcaatctggaaaatgacttggtggagctgagagccttgggggtagttgtgcaggctgccacccctagcctctgcagttgctttcctgcatctggattcagaggcgtcaaggccctctcaagtcctggcatcctgtccatctcatctcctcttgttgtcctctctccccaccctcatgtatatgaataatcagtacccctgtttgacagattcagacttttttttctttttctaatgttatgggaaaatctttccaaaggccctttttttttttgagatggagtctcacactatcgcccaggctggagtgcagtggtgcgatctcagctcactgcaacctccgcctccctggttcaagtgattctgcctcagcttcccgagtagctgggattgcaggtgcccgccaccactcccagttaatttttttgtatttttagtagagacggggtttcagtatgtttgccaggctggtcttgaactcctgaccttgtgatctgcctgcctcagcctcccaaagtgttgagattacaggcatcagccaccacatccagcccccgaaggcctttttgacctttaaccctgactttgcatttcatagaggtgatcacttcccagccttttagatcgaaatcatcttttcataagagttttagtcatacttgggatctcatcccatgttacagttaggggccaggggagaagacacacaagtcattactctggggaggatacacctgtaactgaagagattgaggcagggatttaggcatggatgtttttatctcaacattgttgagaatggaaccagtggcagagttgaatccacactgctatgggaatgtgaaagacctgataaggtagagatttgtggttggttctttgtattcttaaaatgattcttgggcccagagacagaataacagtttcataaagaaaaatatatttttttatattggggtggtggttgttttttgagacagggtcttgctctgttatccaggctggagtacagtggcacagtcacagctcactgcagccgtgaactcctgggctcaaacaatcctcccatctcagccccctgagtagctgggtctacaggcgcataccaccatgcacagctaatttttagttttttgtagagatggggtttcactctgttgcccagtctggtcttgatctcctggcctcaagcaaaatcctcttgccttggcctccaaaagtgctgggattacaagcatgagccactactcccagccatattgagtttttttgttttgttttgtttttgtttttgttttttttacctctcgtgtctgctctgtagggactgattattaattttgtgggttgtccctcttgatgtgtttcgattctaacatttcactgcctttagcatctcagcatggcagtaaacaccaaagatcccatccaggtactgactttggtcacacctgagcagttctgcttagaggcttcatgggaggtgaatgagaagctgcttactaaaatgtccttggcatcatctgtttcttctccagacagactctggattccctgtggtctccctatagtacagtgtcacctggctgtacccaagcccagatttgattgacaactttgttgcttgttgcagtggcagcaggatagtgaagcatgagctaatggccagggcaggctttgctgctctctgtttgttgcctggtgggggctggtgtttgtctctcttttttatttttttgatatgacgatttttacaaaatttattatgttgttggggtctgtggtttttgttttaatttgctttaattaaataaaagtcctctaaggcagatggaatgtgtacaatgtcagaaagactagctggcagaaaggaatgcttttctggtcagagtgtgtgtgccttacaagggggtgtgtgctctctcccgtcccttctccacagactggcaagcgtgtgggcaaggtactgcatgcctccttgcagagtgttgtgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggtctggtttggtatgtctagagttcttcagttgaagccaaggcaccattcagtgacccatctgggtctggcccttatctagtgagtggcagacaaat

SEQ ID NO: 105512 - DNA, 1033 bp, Homo sapiens
gacaaagaatggggcaaatctggctgctgataaaaaaatcatcttcaagattcagtttacaaagtgaaaaaagaaacattcaaaagagaatgagtatgatgctgacatttgctttgaaaaagggatttatataataatacatttttacttgtatgtgcataagttctttctggaaggatccacaagagtgagtaacagtgattacctctgggaagaaaaaccaggggctgggcgcagtctcaactgggaaagaaaccagctttttgaactgtttggattttaaaaaattatgtgtgtatattaccttccacaaaatgttcatttaaaaagagaagacaataccgtgcatagttacgtctatgagcattagccaaaatcgccaccaagggagagcctttgtaaaagatgcagctccaaaggcaaatcatagaatttttgaatgtggaaaaccatcgccagcttctcaagtttaccaaagattcagtattaatataattatgtaaatctttttaaactcatgttaaaaaaaaaagggtcagagcacgtgatgccttggttctctccagctgtcacacttgaaccctggccctatgtggtctccatagaaggggcccctggagttccagggctacaggccaacagaacagccacccaggccctgcctctcgctgaaacccatggcagtctcccgcccaccaacatggcaggcacttatagagctctttctccacgtaggcaccagtctatatgctggacacacagcagagaaacaccgtctctgctcttaagacatgaaccatggtggttctcactcaggcatcaacatcatctgggagatacattagaatccaggtgccttggccaggcgtggtggctcaagcctgtaatctcagcactttaggaggccaaggtgggaggatcgcttgaggccaggagttcaagacaagtctggccaacatggtgaaaccctgtctctactaaaaatacaaaaattagctgagtgtgatggtgtacacgtgtagtcccagctact

SEQ ID NO: 105513 - DNA, 1049 bp, Homo sapiens
tgcgatgaggatgacagtcaagtctgtgagcagagacataaagagacagatgaagaggcagctggggtgagctctgcaatgaacttgaggcatctccaaaagcagctgccatctctccaaaggtggagcgccatacatgtggctccttgtgtgcacatggggctcctcatatcacaaagtgtttatttcctttcctcttggatctgggtcagccaatataaggcaactgtgccagttctgggcctaacttttaagaggatgtcagcttgcactttctctctgagagaaagccagctactatgtaagaagtctgactatgctgagaccaccatgctgtgagaaagcccaagctagccatgtagagattccaccggggaaaaaaatcaacccagtgagaaccaaaggccatagacatatgtctccagttgaattctccaagccatcctctctacttgttcaaggcttctggttggggccccagatatcctggagcacagataagatacactgctgtgccctgtctgaattcctgatccataaatcgtgggtaaacaaaatagctattgccaaagccaccaaattttggggtagtttgtatatagcaatgaacaattgaaacaaactgagggacctaccagatcaacttcaaaggctactcctggcctacaacaggtgtgttccactgattgccacagcctgtcttggagaagagaagagcagaggagggtaggagaaagcagggagtcaaaagtcagaagtgaggcagctaaagggagggttgtttcctttgtgctgtccttttcctgcagctgcacaaaggaaaaagaaaataaatcagagggggaaccctgtaccaaacagcgaattagaatgtcttgcttattcaccaagaaaacaaaaggtgagatccaaaggaaagaggaatggaaagaaatgacagaaaatgaatctaagagaggaagaaaacccaggatataatctatgagtgtggagaggttttcacttgtggcatttggctcccaccagttctcttgaggctaaccagttgt

SEQ ID NO: 105514 - DNA, 1061 bp, Homo sapiens
aaacgaactaagacactttgattatttgagtcaggtccaagaagaacatttagatattcaataggcagacaacctgggccaaaattataggctatcatagtctgtataaccaggtctctagtgggagacagtaagattatttttgacttttgttacctacacattgtgctttggttactgtcccagtgcagtcgactttggggacgtgtaaggatatctgtggaagaaattcctagaagtgaagctgctcagtgaaaagccgtatgaagttattctaaaagacactagaacaagtttttaaaaaatgttctgtgagcaagtgcctgcacacacatgaatttcctggtagccaaggaactgactggaccagttttataacaacttaattgtcatgctcagttacatttgagatgggaatgagaacaccccagtggtctcctggggattgcagctatcttcatgaccgggtgttattagccaagactgggctgcagtttgccagtctgtgaaactagagctagatctccatggagggaaacctggcagggccctggcctttaatccctgctgagagatggaggattactctggaactggcttggaagtttctgacagtcttatcaggtacttcagccttgggctacatctgtcagagctaagtccttatcttcacggaacatagaagactttttttttttttttctgttgcccaggctggagtgcagtggcatgatctcgactcactgcagcctctgcctcccaggttccggcaattctgctacctcagcctcccatgtacctgggattacaggcacgtgccaccatgcctggctaattttttttttttttttttgtatttttaatagagatggggtttcaccatgttggccaggctggtcttgaactcctgatctcaggtgatctgcccaccttggcctcccaaagtgctgggattacaggtatgaaccactgcacccagcctagcagacatttttcaagttgtaaacaatgcttggatcatcttgcagaagcccaccacaacccgaatggtgccaaaccct

SEQ ID NO: 105515 - DNA, 1027 bp, Homo sapiens
agggaaatgaatgactcccttctcaaggcatcactgtgggctctgacggctccagcattcagcagcccgtcagctctgcgtcccagcgcctcttccgtgaaagggaagcccctgtgactgcatgatgcacaagaaggaaggcggtcttgggaccacggcctagagggcggccagggcactccctcctgcctgtgcagggcccttcctattctcaaaaaccttcaccttaagctccaactgagattgaggtcagggttgattctaaagaggggtggagtagtgggaattgattctttggaaggttgtggaagaagagaagagtcttcttatcttagaagaagattctgagcatctaaggacggaactggaggagcccgagctaaggaagtaaagggccaagttgatcataaatataagacatgagccacacctttcacatcgtcttattctcacagccgtctaataaaatggctgctcctcgctgtcaataagaggcagtccatcagggctttggtggaggggtacttggagtggccaagaacaaggcctgggaagtaagggaaaggaatagggctgaaccctaggaagttgtgtaatgaatcatagccatgaatactgactatatgttgattcttatgagtccccttatggaattagaacctgagtggggtcttagggactcctaacttcaaaggatatgaactattcttaaaaaggtcctaacacaggttatcagattgccccccaccccccaaaaaaaggtggaatcagtttacattcccaccagcagttgtttaaaaaatgcatatttcttttcatttgccaatctggaaactaaactttcattgttttaatttgcatttatttgattagttgtaaagttgatctttttcatattaactatatgtcctctttattaaccatttatatgtcatctttgctgttttcctttgcccatttttatttttatttttatttatttattttttttgagacggagtcttgccccgtcgcccaggctggagtg

SEQ ID NO: 105516 - DNA, 1028 bp, Homo sapiens
gtccttgaatagaatggtatcgaagtaactaattttgtgttggtaatctctgcttgagaaaaattatcttttctaaggaatctctggttccttgggagaggtgactgaaattgtttctttttcctagaggagatatctgttctctccagattactgacattatttctgcctaaagtgtaactcacttatagaaatgaacagggaagttcagagtcatgtttatttggtcagggttatctcttgctagcatgaaacagcagcacttaaagatggtacatctggcaggatttgagcccagcctctatgttgaactaacctggaaagtaggatggaagaggtagggtgagggatgggagcaggtagtgggagcagtgattctcaaacttgagcacacatcagagtcccctggtggccttgttaaatcacagcctggcccccacccccaccccagggatactgatttagtagtcccaggtgagaccccaaaatttacacttctaacgagtttccagatactgctgctaatgctgctggtccagggaacacattttgagaatcaagggcttagaaccttgccacttaatgtctggtccctggaccagcagtactggcatcacgtgtcttagatcccaccctagtctaataagatccctatatgatttgtatgcacattagaagtttgagaatactggcttagagcactcttaaacttaactgcacattggaaacacctgagagttttaaaataatactgatgcctgggtctcactccagatactccgatttgatggttattggtggtgaggggggcatggatcagacatcaatagtgttcagagctccctagttgattctgatgtgcagcagagtctgggaactactgacttaacatagtgatgccacacctggccatggctctgaatcacctgggaggtgcttacaggtcccatcttggctgatcttgattcagtgagacctgaagatccaagtttttcaggtttgtgactatctggctatatttatatcta

SEQ ID NO: 105517 - DNA, 1050 bp, Homo sapiens
tatatatatttttgtttgtttgtttgtttgtttgtttgtctgttttgtttttgagacagagtctcaccctgttgcccaggctggagtgcaatggcacgatcttggctcactgcaacctctgcctcccgggttcaagtggttctcctgcctcagcctcctgagtagttgggattacaggtgcccaccactacaactggctaatttttgtatttttagtagagatggggtttcgccatgttgggcaggctggtctcgaactcctgacctcaggtgagccacctgcctcggcctcccaaactgctgggatgacaggcatgagccaccgcgcccggccttctcttatattttaaaaaaatcattgttattccctgatacggttcatttcagggcatatgcatattacaataggcctgtttaatttacacaattgtggcaaagcaggtttttaaaaatgcctccatctcttttttacagcccttttaacacagcagtggccgattactggatgcctgtggatttgtacattggagggaaagaacatgccgtcatgcacttgttctatgcaagattctttagtcatttttgccatgatcaaaaaatggttaaacataggtaagcacttatactgctttgcaaaataattgagttccatgaatagcaactttaagcaggtgtcagttcttctgaagcaaggtaaatgcatgtagtagaatactagttttctagtatgctttagaggttgtcaaccttaatcatttgaggtccatttatattgcgtagtcagttctggcatgtgatgttgcatgcttgcatagaacctagccttcagtgcttctctgtttaactgagttaagtaattaagaattgtacctgtgaggcagagaggagtggcccatagtgttttatagcatctcatgtgaggtcatgcttatcacccagtccttccatgtcagctcttgttcctaagcttggctgaatcccaccttgatgcatccctctaaaaaatgtatagagtggatttgaaatagagaatcacattgtaaaaacatc

SEQ ID NO: 105518 - DNA, 1696 bp, Homo sapiens
aacaagctcagcggtgattccagtgcacactctacgaggaccatgctttgagagtggtttccttggagacagactggcttctgagctactcctaggcctgctatagtccaaagaggccagttccctctttcttgatgtaccctgcaaggttttttctagaacagtgtcattctccctcaccaatccagaaagccccgggaggggtctgggcctgttgttacctatggcctcttagtcacccacagcacccttcatctccccacttaggggagatttgtctctccagagttgtttagtactaaaatgacatgaagtaaaataatcttgagtatctggctattctagaataaacccgtccaacagtcattcatttttacttcatgtgatcagccctaagtgttgttgtgggaagaggaagtcagatgcctggaaacttgagccttgtgtgaagtatccatgtcatttgagaaatcactgtttattttgatttccaactagctgtggctagtgggaagtgtggtctggaacagtggtcacagatgccagtcctagaactagctgcctcagaatcactggggggcttgcaaagcacagacaggtggaggttctggctcccacccctaacccaggggacaggctccaggaatctttctaagaagcctcccagaaggttctgctgtgcattcaggcttgagaatgcctagcctagtggccagacagtacaaggacctggactgaccctaatttggctactggtataacccagggccaccaggtaaagccattcagctttaccagaagatcagaccagcagctggattggatgagcttgtgtaaaatatggaaaacacacatacctgcaaggacagggattgtgccaatgcacttcacactctacagcagtgtggctgcaagcacagtcatgctatccacaaggtaagagcttgcaccagcaggagtcagcactgtctccaaagcaccatgttaactccatggcatttttgtcccagcaagcttgcttaatcaaggcggcggggcaccagggctcatcttgaccaagcttctgagctcatgaccgttggtgggtggcactttgagtggccctgccatccagtgctctgaatctgggcactaaaatgagatagaattggtcctggtctgaattctcagacactgaaggccagggaggatccttcagcctgccctcagaggaatccatcagggtgcagtgaagtgtcacatcaattcacaggtgtttttctctgcttagttataccaagtcaatcacccttatgttgcacgctctctctttctcatttactgatgctgaattcagctgatgctctccctggggtgctgagatggcaacaacgactgtggaccttgacaactcggtttattgaggccagggcttctgggaagtctccccagcctcagctgctgagtaacaaggagaaagctgaggccaggaagctctgggagtacaagaactccgtcatctctcaggtcagaaactctccaattccaggggttaactctgtaaccaagcactctttgggaacctttgcctgtggtctttgctgccctccctgccttgggttgggccactgtgggtcttccttcctggcaatggcggtccttcttgctttgattgattggccctactgttttgggtactttaccaaggtggatcaac

SEQ ID NO: 105519 - DNA, 1505 bp, Homo sapiens
ccctcggtgttctccagccaggcctgggggcaggaggcccagccacgctgccgggtgcaggcctgcccctgggcgcccgcccgcgcgccgtccccgcccctcggccgccccctccgccccggcgcgggctcgggacgtgcagagccggcgagcgagcagcagggactgcgcctggcgcactcacttccgcgtcccgccgccctccggcccgcgcgcgccgatccgccgccgccatcggacaatgggccgccagccccagctgccgtgaacttcctgccgctgctcggccgcccgtgcgtcccggacggcgttcctgccaggcgccggccgggatcgcagctccggggaagcagcggaggacccagcgcctggaacgtacctgcgcctcagccgccgcgcgtttgctccggcccgactcgcggcctcggcgccctcccggccgattcagcttcacccggcccagtcggctgctgccttgctgtgagtttccgtgtttggttgcctaaggaggatgtgattttacttttttgctgttttctttttccttttataatttgaagaggagaaaagaactccgctgagcaggcccgggacggcgaagtgccaccagctaccccaacaaggacgtctccaggggaaagggagttggaagcaaacttggtccagctggcgttgaggtctcaacttcggctggactcttaaatcctggggtcatgcccttcacgctaggcaggtggaagtctttacttgtactgggccggacttgagccccgacccttcgccagcatctccccgctgccctcaacacacacacacacacacacacacacacacacacacacacacacacacacacacacacacacacacggcacctgggctaggcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatc

SEQ ID NO: 105520 - DNA, 1049 bp, Homo sapiens
ctgcctcagcctcccaaagtgctgggattacaggtgtgagccactgtgcccggcctactggtttattttttaaagcacatggcaccatcttactgtgaactatcttttctcctcagcacattcccacatttgggagtaatagttagctggaaatactgtgggtcttttaatttaaacttttgtttagttgtaaatttcaagctcattggacaacacaaacagcagttttatcttgagatgcaagtttatgctgtgcatcagagcaacggtattagctgacgctactcatccattcagcatatattaaaatttattgagcacctatcttgaggccatgctctattccaggtcttggggatacatagtgaacaggacagacaggaacctctgcctccctggagcagacaatgtagtagaaggaggcagggagtgaatgaagtaaataagcaagtactagggagagaatcaaggtagagaaagggaatggagccctggggctgggggtggcagagagatttccagttttaaattgggtgatcagggaatgtcccacctagaagatgcatttgagcaaaggcaggcaggagactggaccatgtgttttcccagggaaatggtgttcttggcagagcagacagcaagcacagagtccctgtaggcctggtctgtgctgggcactgtactgaacacttgatgctgactattgaattgactggtcacagcatccttggaagctggttctgccattatgcccattttactgatgagaaaacggaagctcagggagattaaattacttactggcggtgtcacaggtcatattgggtactgctgggacttgaacctgacagttcagttcagcctcagggcccatgtgtctaaccagcattgccaaacagtctcccaagcagagatttggaagcctattttatttatttatttttatggtttttttttaattgagatgaaattcacataatgtaaaattaaccattttgaagtgaacaattcagtggtgtttaatattaatacattcacaacgttgtaca

SEQ ID NO: 105521 - DNA, 1048 bp, Homo sapiens
cccgggtagctgggactgcaggcgcccgccaccacgcccagctaattttttatatatatgtttttagtagagatggggtttcactgtgttagccaggatggtctcgatctcctgaccttgtgatccaccctccttggcctcccaaagtgctgggattataggcgtgagccactgcgcccggcctgggctgtggacttttgtgtcccctggacctgaagcccctgtgctcaccctccctgctgtgggtgggcctggggatctgtcacggctaaagctaaccaggagagagccacattctgctcgctgttaggaccagaggggtgggaaaggcaagaataagcaggttccagggtctcctgtacccaggaagtggatggacaggcctgctcctcaccagcatggagaaaggaagggttggcattgtgtttggtttttctgtctttggtggatgtcctttcagcagtatcctaacccagaaaactgcagtgacagaccccccttagcctgggatcctgaaagcaggtgtgactcctcctgagaatggccctgccctgaccggggccagggagcctgtcttacttgattttactttcctggcaatgcacagggttaaacgagcagtccaagcaaggaacatgtggatgtcctatctatgtacctacatgtcctatttgcatgactacagatgccctatctgcatgtctacatgactacagatgcccttccatctgacagtctgttgcacactgagctgctcctcgttttcatgactttttttttttttttttaaattgagacggaggctcactccgtcacccaggctggagtgcagtggtgcgatcttggctcactgcggccaccgcctccccgggttcaagcgattctcctgcctcagcctcctggatagctgggattacaggcgcgcaccaccatgcccggctaatttttgtattttcagtagagacagggtttcgccatgttggccaggctggtcttgagctcctgacctcaggtgatctgcccgccttggcctcccaaagtgctggga

SEQ ID NO: 105522 - DNA, 1038 bp, Homo sapiens
aaagtagtggctgagcccactggtgatacagaatgtatcaggcactgtgattcttggatctctggccaaatgtagaatcatttactgagctaaaggccaatttgcttggaagagtgcatctaattaaagtgagattagaaaggacgaaaggtgtcctttaggaaataaccacacatggcaagccactggtatgatgatgatcaccaaccctgcaggccttttgaggcgctcattccaattaaacttgtcatccttagtgcagggggcagctgggagctctggtttgtggcgttcactgtccttgtttgtaccggcatgacccagtcctctccgtgggctcctgtggcgccctgggtgttgttgggtctcaggcctgatcatttgtcataggacagtgggctcaggcccagcagtgtctgggccagtctcccttctttgtcccagtgccccacatgctgtgggctccgtggatgcctgttgaaggagcggagggacttccattaggccgtgaaggtggaataagggatttttagctggggttatggctctgagacagttttactaaaattggtctagcagtttctctgccagacacttttctaagcacttcttatgctttactcacctgtattacgttgttcaatcctcccaacaaccctactttattaaccccatttcacagatggagaaactgagctacacagaagttaagtggcccgcctagtacttttatgaagtatctttgctgagtctggctgctgagttggagattttgaccactgtgttgtgatgcctcttagctcttggaagtttctcctttctaacaaagaagaaacttcaggggctactgtggctagggtaggtcaaggctgaggtctttttgtactctggtggagccagggccattccaggagcagcaaagaaggcagagtgtggaggcatgcctgagctgactggaggagttgggtcccactcttgcaacgagaggctgtctccagctttctcttctgtccaggagcctgtgcctgcacaagtgcc

SEQ ID NO: 105523 - DNA, 1341 bp, Homo sapiens
ttactggcataagccaccacacctgacccttgagcatttttttcatgtttgttggctgcttgtatcagatctttgtttacaatttatctttgacctttgactcctacaacagtttctcaatacttgctctatttttcaggaaaaagaaaataaatattaaggagaggctgttttccacctcaagcagttaccatttgaattagggaagctgttggtgagggaaaaccaattgatgagcgtcttagtctgtttggactgttataacaaagtaccatacactggttggcttataaacaatagaaatgtatttctcacagttctagatgctggaaagtccaagatcaaggtgctggcagatgaggtgtctgttgagggcccacttcccgggcactcatatggtagaaggggagctctctgggatctcctttataagggcactaatcccattcctgagcgttccacctcatgagaatcacctcccaaaggccctaccccctaatcccgtcaccttggaggttaggattttttttctttttttgagatggagttttgctcttattgcccaggctggagtgcagtggcgcagtctcggcttaccgcaacctccgcctcctgggttcaagcgattctcctgcctcagcctcccaagtagctgggattacagccatgcgccaccaaacctggctaatttttgtatttttagtagagacagggtttcttcatgttggtcaggctggtctcgaagtcctgacctcaggtgatctacccgcctcagcttcccaaaatgctgggattacaggcgtgagccaccatgcccggccagaggttaggattttaacataggaattttagggggacatagacattcagcccattgcagatgagtctgtgggttccacccaaggctgctagagtggctgtctatttcttaatggattgagtttctctttcttcaaattgtgacaagcacagacacttaaggaagacagacctggtttgggtttttgattggtctagcattgaaggcctttgtggtcttgtccctgtcttatcacttcctgtttcctattccagtcaaactgaatttctctttttcacttccatgcctctgatcacattgttatctagaatagcctctccccattcacttaatacatttctctgtccagtcttatgactcagctcaaatgcctcctcttccaggaagccttccctgtttccttagcaggaagagacttctcctgaatttggtgcactctgctttcttgttgttttttgttgttgttgttgttttgttttgtttttaagacggatctcactctgttgcccaggctggagtgc

SEQ ID NO: 105524 - DNA, 1035 bp, Homo sapiens
caggagccggtgtgtgcactctgcctcctcaccttgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcct

SEQ ID NO: 105525 - DNA, 1043 bp, Homo sapiens
aagcttatctatccctgtatatgagctaaaataccttggcagttaggcatagataccgcatttcttttgcagggaaatgacaccaaaatgtggtttgggcacttaagctcctcagacctcaacctcactagtaactttctgaaaggttcagtggaaagttagaggtgcaaaattcagagaggtcatctattccacattgtatgtgttgcaaaaaagatgattgctttttctacagtgcaccccctgtgggtgccatttctgtttactgtaatgttctttgaaaaccctagctgcacacttccctccacattttcctctccacctttccctattttctcccagttcccctttgcaaagtgctcacctcgtctttggtgaaagagttgaaggaagtgtcttccactgcgtttctggccaggccactgtcacatgtgctctgctagctaattaggttattgtgtatctgataggcactgaagggtttaatgtgatcctacaccaggtctcaaatgtgtttaagccatatggagccatggcttcatgcagcttagcgtggcaaagattgaataggatggagaacttgagaattatgatgattgtttttcagctgccagaacactaaatttaaccagttcagaccttaaaacaaacccaaatcctcgcatacataaaagagaaaggaaatttgtccctgaagtagtaagaatgatgtttttgtattgatttttgtgagaagtggaaactcttaaattatttgggtgataaagtcaaactggggttatgtgaaagtcattctctcatttgtcagtcctagctttttttccccctgaaaaaaaagtttagagtgtttctgtaaatgtgaaggtacaacttttttgcacctttttctttaccaaggggtttatgagttagagtttccatttttattccttccttttggcccttcctgctctgaggctgctgttgaaggttttcaaatgtggctcctgccctaaggagtattcttttttggatgcatttagaagtgaaattggtttctgtgt

SEQ ID NO: 105526 - DNA, 1024 bp, Homo sapiens
ggctggagtgcagtggtgtgagctcagctcactgcagcctcagcctcccaggctcaagtgatcctctcacctcagcccccaaagcatctgggactacaggtgcacatcaccatgtctggctgattttttctgtttttcagtttcgccatgttgctgaaacttgaactcctcgtcttaagtgatccatgcaccctggcctcccaaagtgctggaattactggcatgagccaccatgcctggcccaaagagagtttagatgaagtacttagtgtacctcataggtaccttctttgagaaatgttttctttccatgtcttttccttcactgagttctggtaacagtttttaaagccaaaaatgaaaaattattgtaacagggttagacaccaaatgtttacatgatttatgtattctgtctcttaggatcagtttacagtgcatttactttctcatggacaagaggatggaaagctagaatggtcaatccatagtactgtttgaaccactcattttgtcacttagaaatgaaatcattatgtacaccgttatgtgactcttactgacagagatacattctgagaaatatgttagaaatatgttaggcaacttctttgtacaaacatcagagtataattacacaaacctagatggtacagcctactacacacctaggctatatggaatagccagttgttcctaggctacaaacctgtacagcaggttactgtactgaatactgtaggcagttgcaacacaatggtaaagatttgtgtatgtatacatacataaacaagaaaaggtacagtaaatatacggtattataagcttataggaccaccatcatatgtgtagtctgtcgttgaccaaagcattgttacatggcacatggctgtactttgtttctccaaccagtttacaccttaacattttcttctctagtcctcctcagtacctaacatagagccttgtgcagagcagctcctcagtgaatcaactgagtaaatgaaaggaactttccagtata

SEQ ID NO: 105527 - DNA, 1004 bp, Homo sapiens
acaaccaccacctcccaggttcaagtgattcttgtgcctcagcctcccttgtagctgggactacaggcatgcaccaccaggcccggctaatttttgtattgttagtagagacagagtttcaccatgttggccaggctggtcttgatctcctgacctcaagtgatccacctgcctcggcctcccaaagtgttgggattacaggcatgagccactgcacccagccaaattctttacgtaagatttttgagggaatatgttcttgctacagttttatgacatatcactgtggctcctatgcaaaatagtggtttcattatttttaaaaattgtggtaaaataaaacattaaatttaccatctcaaccatttttaagtatacagttcaggggcaataagcacattcatgttgtacaaccgttatcaccatccatcaccagaaccgttttcatcttgcaaaaataaactctgtacccattaaacaactccccatttctgtatcctcccagcccctggcaaccaccgttctactttctgtctctataaatttgacttctctagatgcctcatgaagtggcagtatttgtccttttatgactggtttatttcacttagcataatgtccttaaggttcatccattgtgtagcatgtgtcagaatttccttttttttttttttttttgagatggagtctcgctctgttgcctatgctggagtacagtggtgcgatctcggcccactgcaacctctgcctcctgggttcaagcaattctcctgccttagcctcctaagtagctgggatttcaggtgcctgccaccacgcccagctactgttttgtatttttagtagagacaaggtttcactgcatttgccaggatggtctccatctcctgacctcgtgatccgcctgcctcgtcctccctgagtgttgggattccaggcctgagccactgtgcctggcccagaatttcctttctaaggctgaataatattccattatatgtatg

SEQ ID NO: 105528 - DNA, 1034 bp, Homo sapiens
aagattcagttcttaaattatgcaatttcatatggagagaagggaaaacagaaatgcacgggtactcaacaccagatttaacttcatatcctctttgtaaagaaataaaatataaatacctttgaagttctactcctcttaactcattcccttctttcccagagaggttttctctatttttaccacatgtgaatgtaagtgtgtgtgtgtgtttatgaaatgtgtatatattctttcaggcagttttccttttgcactattcctgtatgcacagatttcagtaaccatagtttagttaacaccagtacccaaacagcatggcttaaatttcagttactccagtttattaactgaagaattaacccaccaaagatgaaggtgcaaaaaaacaaaaagcaacaactctggaagagaaattgaaattgaacataaatggagcatagaagaagtagctgaccatgggaatgctgacactattcaccattcaagggacagtaggtatgcagccagaggtcctggtgcaggcgaactgaccgacattaatgatggagtggctgtgacgaaagggatgacagtatcccagagaaagtgatgcctgcaacagacttcccattaaaggaaaccttggagatatttcccaacattgaaagtgcaaaggataaaatgtcagaagttggtttagacttaggaaggtgtatgacagttcaccagggatagaagaaatattctgtatcttaatctatatgacaagaaggcggcaagcactgttcaagtctcttgataaatttttttacaaagaaaatattttttattctcggtgtttctaatgttttaaattatagtgtgctaaatattagttttacaatttgttcatttatgcttataatttactatatataacttacaagttacatctacaacgtaactatataagttaatatctataactaatatctataacttacaatagagtttttaatgttttgacaaaaaaaatttttaaaggtcatgaaacagtcatagtttttacaatt

SEQ ID NO: 105529 - DNA, 1040 bp, Homo sapiens
ttttttttattttgctttttttttttttctttgagacagagtctcactctgtcacctaggctgtagtgcagtggtgcgatctcagctcactgcaacctctgcctcctgggttcaagcaattctcatgtctcagccttgtaggtagctgcaattacaggcgtgtgctaacacgcttggctagtttttagtagagatggggtttcgccatgttgcccaggctggccttgaactcctggcctcaagtgatccacccacctcatcctcccaaagtgctgggattacaggcgtgagccactgtgcctgcccagtctgccttttttttttttttttttaatatacagtgaatatatctttaaaattaggtttcatatgatctcaacttaaagtttcttttgttcaggaacctggatgattgctacctgaatttttttttgacacaccttagaagtgtttaatgagaagacagaatttaaaaggtcgctccatcttacttattaggttggacaatgtgaagtcgccagtaattgaccatttttgaccaataaaaatggttatttcatgtggttcaacctaaattaatattttagttgactggcttttttgggtgagattttcaactctaatttggtaaaattgtatgtaggcttagatggaagtttaggtgcaggctaagcattcaagaaacttggcttttaactacaaagagacttgcttttaaaagcagttgctacattctccatttgtttatgaaacatctctacaacgtcagccatgtaccaggaactatactagcccctggggacccagaatgaagctgtggaccctgtcttgtgggagcctacagtctgctggggaagtggtagtcaaagaatggttgctataatggtgatatgtaccaaagtgaggtgggatcctgaaggaatgagggtctttgcctgaggttgtcagggacaactttataaagtaaggtatctacagaggacagtaactttacacagaaaggtaacttttgagctgagacttgatgaagatttgttggt

SEQ ID NO: 105530 - DNA, 2557 bp, Homo sapiens
aatgtgatggggccaggcatagtggcgcatgtctgtaatctcagtgccttgggaggctgaagcaggaggatcctttgaggccaggagttcaagaccagcctggagaacatagtgagaccctgtctctacaaaaattttttaaaaattaggcatggtagcatgtgcctgtagtcccacctgctcaggaggctgagtcaggaggatcacttgaccccattttgaagcttcagtgagctatgatcacaccactgtgttctagcctgggtgacagcgcaagacctctactcaaaagattttggagaaggggaaaattggtgaaggtgcatgctagagtgatatccaagaatgtgtgaggtgggtgggggtcagcgcacaggtagagggcctggtgtgggctgctcacctaccactgtagaagggaagcagatagatggatgtggttgctgatgggtgtgtaaatgtgatcggggcctgtggagggcttttatttttacagcaccatataaagtgtcataatgggccatgagggggatgagggagaaatgttgcatgttgaggggagtatgtgaaatgccatcctggagagaaggcatggatggccctgggagtaactgattgatgaaagactagaagtaaatacactcacattttaaaagttatgctgatgggattcagtttttattttactcttgttccttccatgctttctggattctctaaagtgtgtagatgtttttgtcttgtaatcagaggaacatgattcataaagcagtcagtcatattctctgctagatttagctctctaagagcaggcttatctgccctgctcatttttgtgccctggctcgaaatagataatttgggtaagggagcaaatattacattggagtcttctctagtgctatgggcttcaaaggaaagtgaattgggagctcaagaggagcccttatcaagtctgatgataccaggtaatagagatgagtcattagcagctcaactcattgctgatgtcattaggtaccattttgaaaagcatttggtgttctcttgtgaatttgccagcacttctccaatgcatacccaatacattcataccaggaggtctttccagaatgttcacagtaccacgttagagcaataccatgaacgtcacaagggcttgaagtttataaatagcgtagtttcatttttacaaaaaagcaagctgcgtgtttctaagtatggttgcatgtgatgaaactaaaaagataggagaatggtctccatgaacctgagaatagttacttctaggtgagaacacaattggataaaatagggaaggagcagataaatagattcagggttttggtactgttttgaagttggatggtaggttcacaaatatttattttattatgctgttatactttataatggatgcatcaaattatattaagaaaaagtgttacatatagaaaataccataaccaaacctaaacaaatgtggaaggagaaaaagtaaggccattgaaacaataaaacctttctgtcatacccccctgctccccagccacagtgtggcatacattaaaaagcagacaataaattagccagacatggtggcatgtgcctgtagtcccagctacctgggaggccaaggtgagaggatggcttgggcccaagagtttgaggctgcggtgagccatgatggtgccactgcactccagcctggttagcaaagcaagagcctctctctcaaataaatacataaataattttttttaaaaaagcagacaacatcaaatgttggtaaaggtgagaagccaaagtaattcttgaagcaatatggaatttcctaataagatcagatgaggagtatactctgtaacccagcagtactgctccttagagccatttctgcttatttgtacagagatgtttattgcaacactgttcataatagtaaaactggaaacagctggcatgtccatggacagtagaatggataagtaactgtaatctagtcatatagtggaatattatacagccatagcagcagcaaatgaacctcatgactataatgagcaaataaagaaaactgaaagaatacatacagattaattcctgttatgttaaaaaaaaaaaaaagtcaaaagctgttcagactaaacaagaatttgtttagtggcaaaactagaaagacaagggaataatgaactgagtggatagtagttacttcttagagggcagtaagggagccacagggaaaggtgcttcagagatgctagtgggtacaaaggggtgtgtgtatgtgtaatttttaaaattatgatcaaatatacctcataaacaatttgcctttttggtcatttttagatgtgtaattcagtgagtggcattaatttcattcacagtgttgtgcaaccagcatcctgtttccatcactccagtaagaaattcttacccatttaatatcaactccccatactaaatgggtatttaactattgtaaatagttacacacattatactttactgtttattatatttcataataaaaacatttaatgtaagaggt

SEQ ID NO: 105531 - DNA, 1031 bp, Homo sapiens
agttttcagtaacctaacttagaaagtattttcttgtattgcttttaggttttttgcatgcatgaagctagtcatttggctttgtgccttcaactttgtaaacatttacattttgagcatttattttctaggctttgtactagcaacatgcttattttgctaaactaaactttaaaaatctgtattaaagcttactgtcattatgaaaagaagtttctccaacctttgtattttttttaaccagaatatatcagcatattttatggctgtgagccattaaataaattgtagcttggggccagaaagttgtagaaattatttgcttaatctctctcatagcagaggaagaataacattgagtgagtgacctggcaaagatcacaaaccaaaattaaagttagcaactctgttgtaactagattttcttggatggaaacatagtttttgattaaatttttgaacaggtagtgcatttacatatttcaaatatcaaaaagtatttttttaatgcaataaaaaatatttcccatttctgacctcatctgcttggttcttacccccttcccagctaatcagatgttagtttcttgtttatccttccagataatttttatgctaatacagatatgtgcccttctcttcctccttttttagacagtgataatattctgtgcacatttttctgcaccttgtttcctttttttccttcatatcttttgcaaatcttttcataaagatctttctttcatacacacaaacacacatactgtctctcagtctgactctgacttttaaaaataattggatgttgttccttagtgggaattacgaagggaagcaaggatagcctgtgcctctgacaagtaatctcataaagtattgaggagtcatgtcattgctgatttggctcaataattttggccccttctggtgatatggtaactaaaacagtgatacttcacatatacctgcaaatgttatatgtaagaaatatgtcagaaaggatgttaggaaatacttggcacagttaa

SEQ ID NO: 105532 - DNA, 1001 bp, Homo sapiens
atcaatctggtatgtttcttatgtttcttggggggaaaaaaaagccttaactttttcttgacagaaaatttactattttaaccattttttaagtgtacagttcagtggcattaagtagttcataatgtgcagccatcatcactgttcatttccacaacatttcatcataccagacagaaactctacccattaaacaattaacttcctattatatccctccccacagcccctggtaattctattttactttctgtctctctgaatttgtctattctaagtaccctcatgtaagtggaataatacaatgtttttcttttttaatgtttttaaggttcatccatcttgtagcatgtatagaatttcattctttttttaagactgaggaatattccattgtgtatgtgtatgcatatatgcacacacacacacagacacacacacacacacacatatacatgcataccacattttgtttatccattaatctattgatggacatttgggttgttttcattttttggctattatgaataatgttgctatgaacattggtggtgtgcaagtatctgattgagtccctgttttcagttcttttaggcttatacttagaagtagaattgctagatcatatggtgattctatgtttaactctttgaggaaccaccatactgtttgccatagcggctgcaccattttgtattcccaccaacaatacaccagagttccagtttcttcatatccttgctgacaattgttgttttctggtgtgtgtgtgtgtgtgtgtgtgtgtgtgtgtgtgtttaatgatagccatcccaatgggtgtggagtggtgttgagttgatttacatttctctaatgatttgtgtgattttgagcatctttgcatgtgctcattggccatttgtgtatcttctttggagaaatgtctatgtaaatcctttcgctatttttaatcaggttgttttttgtttgagttgtagtcattctttatgaagtct

SEQ ID NO: 105533 - DNA, 1079 bp, Homo sapiens
aagtgatcctcccactttagccttctgactacaggtaggcaccaccatgcctggctacgtttttgttcttttagaggcagggactcgttatgttgtccaggctggtctcgaacttctgagctcaagtaatccttccacctcagcctcccaagtagctgggattacaggcacgcaccaccacgcccagctaaaagtatttttaatgcaaaatattcaatccttgcctcagagattctgattcagttgatctcaaggccaggaatcttttttcacaagcaacccagaggattctaaagatagtatatgaatcataaagccctgacatctagggatatagttggaataattatgttagaggaaaccctcatctggctttgggaaacatgattgatttgcacagcaacctttttaatactcttaactttactttttcacatctttggggtgagatgatctctaatcttcagccattttttggatggagggctgtcttgcctcagccatttagacttctttttggtctaggataatcacatatgcctgaccacacattcctgtctgaccttttaatttacagtttttaataatgtcactgaaatgagacccatgttataagagttaagtccttagtaaatctgacctactttggtatgagagtgtttatacaaatatgttttagttattttctagtggactctgctggccaggtggtggcaaaccaggaaggcgtgttccgaagcaattgcatggattgtctagatagaaccaatgtgatccagagtttgttagctcgtcgttcacttcaggcccaacttcaggtgcgaatgctttttttttttttaattgaaaaacaacacagcaaaaaattaaacatctttaaaacccagtaacaaaaaatattcacattgcccacaccctaacccagctctttttatttttgtgtcttgcccatggatgtcacattttccataactagggtcagtctgtgtatgcacagttttcacttttgccattttcccttagcatttatgtaatcacagtttctggtggttgtattgttgtgccgtaatttactaagc

SEQ ID NO: 105534 - DNA, 1302 bp, Homo sapiens
cgctccacagtgctcctcagaccttaccgtgtacctgaagcaccagtcttgagatgtgctctaaaaagcacccaggtgatgctgatgctgctttcaaagactgcactgagtaatgaggacattaatgagaacattttgaatgtattatgcatgcagtggctctttttctgctatgtgggttccctgggagcagaataagatttctagtctgtttgctttgctgtgtcctaccacttaacctgggctatgtatttctcttcatatttcttgtctttgcaactggaattagtgtgtttctttgtgcctcctttggtaatattttagaaagaaaataggtatttcttggacctacaagtgatttcttttgtgaagtatctgtattttcagggatagtttttaaaatctgtcactcacttatttctataccttatgcttattggccataaaacagtgtgagaattcagtgtacaaacctgtaacttaaaatttaacctctttaaccagaactggaaagagaactcatttgggacttataatggatggctggaactcaatgatacgatattataagaacaacttttccgatggatttagacaagtaagtttgtatttgatgctttcctggcattacgtggttgtatctttgcattgttcatcactaatgttatctcacactgagtttacgaatttcttcctttctgttctaggattccatagacttatttcttggaaactattcagtggatgaattagaatctcatagtcctttaagtgttccaagggactggaaattcctggctgtaagaaaccattttgtatttttcaagtttttaaaagcattgtgtctgaaggtatagatggtttcagtctcaatttaaaacgttatatgtggttttatatttcattacatgaaatataaatacttaagttttccaaagaggtcaggctgaggagtacagtaactgtggagcatttgttttcttttcctcagactctcacacatccttttcatgtgaagtaacataagcaaagggaatgtggaagctttctcatttcaggaaaacttcaattctcttacattgagggaattgccagagacaaacgtgttacatggaaggcaaagtttatttttgatgcttctctcctttttgactcctctgttcaccagaccctgcaagagccgctctggattttctttccagtgtgtcaagtgctctggaatggaagggaggcctagtgttctaggtcctcatctgggcatcctccttccatttagcaccctttggcttggagcaaaagcat

SEQ ID NO: 105535 - DNA, 2349 bp, Homo sapiens
gctagaatgcagattcctggggcccaacagttgatgctttatcaagccctgcagaagattctggtactagccagggtttgagaaccactggtttaaaccttaattaagaggttcttatatttttcctgtgaatgtgctagtaaactttaatgttgccaaaatgtgctaaacagctgaaaactgggtctgatatcaacaaacgacttatttagctttttgtttcttaatatcaacaggtgacacttggacagaaacactggcctatgtgctcttctggggagttgcaagcattggaacattttttatcattctttacaatggcaaagattttgtcgatgctcccagactggtccagaaagaaaagatagactgaatttgtatttgtggaaagcggcttggcttggaagattccattgtgcagaactggagtctttactgacccgctttccacatcagcccaaggtctttttaatgcctttatccaaaagcacatcttgtgctccatgcaggatgatgacagaattgatctgatgttactgccttgatggtctctttactattgggacagttagatttataatttgaagctattctgtaattaaaatataacctgaattcagcttgcagaatggaagctgaatctgttcattgtattctattgattgtcaatttaattagctgttgcagaataagtaatatattttaaaaacctagctcctttcattatttaaaacagcaaaattatttttgtagctcagtttcattattgtcattgtagaagcggtcactattagcaggcatacttttccacacatctttggacttttcttaaaagttcagtaataagctaactgtgtttataaaatgtaagtctcttacagacatcaagtagtttgatgagacagtctgtgacttcatgataggaaagaggaggatgaggtctggggttctttaaagtctctggtgggctgcctcatgactttaatcagcttgaactgccagtgcaccagcagtttaggtgtgatgagagaattcagatatactttatctttttaaaaaagtgtaaataaaatcaaagaatgtaaagtctatctcttacgctagaggtccaaagctgcctctgttttaaagattatcccaatgtggaagatgcccatgactggtcagctacttcctcctatacattttggtttctttgagggtcactcattgagacacgcaggcctctgagagggtcttgttctagatttcatattgcacttggagggtaacagctgctttttcacgcatggtactcttgatgtttttcactctgtcaaggattttgttggctatcaatgaatgtgtctaaaacttagtgcttccaggtagttatagtactccaaatcaaggaccaacttaaacgttaatttttgtgcaaaaacaaacctgaaaaatatgcttcggaaactgtgcatagttctaattgtaagtcagattgtatattcaaattgtaattaagagatttaaatattagaacggtatgtaaggtagtataattaccactattttaaataattcagttaaacactgctgcaatatttcagtgttgtgcttgaaaatatgtacagtttttttccaatattaataccttatgttgtccttaaatatttctaaaagcgcctttatttcagcattacctttttttcatcactatcttttataaaacattaatataagtcgttacttttagaaactaaaggaaataatagctggaaaaccctctgtagtttaaaatcagtcattaaactcacaatagggtaagtaaatatagccacctgttaacatgtaaataagcataatttgttccaaagatggaatattgaaacttagttcatgtctgctgtaaaatattatttaaatgctgctgggcatttcacttaaagaacttaatgtcaacagctacaacaaagaccaaatctgaactgctaatgtggctgctttgtagggaatggactaatatcagtgtgttagatcttaaggtatcagtatttcagaatcctgcgacgattttatttctaaattcatgtactgtatgtccataagtgaaaataaaatgtcatattcttttctattattggtatcattcatgtactttgaaagtgatgtttttctttttgatcttagaatgctaaaaatcatgcaaaatgatagacggtttggctctgtgtccccacccacccaaatctcatctcaaattgtaatccctacgtgttgagggaggtacctggtgggaggtggttggatcatgggggatggtttcccccatgctgttttcatgagtttgcacgaggtctgatggtttaaaag

SEQ ID NO: 105536 - DNA, 1031 bp, Homo sapiens
acaaaatttgatcattgtatgtcctattatgctaagtgctcacaacacgctaacgtgccctcatccctgccaggcagatgttgacatgccccaggccctccagcaactggtggtggtgtagggagtccaaatgtgagccctggattgaggactccaaaactggtgcactttgccccagcccttgcccaggcgacccttcagctcagagctcagggaggcctgggactcggtgggacagcccaggcttacttcttcaagcagttttcataattgaaggtggccttgaagccatagatggagaaggtgacaatgctggcaaatatggaggtgaagctgttgatgagggacacgatgatggcgtgcttctggcagttgttggatggctcattgtagctggcgaaggcgatcaggctgccgaagcccaggccaagtgagaagaagatctgggtggctgcattgatccaggccttggggttggccagctgctctatctggaaggccagcagggacagggctgatgatccctgggtggaatcccaaatgctcagacccgcaacaggagagtagcccagagaggggaaggagctcacctacagcacgcagccatcaggggcacccctagggctggagaccagctctcctggccccatccactccctggcagatgaaacacacacctcaagctgcacacctcccagggctaaggtgctgtggagaatacaggtgctatgtggaggacataaggtgctacgtatcctccatagcacctcagccataggaggtgtgtaaccagaagcagctatgctcaccactatacgccagtgcggaggtgtgcaatggaatactgcagggtaaaataattaaaacacaaatggggccctgattcataggcagttactgcacaggtctgggcattcagagatggagggggtgtggcctggcaggggaggtctaggtgtgggttgactctcggcactgacatcggtggcgtctggaatggggaaggggaaggatgacacagtcattttatt

SEQ ID NO: 105537 - DNA, 2108 bp, Homo sapiens
caagaccagcctggccaacatagcaagacccccatctctataaaaaaattaaaaattttttcatataaaaaatgggaaaaaagaatatgggagctaaaatttaactaaattaaaaatcattttgctaaaatacactactatgggacttgggaaaaaagtgtgcttattttacaggaaaattagtttaatatttcaaatagatttatcatatccagggcttgagttatttaccaacactgtacttgggaaaatgttactattttatggcttctcatttgaaagaatatatttttaaagtttggatagtcttagttttatataaatgtgtcctttaaggaaattagaaaatcattagcaaaatactagtaaaattcaagcaaaaaaaactacatatttttatcgcatttgttatctctttccttaactatttttttagtaatgggctgacattttttactaagcaggaattagaaaagaaatttcagcaaacagcagcttatcgaaacatgaaagagattcttaccaagaagaatgaccaaatcaaagatctgaggaaaagactggcacagtaagccacactgatcccgcctttggatttctctctctggattgatgtttgttctctgttaaatctaagcttgttccagagaggtcaagccggtggtagttgctggatcatttagtccagaagccttcatttgaggaaagtggaggagctctggcctgaccttatctataatgcccaccagggcttctttttaggttcatctaggcctttagactcacacaggcctacagtaagctgctcttggcaatggattcacttagcaggatgtcagacaggaaacacagcaagctcgcagggcagcattaggtagttctcttctccttggtggtatactctaagcagtccaagaactggtcttactgttcccctaaatgacagtttaagttggagagaatgagattcatgcagatgggtgtcatagccagcttggcttagaagtccgtgttctacataggattagtatctctcttagcagtcacatgatacccagttaagggtatgtccagttaaaagaactcatcgcacagggggaaacctaaagtggtggctcccaccatgtatttatagttcattcatagtcctccaggtccagatgtggtcatcagatgttttgcctggaaactgagttgacattttacctttatcagagttccaggggagcagagctagaaagggaattcaaggtgagatttgtccttagagaagtagatttgctagccctttactcatatagtcgtatcaactgttcttgtcaacatgatgattgaggtaattatatgaagttatcacaggtctaaatgccaaatatacagacttggagccttagcagtgatctggcctatcctcctacctgatgtaaaaatcccctctgagtcaccatcaaaacaaagttgaatgtgtccaacttctaccgtaacagtaatttgaagtgagaaatatagtgccactgcttcaagtaaacttatttggtaataacaacaacaaaaggtatcctgacattgtgttcttaatttatatctccagatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatg

SEQ ID NO: 105538 - DNA, 2339 bp, Homo sapiens
taatgagaatgattagaaagagaggtagataactactagtattgtctccatttgtcagatgagtaaaatgaagctcagctacctcagataacctgctcaaggtaacacagccaggaagtgacagagccaggatgtatacccaggtgtggctgaccctacagcctgcgctctgaatcttctgagtagagtatttatgagtgggattgagactgaacttagggatcatgtgtatgtgtaagccatcacagacaaaagcagtttttcacagttacttccaaaacattttttcttttgcctgaaaatatgatagacaatttctgaattttactcttgaattgaatgcttttccttaagagttctcagttttgatctctgaattctttgagcaacttgaggattttaaatactggctattaagatatggatttagaatgaccaaaaagttacctttttgtttgaagatgtaatctctgctttttcaaattctgcaacttgttctaataattctcttgaagaagaaagcaaagataaaaattattcatttaaaatagatttatatcacacgcaagaagagtaaaatcactggtaccaacccattacatgccagagagaacagagcaagatggaccaaacttcaccatatcaaaaatgttagttgcaaatggttgagaacctaaaccacatggactcaaatgtaatcatccacagtacctggcattttgtatctactaggtatgcaatatctactgctagaaataaaccataatgttaatacaaatatgaggaaaatttatagtcaactttgtattcttgaggtgctatgaggagactgttttattacataatgtgtattgttagctagtaggtgttcaaaaaagattcttaataaagtagtctcagaaaaatgaaaatagtccatagtatctactgaaaaagagtaccacaaattcctaggaaagacagatagtgggggtgtgccatctgaagatttgcaaaggccaatgagaagtgactacacacaagcttagagtgttaacagcagtcagcttctaagcttcttaaagcaccaccttctcagagttttctcaccagtcatctactgacagtggcagaagttcaatgattttcctccccagctcataggttgtcctcagcgttgttcaacactctgcatgtgaactgatgtgctgtgactgtgcttagagtagttcacggggcttggcggtcagtccttcctgatttctggcatgctttttcttaaaatgagtttcaacttcaccaattttaccatattttttgaatttgagctcttagatgtccatattataagcttttttgtatatttcctatttcaaagttaataaatgtatacttttaaattccattatttagaaaacttccaatgctactggattgaattgatggtatttattatatttgaattgacttttcaactgtctcataatctctatttcttagttgaccaatctataaagactgatggtaatactgaccaagctaacaaaaatgctgtaagaaataattaatgatagcctgaaaagcaatttcataaatctcgatggcctttgtaatacctaggaacagtagaaacagagaacttttaaaagggtgcttagtggtacccaagagatcactcagtgactcaatgctttgctgttaccctacccaaatttcctcacacactagccccaagaaaatatgcagccaaagatgttcactaacttttaagattatgcttgggccattattgtcacagttgcaagttcaaattttattaccggttttcaagttcagagatgtctgtctgtagcttaagataccacttctcagcttgtgcaaacagctgtcgcagaagtaacacattggtataggcagtgttgatgagctcagattccacctcactatgaaccacagcttgtaatccattgaggacttcagagacttcatctatggtgaaggtgtcctccaccagcctgaaaaacaaccatgatccaaaacttatagaaaaacaacaagaaaaatctacaaaatacagcaaaattaagaaacccacattcatgtaatctaagaaattcaaagattacagtgaaaatctctctgggaactatcttctttattaataaacattgaaaataatttaaactcaattaatttttgacatctattcaaatgattaaattgtgcacatcctttaatacaagtaaatgctcaaacacattcccaaaaccatcatctacttttttaactttttagtattaaatgtcttatttcaaactccactgaaatcagtcttattacatttaataatttcaaaagtc

SEQ ID NO: 105539 - DNA, 1036 bp, Homo sapiens
tcagtgagagggtcagtgcctctccatgaggtagagacgtggggccctttcatcttgcggctcccccagcctctagggcattgatgttgtctgcatgattcagtcaagtcgccacctcttccaggtttcagagaaacagggaggggcagaggtacaccccatatcttaagaccaggtctttggaagtagaccacaacattcattgctgagaagtagtcagcagtgacttgattgcaaggagggcaaggaagtgtcatctaggtgggcagccatgcagccaggaagaagggaagaatagaatttgatggagatctagcagtctcgaccacaggatatcttatgcattttcattgttggctctttgatcagatcttcaaaactaacaattaaattacctctttctttttcaggcagagttgggcctaaatgagcaccatcaaaatgaagttattaattatatgcgttttgctcgttcaaagagaggcttgagactcaaaactgtagattcctgcttccaagacctcaaggagagcaggtatcagaggaggactctaagcaaaccaaataggaacatggattctttctggtagccagtatgggggtgccatagcagaggccagacaatttctgggattcatcatgatcaattatttgctaagagcagctacactaagcctcatggatacaggaaacaaaagaagttgtattgtggtgaaagcaatgaatctattgtcagaaatgcatgtgataattgtaggataattgtaggatggcagagtttgagaaggaagttgccaagggtttgtggattaatgattggcttgttgtattgaagattccagaactttaattacttgagttattaattaaatggttagagctataagacatggcaattagtgagaaaacacttctgtgtttcatactgaataattagtagagaggaaaacagcaggaaatcataatgctgactagtaccaaaattgttagttgatttctagcatgagatgataatggttggaccgtagctgatttg

SEQ ID NO: 105540 - DNA, 1055 bp, Homo sapiens
ccaagaaactgtccttggctcagaggtgttgggaattaaagcagagagaagccattcgtgatgcttagaaccaaggatggtcatgtacacaaagaccatcgagacggccattcttgtttacaaaacacttaccaagaaagcactttgtaggggaactttagtaagttcttctcatttcattatgtttcttccaaggaaacaggagagactgaattaataattctctctttcctcttaagcacttttaaaataataaagtacatcttgaaatttggggaggcatctctgatttaaaaaaagaaaaaggctgcttgatgtatgttatgcagagacactctgcctctggtggctgcagagcaatacccaagcctcatttggaaggctcaacatttggaattgcactttaattgattaatcctcaattcatgtggccttacgggatggtgggtctgggaccccaattcattcttatctgccaaagaattatctagaagcacatcaaataccagcaccccacctgctcaatgggggtggaaaacttttgtatccctaagcatattattttatagtgtctgccatgccatgtggaaatactttatttttaacctcaggatttaaataaagtaaacactatgacatttagacatttgtctctcatttttttgggacataaagtgcaccacgaagttatacagagctgagttggggttgagctgtgctgctgggaaatagagcatcttttatggtggcttttcaggaggacttgagccagcagatgttctgggaagtttccaggtggcctggcacctggctgcttcctggcctgctgtgagggtggtgtttagacctgcctgagacagcctgtctttcaatccatgctgttgtgccctatgggcttctagcctcagctcaaatgtccagatctcccagggcacccacagagcatgttgagcaaagagcagacttctgagtttaccggaacaatggggctggggagaagcatcatggatggcctaaaaccatgattggtcaatatgaggtacaaagctgggcaa

SEQ ID NO: 105541 - DNA, 1016 bp, Homo sapiens
tgtgattcttaaccttttttgaccataaactcctttgagaatctcctaaaaactgcagaccttttctcagaaataatgtatatatatatacacacacacacacacacacagacacacacgcacacacacaaacacccctacaattctgggagtccatgaaccccttgaatccttctgccatgtattctgtgggccctcacataagagttcatgataaactatgtgattttaactgaccgtacttttagaaacctggaaaaaatgatcacattttattaacagttggcctccagctggtggaattatgggtgacttatttcttcctttttttaaaatagttttcaaagtttctacagtagtatgttgatttatattgaaaaaagaacataaatgataatctgataaaacagcctgtcttatgcaaaagaaatgaaaacagagattattcattgagcaaatatagacaataactagattctccttatctccctgggtgggtctgactatgccattactagcagtaccatcagcctgcaagcactaactgtgtgcctggaaacatgttcagtagttttcatgtttctccagtttaacccacacagcagcaaatggcagtgatggaatttgaacgaagagcagctgagctccatagcctggcattttgcactgtaccctactacagacaggaatctgagaataccaacaatacctggggttagtcctccctgtcttcttttcaatataaagagtaaaacaaatgactcaccagcagagatgctttgccagtttgttccagagatgagcttgctcatgaagcaaggtctgcctctacttctgtgatgtggttcatgtttccgctgaacattttttaagagccctcagctggttactataagagacccaccccctactcccgtccttcagatcagaatccatatgaccaacccgcccctgtgtaacgcgtgggtcagagatggatgggtgactgataccccacactcccttcattctgcttt

SEQ ID NO: 105542 - DNA, 1061 bp, Homo sapiens
cagtcggacacaaggcccctggttggaaacccagtgcctgctgcaagcccttgagcactgggaggttctttcccacgcatcagtggattaagggaaaatgcaggtcagacagactcctgctttcaaaaatacatgaataagtactgcctgtgtcttacagagcaaggatttagtggcatagaagtgtgttttctgttattaggttctttcttaataagatttttccttctaaataagggacctcagagaatatgcaagaggttgaaacctctctaagcccctgactttgagaagtctcttaggttgtacattccatttcgtctgtaagccttcctctacttttttggaatgttccagcaaccaaccatttctctcaactctggacagaatagctgtcagttgagtgaccacttaaattgtgcctcagcagcttgttctgcatagctgcactctctcactttcccaagggcccttacccagcctatgcataacagtgtgttgtgtctcttctctcctgatctgcctctgctgcccaggagcaaatacagactacaggccaccggacgacgctgtgtttgatatcatcacagatgaggaattgtgccagatacaggagtccggctcctctttgcctgaaacacccactgaaactgattctctcgacccaaatgcggctgaacagtgagtagaggtcacccccatttcctgagtgctcattacaggcctggcccctgtgctttcttatcaaaggatgaggaaagtgagacactggaagcaggattgactgtccttgcctaagggaacagtgcttgcgatggccttgaagagcatcggcgctcgggaagttgtcagtgttgagccttgcagagagttcctgagagatgtcagtggccccaggtttcagcatcactattaaggcctgtctttcttggcttgagcgactatattagtttgcttgggtgctatataaaataccgcagaccgggtggcttaaataacagaaatttaccttctcacagctctggaggctggaagtgcaaggtcaggtgctggcagggctg

SEQ ID NO: 105543 - DNA, 1031 bp, Homo sapiens
atggagttagggggccccgcagggatggggcatacccagagactagcagttcttctaccattcctatagggaccagaggggagcagcattactggaagccagcaagagctggcctgaaacctcactagaggaacacaggcagtgccaggggcatgaaggccagagaaggatggataaagatgaatctcgggctgggctgggggcaggtgcagaataatcagcagagctgtgaaggtctgtggtctcttagagccttagcttctgagatatgggaggcatacctacaacttggtgccagggaaggtgggctcagccacactttgtctccctgcctcccaggaccttaggaagtaaaccatgctttcaccaagctgacaagaaggctttgttggaatcttatgaaatgagctcatggccacatcctaacttgggggcagagccaggtctgatgagagtcacatggcatccagagcccagtttgggtgctgagcagatcacacaagatcatagtgtgtcatcctcacagcctgggcttgttttgttcccaggatatgtggccgcatcttctgttactactgctgcaacaactacgtcctgagcaagcacggtggcaaaaaggagcgctgctgccgagcctgtttccagaagctcagtgaaggccctggctcccctgatagcagtggctcaggcactagccagggagagcccagccctgcactgtcaccagcctcacctgggccccaggccacaggaggccaaggtcagtctcctgctactactgcctactatgttctctaggtgccacttcctcccctaccgatgttgtggctagttagtgctaataagctgaattcagtgttttctaaacttaggtattaaagaggtgctaaaatatattaccaccaacttgagactttcattttgatatattaggattgaaagagaattgaaaaaggaataactttgccctgataagattcagtgtgatttaacctgaagtctatgtacctgttaatgcacattcatgaaat

SEQ ID NO: 105544 - DNA, 1091 bp, Homo sapiens
gttggaggtgcgggagaagcagctacgggagcgcatgcagcagctggacagagagaaccaggagctgagggcagctgtcagccagcaaggggagcaactgcagacagagagggagagggggcgcactgcagcggaggacaacgttcgcctcacttgcttggtagctgagctccagaagcagtgggaggtcacccaggccacccagaacactgtgaaggagctgcagacatgcctgcagggcctggagctaggagcagcagagaaggaggaggactaccacacagccctgcggcggctggagtccatgctgcagcccttggcacaggagcttgaggccacacgggactcactggacaagaaaaaccagcatttagccagcttcccaggctggctagccatggctcagcagaaggcagatacggcatcagacacaaagggccggcaagaacctattcccagtgatgcggcccaggagatgcaggagctaggggagaagcttcaagccctagaaagggagagaaccaaggtcgaggaggtcaacagacagcagagtgcccaactggaacagctggtcaaggagcttcagctgaaagaggatgcccgggccagcctggagcgcctggtgaaggagatggccccactccaggaggagttgtctgggaagggacaggaggcagaccagctctggcgacggctgcaggagttgctggcccacacgagctcctgggaggaggagctagcagagttgaggcgggagaaaaaacagcaacaggaggagaaggagctgctggagcaggaggtcaggtctctgacccggcagctgcagttcctggagacccagctggcacaggtgagccaacatgtgagtgacctggaggagcagaagaagcagctcattcaggacaaagaccacctcagccagcaggtgggtatgctcgagcggcttgctgggccgcctggcccagaactgccagtggcaggtgagaagaatgaggccctggtccctgtgaactccagtctgcaagaggcctgggggaagccagaggaggagcagaggggcctgcaggaggcacagttagacgataccaagg

SEQ ID NO: 105545 - DNA, 1023 bp, Homo sapiens
cactcagttaacagaagcaggtgcggttgtcattgttggaattgtgattgtcactactattatttgcacatactgggtattctgatcctgcgcttacctataatgagcagtaggattatagtgaagaacctgaaatgtggctagaataaaggtaaagctttctggaagtcagtattcagggactgaattgattcatccacacagcaaacatttgttgtccagctactatatgcaaattactagccctgggtggtggacagacaagggtgaacaagaaatgtgcccagtcaacaagcattgtaaagtatctgtgagctctcaggacatttcaacactccctgacttggagttatatctcatggatacttacatacccttttatgtttcagaggtgctttgtatcactgaccacttgctcctcatgcttcctggattatttctgcttctctgtctgagtttagtcactatctggttacatgttcctatttgttgtcttaaagatgctgtgacagaactaagcaaagaatttcaggaagcaggggaacccatcacggatgacagcaccagcttgcataaattttcttataaacttgagtatctcctgcaagtaagtgatgcctgtaatgtgttgatttttgcactggtatctcttttctccctcttgggtgactcatcagcattcaagatatggttcagaaagcccaaggagccagtaagccctcgtggttagattgaaggtcagagcagtccccagtgccagctcaatcctccaagtgtgatcctttggggaattgcaatgttgccccttaggatggctttgagaatcaagaacatcctttagagatttaggtcattgtaaggtaggtcagaaggttactgtatggcaaagatcttaactttgggacagttacatacccctttgggagtttagtgaaagctatagagtcttcccaaaaagacattcgtgtatgtatacacacaatcacgcatttttgcaggcagattctaagagtgtgtggaccc

SEQ ID NO: 105546 - DNA, 1027 bp, Homo sapiens
cactgattccgtgtagcctttggtataaggggatggagagagccactaggtggctttttaaaggaaagtaaggcagtcctatctaaggtgaatggaaagtgagctcaaaaagataggctgcaatatgattgatctaatttcttgtttagccccaaaccaggtcactgtgtctgaatagaagtgtgtcagaaacaaaccagagagtgcccacagaacaaggcccacacagaaaggtcaagccctcctgttgagggaatacacccagatagggtgacctttgtgcccagagcagagttctctaatattgtcgttaaattgtgtctgtatctgcttcctccatggcctccccttcctctgtgcaggtgccaccatggagtctgaccactgctgagcagacagccaccgagggccgaaattctgagccttcctctggacccaggcaggagacatacagacaagaaaggcaaactcaccatggcctccaccaatgcagagagccagctccagagaatcatccgagacttgcaaggtatggtaggttgctgggcaggctgagtttggttttgagggacttgtggcagggctttttgctgttgccagttgaaattcaaccctttcatttttgttcacacaacgagtaattggagtcctcaggtcacatcatattgaaatatttgggtctcaaatatccaccttgtgtaaggcttggaaagcttgcctggtttcctttcagagaactgtaaagccagtttgtaaacaaaatcatacacccggctccaggactgggtctgatttccattagtgcacacatgtgtgttttgaagctgcctgttaagtctttggctaaatcccaaacttctgggctctgatgaagttggcttctttggaaaagaatgttctttctcccactgagcaggaaggacagagacccacctatcttgttttgctgcccaactgggtcctggctggcggatggcccattgcctgggatgcactgtaggtccagtcctgctgcctcccagacttc

SEQ ID NO: 105547 - DNA, 1603 bp, Homo sapiens
aggaaacattttttaaaagccctatagaaaaaaagaagaagaaagaaagaaagaattgggttcagctgcaaataacaggaaaaaaaaatagtggcttaaaccagtgcctctcaaaccatcctgtacacagaaatcacccggggatcttgttaaaatgcagaccgtgattcagaagccctggggctggccctgacgttcagcatgtctaatgggctcctgtgcgatgcccaagctgctggtccacagagctcactccatagggagggcttcagcaagacaggagtgtattcctcagccacaagaaacctggagtctggccctccagactatatccatcgctggtgatgggaccattggtacaccaaacctcagcaacattcaatttacccatctaacaaatctgcatgtgtaccctcagaacctaaaataaaagttgagatagaggaaaaaaaagagtttgttgctttcagcctcttgattagtgagatggaaacaaaccatcaatacacaatgctgtctggcttcctctgtgtggaaagtgcggatagggattgagagggtcctacttgccaaggccacaagtttgggatgagtcagctgcatcatacatcagcagatgagctgtgaggcagggatgctccaatgggcacagagcagccagacccacaacctgccctgaagccactcagagatcacagttcagttacagggtacatggtgggcggcctaagaatggggagaaactggggacctaggacccaggacctggccacactgagtggacgagatcagcttcaggtcccgggaaagttcttcccagaaggcaaaaatgattcctgaagcatatggtcattgtgataccttggctggcaatataatctgtagtccaaaccagggacagtgttgagaatagaaagccaaaatcacttaataggccttaactgatctgtggtatgcattaaccagttgtcggcaagtccagaactgtggaccttctcctaaccctgtgagtggacatctgccaggtaagctggccacaagcagactgcactggaacacttagggtctccattttggcctagatgatcctcaggtcaggattcagacatgttgggcagcatcagaaggacagggtgggtgattgtggtccttgatagcaggcatagggcttcaataaggagtgaaagctcctgtaaagcaactactgactgttgacagtgaacggattcatcagaaactcaactcaggctgggcgcggtggctcaagcctgtaatcccagcacttcgggaggctgaggtggttggatcacgaggtcaggagatggagaccatcccggctaacacggtgaaaccctgtctctactaaaaatacaaaaaattagccaggcgtggtggcaggagcctgtagtcccagctactccagaggctgaggcaggagaatagtgtgaaccagggaggcagggcttgcagtgagccccactgcactccagcctgggcatcagagcgagactccgtctcagaaaaaaaaaaagaaagaaagaaagaaactcaactcaaaccagctttagcaaaaaagggaatctgtgggctgtgtaaccaaatc

SEQ ID NO: 105548 - DNA, 1016 bp, Homo sapiens
agttatattttggcaagtgtagactcccaggagagacttgtaggtacaatctaggccttgaagaaacaaaggctggaatatctgcccatgctttgggcatgagatgctcagatggtgcgtgggtagatctagttgaggaagtgtgggcctggctgttcatgggaagtcttcagtggccttcatggatggccatccagtcctgagtggtcaccctgggggtcctgggacacacctcagtaaagagcaaaggcaacgccctcagggtcccttcctccaagatggccatgtagggtaatggagatgaccagtccacactgataaggagttcctagcaaggcttccttgtgggtaccacaggacaactctgcccatagcaaagatgcttcagtccagagggagcccatgggctgtttgaatttgggagaggtgggattcattacaagactttgggctcttatgtcacatcacatgatttggagaaattagacacaatctcttatttttataccactgtcttgggctaaaataaacaggttgtggctgatggtgttgaagataaataagcttaaacaaataactttggccgggcacggtggctcacacctataatcccagcactatgggaggctgaggcaagcaggttgtttgagcccaggaatttgagaacaggattttgagaacagcttggacatcatgacgaaaccccatctccacaaaaaaattcaaaaaattagccaggtgtggtggcatgtgcctgtggtcccagctactcaggaggctgaggtgggaaaatcacttgagcccaggaggtcgaggctgcagtgtgctgtgattgtgacactgccctccagcctgggtgacagagtgagaccctgtctcaaaagcaaaacaaacagcaataacaatattattattgttataactaaaaaaaaaaaaacaaaaacaagcagcttttgtgactaagaaggaaaatatgcatatagtggcatatttttatatgaatcatctcctctgtg

SEQ ID NO: 105549 - DNA, 1069 bp, Homo sapiens
ccgcctcagcctcccaaagtgctgggattacaggagtgagccactgtgcccagccatgtcctatcttttaaatacacattttgtggggattttccttgagtcctttgtaatttggacacgtcattttaaagttggatgtcccttactgggagtaacatcaaacattgcatgacgacatgcagctgtgaggatctgcctgagaggaggtgttagtgtccactccatggcctcctgtactctctgcctatgactagggagctctcatttccccatcaggcctctgaaaagtctatactttaaaactggctctatattactgttggattattccacactggaattccactggtgatgctgatatcatgtggtcaaatgtgacttttaaaggtaagccagaacttgggataacagaggttattttatgtgaggaattttgcagtttaaaacgcacaggtgataatgtgatacttcccatgctttctcgaatagatttgtaagccttatggacaatcctattgataatgcccaatgtgaagatggcaatgaaataatggaaagtgaacgggatcgccaacattttgataaagaagttatgaaagcctatattgaagaccttaaagaaagaggtgggttactcatatttaaaattatttaaaattagtgtacagacgtccacttatgtaatacatttgttaatagaagtcaaattgacaaaaagtttattggttgaggggcacgttacttcgtaaattatttttccatttaccctccaacacactccaaatgatacatttccttaaaatatcaaattgtgctagtccatttgaatgcttgatgaatcatccactgtttgacagagaggctgggaaacgtgcacttaaaatgttagggttgcgttactaaccatacgtgagtttttaactaaacgatattgacaaaatagtatcctaagttactagaaaaataagatgtcgtttcaaaatccgtttacattcaacttttgaaaaagttatctcacataaatcaagaacacatataaaaatcacaaaagggaaagcacaggatggcc

SEQ ID NO: 105550 - DNA, 1032 bp, Homo sapiens
gtgggcagactgcttgagcccaggagttcaagaccagcctgggcactatggcaagaccctctgtctctacaaaaaataattagccgggcatgatggcgtgtgcctgtagtcctagttactcaggaaggagtctgaggtgggaggatcatttgagcccaggaagttgaggctgcagtgagccgagattgtaccactgcactccaacctgggcaacataataacaccttgtctcaaaaaaaaaaacgaagaacaaaacttagaataagttggttctcataaaggtcacatgtataaaataaagtagggacttcctgttagaatttatttgtaattcatgttggttttcttagctatgatgctaagtccagtgctatgattgtttttacctcttcttaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaagtgagtagcccggaaatcccagtagacacactcagacacaggtaaggagtgagaagtaccagagcctgggcagctgtctcaagacccggattagatggctctcgtactctgagaacctgatcccaactcacagaagttctggtgactttttacaggattttggagtttgtggcatatgacacgaggaagaggcatagggttcagaggatttctgcacaaatgcatgctggttgatggtgttgcgggacatatgtccagggcctgtgatctcttgctcagtgctcacatcgctgctggcctggaggggtcagcagatgttgaaaggaccctccctggttgcttcacccttctttaggtttccttaagtgaacctataaaccacccacaactaagaaaaaccatccatgcaaatgtactccaaacagcctccaatctggggatgtggaagtggaattgaaaagtcctggctccgccctcccc

SEQ ID NO: 105551 - DNA, 1154 bp, Homo sapiens
tcaaatattgtaagatatggtaattccttaagctgctccttgggctctagaaaccaggagccgctatagacactgtgctccagttgcaattatcttccccttactggaaattaggtctgagggctttgggagaacagggagtaggtaggcagcttcatttcagttggaaaagatccctgggcatttcaagaaagaatagacaaatcagttatttaaaaatatgacacactgaaggcatgagccttaaaagttttgtttcagattctgtaatgttggacgcttatcacactgaaaaactctgtgatttccagaacctcggggtcatgatgctacaagataatgttcattagatacaccccccaaaacccaaatactaaattatgtttagttccttccccatcattatttacagagctgtttacttcttagttttgctttttgttcttaaaagaccttaaacgacctattcaatggatgttaactttttctgctgacaggttgtttgaagaacctgaaagaactcaatgtgggtttcaactatctgaagagcattcctccagaattgggagattgtgaaaatctagagagactggattgttctggaaatctagaattaatggagctgccctttgaagtaagagataaacatttctgtactacgattcacttttatttggtttatgacatagaatggtctataatatggcaagaagttttaacatatgaaatctatctttattatatcaccttttcctgacatttcaatcaccgtatactggtctttaaaaacttctttttttttgaggtggagtcttgctctgtcacccaggctgcagtgcagtggtgtgatctcagctcactgcaggttttgcctcctgggttcaagcaattctcctgcctcagcctcctgagtagctggttctgcaggtgcacaccaccacgtctggctaatttttgtatttttagtagaggtggggtttcactatgttggccaggctggtctctaactcctgacttcaggtgatccacctgccttggcctcccagagtcctgggattacaggtgtgagccaccgcacctgcccttctttaaaaacattttatactatgtcagaacccgaatttaagttcagaaatgctatcaaaggaaaacca

SEQ ID NO: 105552 - DNA, 1022 bp, Homo sapiens
gaagcacaaattttgaaatcgaatgtatagacagaccttaggggatgttaagttggtatgttgcaaataaataatacacattgtggctctaagtgtgagtctggttttttgtgttcactaggatttaattttaataacatcatgaattcacggcagttttgaaatagggctaatatactgttgtgaagttgacgacaactgcggtgtctttggtttctttttgaaatggctggagtgctggtggttaagttttatgctctcgtgtctgctttctcacttcctgttttaaaataaatgcttggttttacacggctttgtgcacacggaggagctagttctgattgatgtcattctttctattttaggagctcccagattcattgaaggagcagacacacctgagagaatggtacataagcaataccttgattcaaatcattcctacatatattcagttatttcaagcgatgagaattctggatctgccaaaaaaccaaatctcacatcttccagcagaaatcggtatgtcaacttagcaggggtcttcgggcctctggtgtgttaagcaggcagctgtcaggcaggtgacagacactgtgcagacaccgtgtttcctctccagcttccccaggaagtggttgggcagggccgtttggaggctccccagagctgcttgtttgcagcatccctttgggtggtgaggtcggcgtctcgcctgtataactcagcacacaggacacttgccaattgctcagaaaccagaagtttcatgagtgagcaatattttatttaggaactctgtgtttattttctttttgttttaaacctataaacgtgcagtatgcttattagaaatgtaatgtattgctcttatacattagtccattgataaatctagtttagcttatgttgtctttttttttcttttccttgagacggagtttcgctcttgttgccccagctggagtgcaatggcacaatctcggctcactgcaacctctgcctccctggttcaagtgatt

SEQ ID NO: 105553 - DNA, 4283 bp, Homo sapiens
gatcattttagcctgcaactaatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacaggtatgagctaatcttgaatgtgaactttttttgattgctagagattgccagcttaggaagtaatgttctacacctgtcatttgatttttctcttgctcaagccttaaaagagctgccaaccgcactgctgtttttcctgaaagacctggaatttcacatggttacttctaactttgccattggcttttaacattttcgtgttaatgttaattttcattttatgttaatgactctgcctatgaaatagtgtttctttattcttgtacaaataaaggtcagtactacaaccaaatttaaaatcttccgaaaagattaaaggtataagcagattcaatacttggcaaaactattaagataatagcaaaaaaaaaaaaaaaaacccacattttttacctaaaaaccttttaagtgattggttaaaatagtttggccgggtgcggtggctcacgcctgtaatcctagcactttgggaggcagaggcgggtggatcacctgaggtcaggagaccagcctggccaacatggcaaaaccccgtctctattaaaaatacaaaaattagccaagcatggtggcgggcacctgtaatcccagctactctggaggctgaggcaggagaattgcttgaactggggaggggaggcagtgagccgagatcgcaccattgcactccagcctgggtgaaaaaccgaaactccctctcaaaaataaataaataaatacagtagtttgtaaaatgattcatcggtaacatgggatgcagctattttttaatccttatatgaaaattgtatgcaggggaaaacatgtgaaatagaagataaaagacatatacctacttaaaattaggtacttatgtgaggacagggcctaagaaataataatatatattaaaaagacttggatattggtgactttttttcaacatttttctttgttacatgaattagccattaaaaaaagaaagatggtgctctacaatttcttttcagtgatctgtggtcttgtccttgtgatgagaggacctgggtgttaacttgtaaggttttatttcctttgtttggctaactcatgtctgacttcctcttcctagtgtgatttggatcatggccatttctaaagtctttgaactgggattagttgccggtgagagaccttttgttcttttgatcactctcaatttttatgtggcctaaaatacagactccatgaattgattttgtcgttaagggctgggccatcaggaatttgctcgtccatctcggggatacctggccttcagagatgacagcatttggccccaggaggagcctgcaattcggcctcggtcttcccagcgtgtgccgcccatggggatacagcacagtaagaactgcctgacttcgatgcttctgccctggcccttcatgtgtctcctgagtatctttccaacactctttcacctaaaagggcacctggttctggaactgtgcaggtgctggactgcttttggttttggaagtgagacaaggattgtgtattttacttccctagagtgcagttttcctcccctgagtccacttcacactggggaacccagaaccaccactggcctatgcatgaaaatgacttctctgctcaaaggcacagagacttactctgatacaacacattggtgttgtattaaccttcgcttacaggaattgcccttgcacttttccatccctacaccctcagtcatctgttcttacctttcaggtaaggagctaaacagaacctgctgcctgaatgggggaacctgcatgctggggtccttttgtgcctgccctccctccttctacggacggaactgtgagcacgatgtgcgcaaagagtaagcaattcagaggggcggggagccgtggagaggagagagaaagggaagtggaaatttcagacccaaggctatcgccttacctgttcattctcaggaactgtgggtctgtgccccatgacacctggctgcccaagaagtgttccctgtgtaaatgctggcacggtcagctccgctgctttcctcaggcatttctacccggctgtggtaagcggaggttctcctctttcttttgccctttgaagttacgtagttgccttggggggtgcttagttagcaggctctccttgtacctcttgtcttgctagagcctggcagccaaagttctgcttataaaagcatcgcagactcctgatgagatagttgccttggcctctttgatatttatttcctcgggaacctggctagtcctgctgcctttcagatagagatgtatttcaagtctatttgacattttatggtctgaacttctattgaggaaaataaacaagtctcggtctcttgttaaaccaagagatgttctctggtgttcctttcctttgggtagggggacccaaaccaggatgggcagctcatttagagcccaccctgacgacaaattctatcagaggcttggccccttgctagtcctttagaaacttccagagtcctaaaagtccctggtaaccccctccccataccttaccatgactggtcacagaacccttaccatgactggtcacagaaccctttcaccttcttgatttttactgatttgaggaatacaatgaaaagaagggcagcacctggagaggaaaagaggcgacagtcctctctccaccctagcctgagccaggtttctagggccccccaaattcagagacctattatagttctgggccttggagatgttagaaatggaaaatattcaagtccaggaagtaaatgaaagcaaacatttcactgagaacaggaaggaattccccaatccagacagggattgtgtctttgccatttgcatcctgggtgtcaggctcaggataggtgtttgataagtgtgggttgggtgattggatgtgtagggaacatgttctcttcctggaacatggggcccaatcagaatctaaccaggttgtgctcattcctgcaagtgaaggcatcaccactgggctaggttccaggtgtgagtgtcctgagaagagcaggttcacagtagcgtatagatatgccacatttgtgggcagcaggatgaactgccagagaggtttgctttaatgaccaagcatccctaccttccagatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttc

SEQ ID NO: 105554 - DNA, 1020 bp, Homo sapiens
tgcctgcaggtacattgagtcctacacaagctgcatggtggtgcaggccttccagaaggcagcaaagaggagaaggtgagcacagggctggtgcactggcccctgacagggtgggagtgcctgagtgagggtggggtcggggaagccccctccccagagcagcaggtgtcacagcccacaactcatcctggaggactcctggctctacaaatctgcactgatccacactggaagagaaacagggaaggcccagtgaggccaggaacagaatccagacccgctctagctgggctggccttggggcggggaaggaggggaatcccttcagggtggatggttgtgatcagcaatcccttcatactctgagatattgctcttaaacctgtgagggcaactcaggtactgtgttgatctgatagggtagaggttttgggcctggggctggccctgggatctgaggggattagctggggcagggaggtggcggtgtgggtgcaggaatggaggaaggggtgaaggtggtgcgtggccctctctacacgcagcgagtactggcggggccagcggaaggcgctgcggcagctgctttcaggtgtgagctcagagggctcggtgggcgcatcgctgggccaggccctccaccagccactcgcccatcacgtgcaacagtacgtgctcctcctgctgagcctcggggacaccattggggaggtgggtaccaggggcagcagcatgtggggaagccgagggaagggagggatagggcccagactcagggggctcagcctatactcaggaaccctagtacaagaaggactcagccatgccggcaggtgggagagggttgaggaagtcacaggcctgtcctgtggttttcaggggacatgggggacgtggcccagccctgaggagggggtccgaagacatggttctgtcctagggaatcttagtgggtgaaagcactgcccttccctgcggtgtctgaggcacgtggccctgccctggtagagccagcagaga

SEQ ID NO: 105555 - DNA, 1044 bp, Homo sapiens
ctgtgctgtgtcttcaactgtcgtgtgccacggacccggaaggagatcgaagcccggtacctgcagcgaaaggcagccaagatgtacacagacaagctggagactgtgccacccctcaatgagctcacagaagtcccaggaggtgagttggccctggcttgagccctgctgcgccagccagttcctcagtcctgctgcctggagtcaccctgttcctctgctccaaccaaagcaggttcagggaggggccccagccctgcccctggagaccagagcacagaaattggttggcatgaggcaaatagaacgatgagcctattctccagtaggaagaaggaagaaaaaggcagagtgtaggaggttctggggctcttcccctcaggacagtcagaccccaggaccttgtctcaccactatcacatggtctcttccccctgccccacagaggataagaagaagaagaagaagaagaagaaggacagtgtggacacagtggccatcaaagtagaggaggatgagaagaatgaggccaagaagaagaaaggagagaaatgaagacatcctgggcagcttgggctggcgggccctggagctcaagccgtggccggggtccaggcatgttggactctgagctcatttggggaccacagaggctgtggtcagagagggaagctgaggcccatggccacatcctcatggcccatcaggggcaggaaccagacaatctcgtaggtgtcctgccccccagcctaggcttggctcctttcaccccatccacatgggtactgtctcggcagaggtggtctggtgccaccgtccctctgcagatacactgctctccccacccagacctgcctgtctcccaccctttctgccagggatggcagtggctgtgaaggagtaatgggatatggggttacttcagccaccctttctggcacgaaatggctgaagtgcatgggtcagggtgtgaggccacacccagagtagccatgaggaggcagagagggtcactgggggacactgtggcagcaggagggactc

SEQ ID NO: 105556 - DNA, 1054 bp, Homo sapiens
gaaatggaacccccagcccagcagacatcaagctcaaggcaatgggctaccctcatttcacacgttgtgatgaagctgaggctgctgccaggcccggcatgaggccccgaggctcgagctcggggctgggggctgcagggctgggtcaggggtacacagagctaaggccaatgggctagagggtgccggaaagagagctggagtctgggctcctcttgggaatcagagtatatttaagaagccaagggggacctcgggctgttctggtggccccttctatgcccagctgtgctgggaggtcccagggccctagaagatcacagcagggccttctgcctgctgaccataacagtgccagcttctttgcagcttcctcttctaccatttcccactacgggcacctaaaagaagcatctctgaccagaagacaaaggcccaaatagcacctgggggagggaagatgcacagaggcacttccagatggcatcgaacagactaaggctctgaaacctaggcctgaacactaaggtctcgagacaccagaggtttctgagccaggagagcctgctggaaaagcagcctgcagagatttgtgaataaagctgattgccttctcagagccaggcctagaaaatggcctcctgagatgacccctcaggatgcgctattcctggggcatttatgtggagggtgatgcagcagtcagtgacagatggctcaggccaggccaaagtcccctccctgactcttctgccagcctgaattaggatgagatagagggagaaatgggagccaagaggctgaggggcagctgcagtcacctgggcccatcccggaggcaggcacaggactcgggagggacgctgccagctctctgggtgctgagttcacaaggctgcattcatgattttcaatagacctgtgatggtctgtgcccagtgctggggacacagaagagtcaaacctggctcctgacctggacctggatcatcactgtacagggaggagagtgatccaggctgatgaggaaagcgcatgacatggggtcttagga

SEQ ID NO: 105557 - DNA, 1007 bp, Homo sapiens
gctattcaggaggctgaggtgggaagatcatttgagcctaggagtttgaggttacagtgaacaatgatcataccactgcactccagcctgggtgacagagcaagacctcatcagaggaggaggaaaagggaagagagaagaagaggaaagaagaagaagcagtctgcatttccctgcagactaagggcggagcagcttctgtggtcattggctactgggattttctccttggactatgcccatttttctgttggggcatccactttcctctcactgagccacagaaaggggttcccagaggagggagagagctctgccttggctgaagtaggggacatggtgagggtggaaccaggtggaaatgagaacaagttagtgaaggatctgattggagctgagagtgtgttggtgacggcagaggggccagtggtacactgggctggtcggctggggatgctctagggcccgggctgtgggaacagggagagagatatctgggcagtgcttggacccttctgaggcatgagactccagtccacatgtggacagcatcattccatggtgacaggtgaaaagggagcacccctggatgggtgcaggccagtggctggagaggcacgaggtcaggctgggggaggggagggacagggaaagatccatccctcatcaagctctcaccttcctcctcagcctgtggcttttcctacgagcaggaccccaccctcagggacccagaagccgtggctcggcggtggccctggatggtcagcgtgcgggccaatggcacacacatctgtgccggcaccatcattgcctcccagtgggtgctgactgtggcccactgcctgatctggtgagtcaaggctgaggtggggtgggtggagaggtatttggagctgctgtgggcccagtcatcccctccctgccagctgttctgggcccacagtcccagccccagcctcatctgggctccaagcaggtggaggctgagtcctgaaaattccttc

SEQ ID NO: 105558 - DNA, 1003 bp, Homo sapiens
gccgtggcgggtggcccctggggggcgccacgcaggcggggcactaggagcatccccacccagctcaccagaggccgcggcatgcggccaacagggggcgccgtcgtgggggcggcactgggagcgccttccggagagacgcagtcggctgccaccccgggatgggtcgctggtgccagaccgtcgcgcgcgggcagcgcccccggacgtctgccccctcccgcgccggtgccctgctgctgctgcttctgttgctgaggtctgcaggtgagtccctcccgatccctaccccacccgcctgacgcggccctcgccttccacctctaatccgctcgacgtcctccgcaggttgctggggcgcaggggaagccccgggggcgctgtccactgctgatcccgccgaccagagcgtccagtgtgtccccaaggccacctgtccttccagccggcctcgccttctctggcagaccccgaccacccagacactgccctcgaccaccatggagacccaattcccagtttctgaaggcaaagtcgacccataccgctgtgagtaccaggggtgtagactccgtggggcaaggagggtgacagaggagtcttaaggaccttggctggggctaggggagcagaagggacgggggcgagcaggatagaggagcgcctccttctacaggtgttcattgagcactaaacacctgtgggtcaggcctggtcctgtctggaggcccagagctctgggtgtcttgtcctcacaggcctcccctcctgctgaggtagggggcaggaaagtcagaggggcctggggccggctgtgtgttcccgcctcgcctgagctggctgtggggcaggtggcctctcaccctgctccaggccctgacacccatcatgcctctgacccaggctcccagccagggacctctgggatctccagcacagctttcagggccaggctgtgtgagccttcctgtggtgtctccagggtgcacacgtaagacgttct

SEQ ID NO: 105559 - DNA, 1367 bp, Homo sapiens
gaccctgtttttctgactgagatgattggtcagcagaggaggtttgggaaaggacacgcagaattctgcttgagttggagggtgtggggctgtctgagagtggaactgaaaatatggagggagctggctatgtaggttaggagttgtagagaaacttcaggctaaatatgaggatttagtgggctgccatgcagaggttcaagacgtttaacagccactatagtttggaaaatgagaagccatcattttctcagagcatattaaagttttcccattaactttttagttcccatgctcacatattcagttgtcatattcacagaaatctgggtggtggggcctttgaggtgccagaggaagccctatgtgtgcctgtctcctcaacaccttgtagtacagtcagtctgctctgatatagatcctattcaatttctgaagttcgtttctttctctttctctagggagattctgggggccgcttggcctgtgaatataatgacacatgggtccaggtagggattgtgagctggggcatcggctgtggtcgctgagggttgcctggagtttatacagaaattggtgtctacagtaagtggctgattgcagtggtggatcaggctacctgtttgtatccagcagtgttcctcatcttagtcctgcatttggtgctgcccctgggcatcctggtggcccagtgatcaccccagcccactccccttttgtttctgagtctcatactaggcctctcctccaacctcccactccttctcaatgccgtttctgaaaatcccagttggaatccacgggccctctggagatccatacaatagagcacagcagggagactggggcctggaaagtgcccctgcctggtgctctggtcacctgcctcagccatgcctgcaccagggctgtgctctggctagtgggaaggagggggtgaactaattccagctagaggaccagcctccctgccaggtgggccacagtgactcatcagtatctgggggaacatctatcaaagaagagacatcatcaacagtgaagcaagtgttagatgtggttctggtttcagggctcccacctaagactttgtgaaaccagccagctgggtgattgctcagcgtgaaggaggcgttaccaggtccctgcagaggtgtgaggcctgggacttccactctaggctcagttgtctggggctgggagaagttcccctgcagcccagtgtggatccatctgtgagtggacagcctctgccacactaactctcttggggctacccattcttggcacccccttcctcagtgccctagtggccactttcagagacactacaagttgtattgaggcagttatggagtgcagag

SEQ ID NO: 105560 - DNA, 1210 bp, Homo sapiens
cctaatcccttggccctgggcagggttctggctggacatagtctggagtgaggatctgagtgaaaccgcgagggcgacatttcccattcagacaaggaatctagcaggaccggggtccaacaagtcggctcggccatttccaccccctaggcaccggccctgccccctcgtccctcgcaggcgccctggttccagccaacccctggcaggggcgcgagctgtctggagaggggcagccggtatccatgacatgtcctctggcggcggctcccggggcctcctggcgtggcttctgctccttcagccctggcccgggcagaactgggcgggcatggcggcgccacgcctcccgtcccctctcctctcagaggagggcggcgagaaccccgaagcgagcccggctccaggacctgaagcgggccccccactcaatctgtttacgtcctttccaggtgactcactgcgtgggaggcccggaggcggaggttggggcgccaggctggggcaggtgctacctgggagcctgcggtccgcggcccggggaatctgaagcgtggctcgggagccccgggggacatggcctccttcttggctgtcgtcggggcgcccgggggagtcaactcctgtgtctttgagtgagttcttcatcctacactatcctcaccccagtgtgtggccgaacccctctgagaatcgtgggaggagtggacgcggaggaagggaggtggccctggcaggtgagcgtgaggaccaaaggcaggcacatctgcggcggcaccctggtcaccgccacgtgggtgctgacggcaggccactgcatttccaggtgaggagcggcacgcggggctgggggccggccccctcaagcacacacagttccattgccccggcaatttggcgacaaagaaacaaaactcacagtgaagccggagtgcatcggtcgtcttgctgtaggcatgtctaagtcgggcagacaaaccaagtttgagagtgatcaaggaagggtttttggtgatggcgatggggtggtagggacagtggcccgggaggttgaggccagtttcagaaacattggaaatgtatggaaaaggcacaaaggatgtttcccaggccttctcttagaggcatctcttccacagccgtttccattacagtgtcaagatgggagatcggagtgtctataatgaaaacacaagtgtggtggtctcag

SEQ ID NO: 105561 - DNA, 1007 bp, Homo sapiens
aggggctgtgttgtgtggggagtcctgagtgtgtgtgagagtgagtgtgtgtggatgggggctgctggcagtgtgtgggagagagtgcatgttaggggtgagtgtgtcgcaggagtctgttgcatcctcctttcattctctcagcatttactgagcaccgactgtgtgtcaggctctgttctaggtgctgggaacactgcagtggagaaggcagtggaaacctctgccctttgtgtagaactcacacaaaccagacaaatcctgacagtggagtatcgaatggtgctaaaggcagagaaggactgaaagcagggagggctgtggtgtgtgtgtgcatgtgtgtgtgtaagccgggaggtgggtgacatgttaaataatgaggtcaaggattatctgggcaggaaatagttgagcaaagatttaaaggagagaagataatatttagaatatataaagaacttctataactcaaaaaccaccccccaaacaacccaactaaaaaataggcaaaggacttgtatgtatacatttctctaaagaggatgtgcaggctgggcgtggtggctcacgcctgtaatcccagcactttgggaggctgaggcgggtggatcacatgaggccaggagttcaagaccagcctggccaacatggtgaaaccccacctctacaaaaatacaagaattagcccagcatgatggccggtgcctgtaatccaagctactcggaaggctgaggccaaagaatcatttgaacccgggaggcggaggttgcagtgagctgagattgcgccactgcactccagcctgggcaacagagcgagactccatctcaaaaaaacaaaacaaaacaaaacaaaacaaaacaccaaaggatatacagataaccaataagcacatgcaaagatgctgaacatcactaatcattacagaaatgcacattaaaaccataatgagataccacctcacacccattagaatggtttttataaaaaaacagcagaaaataac

SEQ ID NO: 105562 - DNA, 1048 bp, Homo sapiens
gtagattctgggtgtgtcggctgcctgtagccaaacaccctgttgtgaggatgggatttcacttggccttggagtttcccaggagtcccctattcccattttcattccgtgctgggtgtccaggggccgggatggggcatcgctggggttgggagacacacctgactgccgcacccttactgccccaaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaaaggaagcggtgtgtggcttcctgtggcccaaactggggactcactccgagagggtggggctgggagccagggaaagctgtggcgggagggccatgagtcatggaggaatcctcaggtctcacttcagaatggggagggatctggggcctgtggtatccagcagaaagggcccagagtggctcaagtctgcaggggtcacacagcagccaagtggacccatgtggaaatccagcctcagcctccgttgctgccagctgtggagctgctctccacacttgtacctagaccccatgggggacccaggctcctctgggccaactcttctgactgctgc

SEQ ID NO: 105563 - DNA, 1007 bp, Homo sapiens
ccacctttgccttagctcagtcccttgtgttgggtgggtttgtgatgctagtccccctgcctcagtgggacagggaatgatggtttatgctgggtttcggagggtacagaaggggaatgtcctggcctcttccccagggcagccccctccagcaaccgagcatgactcctaatgccagagggctgcaagaggggaggggacccaatgccacatcaggccagccttcaccttcctgcttctccctgcctccctgctccagggacctcaagagagatgtggccaagaagctggagaaactaaaaaagcggactcagagggccattgccgagctgatccgtaagtgcagtgcctgggaaggtggggtcctgcccactgggtggtggcccaagcaccgggcccctccccaccccttctgtctgccatccatcccaggtgaaaggctgaaaggccaggaagacagcctagcctctgcagtggatgctgccaccgaacaaaagacctgtgactccgactgaggcatgccctgccccaccactcgcccatcaggcctgtcctgcagaggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggcagaaatgtgtcagatatttcctaggtctgagggtgcagtggatttgggctccacaggatggagacagggtgactgcagagctggtacttaatatgtatgaataacccctgtgttgggctgggcatgttgaggccggaggggtgggaaacactcagggctgccttct

SEQ ID NO: 105564 - DNA, 1118 bp, Homo sapiens
tccagttgtgcctatgagatgcagcaggcgtgtaccctgttggagtctgggacaccaagctgggccctgccaggtgccccccttctgagatgtcctgttctttagctccctgggccacgtggactggaagtaggagctttcaactgagctggtggttttctccctttctttgcaggacaaggaagatggggagccaaagaccaagcatctcagagaagaggaggaagaaggcgagaagcacaggtaatgcccgtgtgcagctccagggtctgctctctcctccagcactcatcggtctcccagtctctgggtcctcccaactctgttcagtgtctgccctgttccctcccctcttctttctgcccatggctgtcctgttcagaccttaaaatctcaacatctcagaaggcccttgtcgaggccttctctgcctcctttccctcattttccatttggctgttactcagcccccagcattttctttctagcccttacattatgcctttttacccttctcatacaccttttgtggcgtggttctccattgcctactgagtaagtgccccttctgcacttggcatgtgaagctctgcctggaccatctagcctcatccaacctcctctggtttccctctagccagagccctttgtggtcggcccttgccacctctggccactcagcatttcctgaccagtcttttgtccgtcctctcagcctggaggtccttctcatctctcctatacctttgatgtctgggtcttcacatagagttcagctcaaagggcgcctttctcgttgtctgtgtccctctggcttcatttccctctgtagtatttatcttattttgtcgaatactctcatctggttgggtccacttaagttgcctaaacacagcacacgtgagggtcttgggtacacttccctcgtgattgcaggcacaaggtcttcccccgcagtcttgagggctgcaacctccacagagcctcagatgctgctttgcctcccaaaaatctggagcctggaaactgttgccggaaccagtgtgtggggtgagcgaggcaaagctgtgctgctgatctttgtgagcagagtgtctgactaccactcccgtgtcagc

SEQ ID NO: 105565 - DNA, 1046 bp, Homo sapiens
ttcatggtgcagggtcatgcgggaccctgtaccacatggtggacccaagttgccttgtataatcctcacatgcccctgttaaagtagtgccagccccactttgacaggggaggagacagagcctcagggaggtcccaccactggtaagcagtgtgtcctgatgttcccaccacctgcccagtccagggctgcaggctgggcttcctgcataccacagtgcccctacagggaggaccctggagggagtttggagccaggccagacttcccagaggaactcgtccagtctggctgcatatgaaggaaggggaagagactggtctttgccctgccctctgtgtgacctttcaagaggttatttcctgctggggccagtgtgggtgaagtctcagggcagtgggaggggccttttgcatactaatggttctggttgttccctctgctctcttccccctccgtccctctgtccccactgtcactcatcctttaaggtgacacttcctttggaaagcctctgtagacacctcttaatgccacccaaaaaaacactgccttccctggctgttgacaccttcccttttcccctgtgggtcaccacccccttgagaatctgaagagctccagatttctcatccactaagattcaccttctcacactcgcctgtgtttctgtctggtcattgacctctggaatctgtgcaccgaggataagaacccctgccctgctctgtgggcactaggtgcctactcgttcctcttcctcctcagtacccagcatggagtatctgagtacagcatggagtaccacaggggagccagtcagtatttgtcgactgataaagtctgctggaggagctctgtagtgcctcccttgagcacttgcagcaagaataggatcagagttgacttgggctggctccccacactcctgacagacacatggaggatatctgggcagggccgtgtgacgggcctggcgaggagctgcactaggcatgccgtggcctggcccttgaggtgccatatggatggtggggcccagcgtgc

SEQ ID NO: 105566 - DNA, 1052 bp, Homo sapiens
cattggttggcttatgagtagtgtccccatttgggctttgtcccaggctgcataactcacaagacagagcctgagctggtagaggtgctgagaaaacacttgagggattgagtggatggcatggagagtgatagctgtttccaggtgtgaaagaggtggagggattttaggcagaggaggggcaggagcagaacaggcaggcatggaggtggtctgaatttgggaagatgatctgtggaaggcccttcttccttgccacctccctgtccccccacactggctagcgttttctgacttggattcatattctctgcacacgtgtagggtctgctcttctcaactgtggtagctcgagggcaagggctggggcttcctccgggtgacactgatggctgctctgggtgaactgagggaaggaacaaggcatgaatgtggggatctgttatgtgacccctttgtcacgggatgagagggcctcaccccgaagacacaggtgagagtctcaggctccaccatcatcatcactgtggttggcgcctactgactgaggacgtactctgtgccagccacagtgtagggctgtcactcacatgcgtacccttaagtcatgccatctagcagttgaagaaactgcagctctgagaagctaaactggcccagagtaccacagtacacagttgttagtgctgggtattgactcctcatgtggttctgctttctcaacctttccatatgctgagcatgtggatttttaaaaacgctttgtagctaaaggaagtgtgtgtaggtggggataagaccttgtgaagcagtatttccccccacaaaaaaatgtgccagttctgacttgtttaaatttggtttaattaggatttttatcacttgtagatcacaccagagagcagacagctgtcttacctttacttctcagattgtgacactccaagaagcagctgaccagaggttaaaatagcttctagtctaggagcttcagcacattttgttgctgtgtaaacctctgacttgcctggaaattgacttgtaaagaattt

SEQ ID NO: 105567 - DNA, 1125 bp, Homo sapiens
gagtcagggcattccaagaggccagcatggagtgattagtgtggttagtacttgggcaaaaccggagcgatcgacgcactcttttctccttctctcaggtctgaattccacttgctgctctttcactgatcagcgttggataaatcgagccttagcttttttttttttcttttttttttttgctggctccccacccactaggcaagttgtccggaagaataagggcggggcggggcggggcggggcaaggcggggagggctcgcccataataaccccgcattgattggctttcaggacctcccagtctctcattctcgtccttggattggccgcgagacatttatccactctccttaggcctgcgcgatgcaagacgggagaaaaggaggggcgtacgcgggcaagatggaggcaactacggctggtgtgggccggctagaggaagaggcgttgcggcgaaaggaacggctgaaggccctacgggagaaaaccgggcgcaaggtgagaagtgtggagtgagggtcgcagttgaggcgtccagcgttcggggtccgggtcgcgcttgaggagagcaaagggctaataaggaaagacagctgccgagggcgcgcatgcgcgggcgctaacgcatgcgcgagaagacggcgccctcccacgatgtctggggctgcttggcgtgggactcctctggcgctggtgcggtcgtcgcgcatgcgcgggggtgggcaaggcagtggtcagcgacccgcagtccatctgactcctgcttcccgggtgttgctcgtgtaggtatctagggctgcctgtaggttcagatgcttgttgggttaggcgtgatttgttccgttcctctatggcctagctggtctttaacccccgccttcgattctgagtcagacagactccccagtccggcagcactccttggacagggcagcaagtgacagcagtgggtatacagccggagtcgtttcgtgcaaaaatcaaaaagaggccgggcacggtggctcacgcctgtaatcccagtgctttgggaggccgaggcaggcggatcacttgaggttagtagttcgagaccaggctgggtaacatggtgaaaccccgcctctactaaaaatacaaaa

SEQ ID NO: 105568 - DNA, 1049 bp, Homo sapiens
tcttgcctcctgtctagaggaacaggcctccagcctccccttggtgctgctcatagaacaagtcaggaaaatgatctcaaacccagggtccctcagcaccaacctgggagtcttaggtgtgggggaaactactgaatgtgtcacttaaacttactgttctccagctaaggaagttgataaaataccaaggtaaaataatcagcaaggtaaaataatcagcaaggtaaaataccttccaaacatgataaagccagcaaatggtagtaggcgcaggatatgaactctgatctgtgcctccagagcccatgcatcctataggatcacactgcctgccatcccaggtgctgcttggagaggcccctcccacagcctagggacccccaccccttttctgggcctctgcctcatagccacccactcaactgtctcacaggcccaaggagccagatagagccagcggaaaagtccgaatcacctttaatatgggttacaaaagtagcaaaaccagctgaggcttaataagaggaggtggagtagggatccaaagggcagaaccactcctcactgcccactccccaccatatcctgggccctcttctggaggggatgggtggataaggggaagtgaatggtggctggatcttcggttttcttccccagaacagagcaggctgagcccagcaaccccaggaagcccacaaagggaaagatatatgagatgggggtaggggagcaccggagcagtctccgagagtgcaggctatggagacagcactcacaccacagaacagccctcagcttgggggcccaggacctggaccacatcttcctggcccatggcaaccagggcattctctagcaccttgtgggtggcaccactgtcttcttggatagcccagtccctcagcagtgtgtaggctcacacctggccttgggccatgatttctacagcctcagcttggtagcccagatggtctgccagtccccgccagcccttgtcaggttcacgtgacacctctaacagccgctccactttctcctggtgctgc

SEQ ID NO: 105569 - DNA, 1010 bp, Homo sapiens
ctttttttgggggggggtgggggaggggggtggggagaaagggtctcgctttgttgcccgggctggaacgcagtggtgtgatcatagctcattgcatccctgaactcctgggcccaagcagtcttcttgcctcagcctctggagtagctaggactattagctaatactttttaaaaatttttgtagagacacagggtcttgctatgttacccaggctggtcttgacttccaggcctcaagtaatgctcctgctttagactcccaaagtgttggacacctggtttgaaatgctcatttgatgtttgggttccctagcttcccactgtgctccctaacactggggttggacactagaggacaggataggacccctataaaagaggtatagtgcacaggttatgatgatagtgaacatttccaggaagatgcagggcttggtgagagacctctctcccacttgttggatcagttatctaggcagtgaggaaggctaagggcttcaggccagactgggcccatctttgcaaaaaggttggtcccacctgtttctcaccagggttattctgcctgctgcagcagtgttcttgaggtcaggtcaggttgtggcctgccaaatctttggcagggtgagtagcaattagagcagtcactgcctgctaggcactgtgctgagcacttagagctcaggttgtggtcacagtcctgaggcacaggaattggcactataatgaggaaaactaagggtcagagaggttcagtaactcttctaatatcctcatattaaaggaagtgttaaaagaggggaaaatccttattttaaacttagacatgctattgttttctcatgatactgcagccttcaaaactgtaaagcactttttttttttgagacagagtttcgctcttgtccaggctggagtgcagtcgcacgatcttggctcactgcgacctctgcctcccaggttcaagcgattctcctgcctcagcctccctagtagctgagattacag

SEQ ID NO: 105570 - DNA, 1436 bp, Homo sapiens
tcctgtggttcctgggattgctaagcctcatagaagctctggaacacctgctgtgctctgccttgcctccagggcccagagaacccagctactgtctttatgccaaggacacaaaattcattgactgaaacctggggctgctgaaggactcagcattgaagtcatgctgttgagtccctccagcctcctttaaggcttgcttagtccatccaggggagctctttccctctcaggctgagcccgtatccttttctcagatcttactggcttactagtattccactgtccaaaccagttaacctgagggaggaaaaggagaaggattggctggctttactcactaccttttctagttatttcctcagtacaactccttgccctctctggactgttgagcaacgtgttctcttttctctgcctgcagatgtcccagttcatcgtccagtgcctgaacccttaccggaaacctgactgcaaagtgggaagaattaccacaactgaagactttaaacatctggctcgcaaggtactccccttgcttttggtagcccaccaggcaatgttctgggcaaactgtgtaccttctaagaagcccttttcatcatagaaagtatttttttttttcttgtcagatgtcagagctggggacccaggaacggggagggaaggtttggggagggatgcgtaccttacatgacagcagtagttctctaagaaattttcagagctcagcttgtcctttctggtgatcatagcaccagcctgccccaacatctacccccttattaacttcctgtcttggtgagaagggccctgaagcagcaggctggattaccacccctgtcctccccctcatataatttctgctctgattggtggctgtggtctctcttcctgtgccctggacagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatatt

SEQ ID NO: 105571 - DNA, 1102 bp, Homo sapiens
ttataagaaggagagccaaaccatgtaacaggatttgaaacataatagccaagttgactccaggccttgtacctgagtcagggcctctaaacggattctaataccaagaatcaggtatccctgctaggggaaagaaaggagggttctgggacagtagggcatcactaaactgacttctcatgccagcaccactgtgttttctcctccatttttaggcctcgaaaaagcccaagacagcagaagcagacacctccagtgaactagcaaagaaaagcaaagaagtattcagaaaagaggtaaggtttggtggatataagcactaagctcctcaggcttaaatctgaaccctttcatttcttgtcctaagtatgtcgaatatctcctttgccccaagataggcaggaacacaaggtgttccttgtgtgtatgtcttgctgaagtgcttcttttagcactgaaaactcctcagccatcttttcttggcttgacaggagcccctctcagaccacatttgcttgtttgactgtgggccttctgtagcatctatggcaaaagaaagctgtctgtagtggtaggctgccttgtctttgggtattcctcttgcttctgtgatttgacttagttgttatgtgaatgacacattggtgaaagaggtgtggcctttttcaactggttaagcacttcagtacccattgactcattttgtccccacaacagcccttgaggtaggcaagacagattgcctttcctcttattcaggtgaaagaactcttaaggttcagagaaggcaagttctagacaaaagatttgaactcaggcgttctggctcaaagtccagttctctttctgtaatatctcatttggtagctgcctaattctccagggcttgggagaatgctgctcctttttatgctaccagaagtgtgtcttaccaaccatcaagacactaaacttgtctgcttcatagcatctaggttctaaactccaatcttcattcactgaaggggcttgtagtgttttggaagaaacagacctgtaaataagtagcgacagctgtgtgaaaagtatgccatattagggctgggagccacaatctgggcag

SEQ ID NO: 105572 - DNA, 1015 bp, Homo sapiens
taggaactacgactggagatgctggggaatcttgccaagactgaaaagcaggattgagggtttagcaaacaagtgagtaagggagtcatggatggcctgcaccctcattcttagcttgggtggataagatcccatcattcagcctagggaatgaaagaaagaggaggaggaggtgtggagattaagttcattgtggagtttgagctccctgcagtggctgctaggcaggcaaatctgggtttgagtcatcagtaaattggtgcttgttggagacagagctgtatggagtgacatagggaaggcatataatggtcagataattctttgaagagtgctgtctggtagtaaaagcttttgatgatgagactaaacattgtgagactgttccttttctcttttccatccattgttgttcccttcattgtcttgtactcaccatcaagataagtgtaagtggtggtaagtgtaaagtgtaaagtcaggtcttccctttgagcacctctgacctgaattattactacttgcacaattgaggcagcagtttatttactgctgcctcctggcttttaattaacagtcataaggtataatagatctcctctaactatgttatgttaaaatagtagttttagagtatttgttgcattgagggagttgcagagaggtggcatcaagagccaatgtatttttcaaacggggtcttgctctgtcgcccaggctggagtgcagtggtgtgatctggtctcactgcaacctttgcctcccaggttcaagtggttcttgtgcctcagcctccgaattagctgggattacaggcatgcaccaccaggcccagctaatttgtttgtttgtttgtttatttgtttatttgagacggagtctcactctgtcgcccaggctggagtgcaatggtgtgatcttggctcactgcaccctctgcctcccaggttatagcaattctcctgcctcagcctcccaagtagctgggattacaggcgcctgccaccacgcctgg

SEQ ID NO: 105573 - DNA, 1059 bp, Homo sapiens
acgggtgtgagccaccgcgcccagcctttttagatcattcttaatctgcttctgatttagaaactataataagtctgaattcattctaatgtcatagaaaccattttagtgttttgttcaagtatctttttttcctttaatactgcagagatttttttttttttttttaagagacggagtctcgctctgtcgcccaggctggagtgcagtggcgcaatctcggctcactgcaagctccacctcctgggttcacgccattctcctgccacagcctccggagtagctggaactacaggcacctgccaccacgcccagctaatttttgtatttttagtagagacggggtttcaccgtgttagccaggatggtctcaatctcctgacctcgtgatccacctgcctcagcctcccaaagtgttgggattacaggcgtgagccaccgttcccggcctactgcagagatttttaatctgtgatccataattgaacttcaggagatgtttagaacctctaaaattacatgtaagactatagcatttctggggtgagggtccataaatataagcaatttctctaacaggggcgtgtatatatctgggttgagaaaggaatgaactgtggttcaaaaagtgtttctagatgatttgggtatcaggagggctcctactcttagctttgtagtgaagggtgggtaaggctagaaaagaaggtggttgggggaccaagtttaaatagaggcagtgaactaggaggactttctaggtatggcacttactgaagaacaacatttacaagttgccttgtgagtagctatggtctttaccaagaatacacccataatgcacaagagtctttggtactatgcctaggactttttctgaggtattttatcttttcttcttcttttttagttttaaaaacaggctatttctgcacatgaggcaaaatatgaaagacatacagtgaaatgtttcctccctacccttggcttccatctgatttccttgaggcaatcaagcagtttcttgtgtagctttccagagataatttatgcatatta

SEQ ID NO: 105574 - DNA, 1031 bp, Homo sapiens
gcaaaaatggtctaaaatttattggtccattttttaaccaaatactttcatctaaatcaagggttggccaaatctgccccactgtctgtttttgtaaataaaattttctttgaaacacagccatgttcattcatttatgtactatcatctgtggctgcttttgtacttcagtggtagagttgagtagttgtgagaaagactggatggctcacaaagcctaaaatatttactatcttgtcctttacagaaaaagtttgccaacatctgatctaaaagataaagtgcagaatctggctgctctaaacattctggttttgaatgaagtcattttcactttactcttttgggtgagctcttaattctgtttccctaaagacataatgatcatgtttctattgctgcccatgaaattagtttttttaaaaaagtcttgatgctgtttaggaagtgatttggttgtacaactatcttgagaggtgggagggtgtatacattatagaatttccaagctagaagtgatcattaaggaatattgttattcccttaggactgtgaccaagtcagaaacttgagactgttttagtatagatgtaggcagtataatttaagtcttatagtaaccataatgaaaacacatacattttccttcttaatactttaaacttttaattatgatataatttcaggctcaatgaaaaactgcaagaacagcattctgtacatattctacatgttacacacattctagtgacgagtctagagaaaattcagtgaaaaattcctctaaacttttcactgagattccccagtgttaacattttaccttattttttttattgttttctgtttctgaactttaaaaaagtaagttacagcagaggtgggcagatcatttgagcccaggagttcaagaccagcctgggcaacaaagcaaaaccctgtctctacaaaaactaaaaaattagcgaggcatggtggcacatgcctgtagtcccagccacttgggaggctgaggtgggaggattgcttga

SEQ ID NO: 105575 - DNA, 1088 bp, Homo sapiens
ttgtaacttgaaccatttccatctagcttctcagggcagcaaggagcttgttaacatcaccagctgaccatgtgtctccttttctcaactccatttccaacttcgtgctgaagaaaaacgagaacctagcgtgcattctgtgaagaaacaggaagatggttgggaagttggatgatgcatgaaaaatataataggtgaaaagaggacagaggtggttaactcactggcgccggcgttattttggtgcgtccattgccgacaatggatgtcgttccgggaaaatccctactcctggcgagaaaggattaagtgagctactttttctatacctatatacacaggaccactgccttgactccacaaggcttacacattttgactcctaaagtagacctcaaccagaaacatcacctagcacattgccacttgtgagcatgtattcattttcatgtgaaaatttactaggctacattttcagcagggatatgtgcatatatttctgtttgcagaagaaattgttgcatatcacccttcatgctgaaaatataccctagacttcatagggcaaaacagctggttaccagtggtgactaagtgtaacttgactggaatatcttcattcatttggatcataagaagaggaggtaaggttcctgtgaacttggcaatttcatttgccattaaacaccgagagattgtaatggttagtgattccagagcctctcttataaacacttagattataggatgtgcatttctccttagaatgaagtctgggtatttccatttgcatctggatttagatgatttagggacaaaattacctacatgtgataagttgaactcttcctaatgactattcttattcttctcttatttcatctttatctcaagacattatctttaattcagcaaatcaagtatttccctagaaagctatgtattaaaactctctatgaaaagttaaaataaaacatagagttgcctaaactgagaagttttgagtcactgtttggaatttcactccctcgctaatattgtatgtgaaatctgctgtgcaacatttgaaaatgaaattatgtttcctg

SEQ ID NO: 105576 - DNA, 3436 bp, Homo sapiens
tctactaaaaatacaaaagattagccaggcgtggcagctagcgcctgtactcccagctacttgggaggctgagacaggagaattgcttgaacccaggaggcagaggttgcagtgagccaagatcatgccattgcattccagcctgggtgacagagtgagactctgtctcaaaaaaaaaaaaaaaagtcaactgtacaaagtgatgtaatttttttttatgtttaatcagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggtaaggaagcatcttttgttcatttcaacttgaattactcaggtttagagttctacaaacctaagcaaaattaactactttttttagccatgcatatttctgaaaaatggaatactgtctctcttactgttttatttataagtgtctcaaacatcctctaaaccgtggcaagagtcatattagccaaactaatatacaaatgtcttcttttctgtcacttagaaaagtacatcacaatagtgagttcagtcatttaagtgctcttcacattaaaaacaaaaatcctttgaggagcaaacttaggattctatttgtaatgagaaaaaattagtgtttaaatttattggaaatcagttgtattaatggaaaattaaaaataattggaaaactaagataatttagcagcttactaaaaatgattgaatgtaaatttttattttagaaaaacaactttatggaactagttcgtattcacttctattattgtttctgaaatgggcctgcttttaaatgcctatttctttggacaaaagaggaaaaatagatctggaactcttatgcctattacatacataatctcttgttgaagaatgtagcaagatgtgcagggtttgctttgcagaaaacccagactgagtcttggataaacacaagaatgaataacaggataaacctaggagaggtgtggtacatttcatttgtaagtgatctggacttgggatccacgtcttgaggaccctgtgggaacaggttacttaactagcttctatttttctgttcctcctttcttctgccggagatgaagcaaccaaataaaccagcaatcctgactctttgcagcaagatgaacacctgaatcctccctgcccctaattatgatgacaaagctcactccattagatcctgtgatttgacccaatgaaactggccttaaacactgagcaaaatgagtagttggtggttgtgtactatgcttcctcatttgctgtgttgagacccttctttaagtatgttgtggtttcagcttttgtttacccatttgagctcttactcatgttactttcatcacttacaattcagtataaagtcagccttattatgtcttaggaaatcaggcctttttctaaatatgaaaggaagagttcgtagtaaatttacttatgaagtcagtatgtgaactgcaggaatcagaattgcagttaattgaaagaagtgctgggatagtcacttgatggatttttatttaaggcctgctttgtgacagcacaggagtccctaaaaggagtccctcttgtgtttggaggctgctagtggagcctgtaaagaagctcagttaagaaggtggagatgaagacaagtacacaaatggacacagaaaaggcctttatagctgtacttttatggaaggaagaataagtagggttgtagaccagtagtttacttttgccggagaagtctctggttgatgttattttttaaaactgctaagaagtaatcattgtaaagctatcttaaaatctggaaaaagtaaatattcttgtttcttcgtatgatagtgggtttctgtaattgtgatggtatgaattactctctaggatatacttaacccaattagatgtaaccatggtaatttaaactcacactctggacacacatttgagtcctacaaaattatttcttccccttcttcttatcttccccactcctatctgaaacatcaaagcaattttatatgtagcttgatgatcctcttgatttgaggtttaaaactttatttgtacttaaaatatatccttcttatccttcatactttggatttttcctgattcttagtgtcaagggagccgttaagtaaaattctcctctcttcttcaaactttagtttgctctggaatcattacccatctagaattgtattactgagaaatgtttttacttgactgtgaactgtgatgttttgttatacattggtgctggggttcttaattcatccatcattctaattaacatttactatggctctgttttcaaaactctgattatggtggttcttaaaaaaaccagacaaacatagatagcatttaaccagaagtctgaaatcaggaatccataatttgaacatgttttagagaaacacattgacatgatgtgattactgtatatccatacgatcccggcattgaaagagttaactacttctgtctgacttccacctatgtgttcgagtagacattggctgaaaagaaaatgtcttattcaaccaacctttattaggcacctattgtcaaacactgtgttagttgctgatctttaattccaagatcgtactaaaaagcattggtctaagattgtggttatgtggttatggccatttcaagtctccccagccaaccgggggccaccataacattggtggacatgtgttccgcttggcttttctacacactggatggagtgaagaacagaaagggattgcttcagattccttaatcttggttttgctgtgatggcagactataggaatcatcagtaaatgaaagaggg

SEQ ID NO: 105577 - DNA, 1443 bp, Homo sapiens
tttctgttttggctcattgcagatctccacctagaattatacttgactcatataagttcttgctacgtatttgatgagtgaatgaaatgcatttcaaatgtattataccactttatactttcatcaacagtagacttgttattatcagccttcttaactttttcccccagtctagtactttcccagtttggtcttcatttgtgttttcctgataattgataaggttgagcaactttttgggtttttggtttttttttttgttgttgttgttttataaaaaggtatttttatttgctgtggtaggtggatggagagctagaagctctgatggaaaatggtgagggtctctctgataaaaaccaggtgctcagcttatcccggctaatggttagaattgaaactttggagcagaaacttacctgtctggaactcatacaggtgaacactttaatgtttgttttttatttctggttttgtggtgggaatgaatgaatgaagatgaatgaagaaggaataattctgataagagttagtcttattttatttatttatttatttgtttgtttgtttgtttgtttgtttgtttagatggggtcttgttctgtcatccaggctggagtgcagtggtgcagtctcggttcactgtaacttctgtgtcctgggtgcaagcaattctgcctcagcgtcctgagtagctgggattacaggcgccagccaccacgcccagctgatttttgtattttcttattagagatggggtttcaccatgttggccaggctggtgtggaaatcctgacctcagatgatccacccgtctcagcctcccagaatgctgggattacaggcgtgagccaccatggccggccagttttattttttaaatggatatgtgagttgtgtatgactttcaaagcttgtaccatattatttaaaatggctaaagagttcagtatcatttaatctattagtacagggatccccaatccccaggccatgggctgattaggaacggggccacacaggaggaggtgagtgagcattactgcctgagctccacctgctgtcagagtagcagcggcattcgattctcataggagcacgaaccctattgtgaactgcacatgcgagagatctaggttgtacactccttatgagaatctaatgcctgatgatttgaggtggaacagtttcatcctgaatccatcccccacccagtttgttgaaaaattatcttccctgaaactggttcctggtgccagaaaggttggggaccatggcattattagacctggtttgctttctgtctatattcaaagaatgtggtggctttttttttttttttgtaataattcatcacacttgccatagccttttaccctccagttactagcatcccaaagccatttgtactacgtgatctccaagcacaaaattttaacggta

SEQ ID NO: 105578 - DNA, 1087 bp, Homo sapiens
tagcagttacttttattagagacgaattagagatatatgcaatctggtagtccattaaatgagagttacacttaaatattttagttcttttaaagaaaaaagtctccatgtgctatttgggaaaaccttcattgcctaaagacccacttgcataattaaggcagatgatgatgatctttatatatgcgcacacacacacacacacacacacacacacacacacactaataagttactaatttcttttgttttcaaacatcatctcagtggactgtgaacggacaactgagggttgggttttttaccaccaaactggttccttcaggctcagagttaacgtttgactatcagttccagagatatgggtaagtattgtttctactaattttgctgcttctgatggggaaataggctgttcagatataaggatataaaactttaatataaattacttaaaagttatatttactcttaactcttatctataagatattgttttggttttgtgtgtttttctactgtatgacacttctgacccttaagggatgttgtacaggaactgtataattttctcctcaacttcatatggtctacttgtataattatatttcttatgtaattctgaaaaactttagacatgccaactctttttgtgtctgaagagaatagtacagtattataaattcctctgtatccgttattcagcattaacagttagcataactcataaccagtctatttcatctgtaccattttgtactcttaaatataattggttacctagttcttttttttttttttttttttttttttgagatggactcttgctctgtcgcccaggctagagtgcagtggcgtgatcttggctcactgcaagctccgcctcccaggttcatgccgttctcctgcctcagcctcctgagcagctggtactacaggcgcccgccaccacgcccagctaattttttgtatttttagtagagacagggtttcaccgtgttagccaggatggtcttgatctcctgaccttgtgatccgcccgcctctgcctcccaaagtgctgggattacaggcttgagccactgcg

SEQ ID NO: 105579 - DNA, 1043 bp, Homo sapiens
ccttgtatgttgttttgcttttgtaagttgcagtttcaaagaacctgttgatgactttaagtgaggacttaactgtaacaatagtaagcccattacttattgataaaaataacatggtattatgaaaaataacttttttttttttgagtcagggtcttgctctgttgcccagcctggggtgcagtggcatgatgatagcttacagcagccttgaactgctgggctcaagcagtcctcccacctcagtctcctgaggtgctggaactacaggcacatgccaccatgcctggcttatttttaaattttttgtagagacagggtcttgctgtgttgcccaggctggtctcacttctgacctgaagcaatcctcctgcctcaacttcccaaagcactgggattacagacataaaccactgtgcctggccttggaaaatgattatttaaattttttttttttttttagtgaaaagagttgcatcgctttacatttttataaatctctttaatgtctggcttaataaaattcagttcaattctcatatatctgcctctgtattcagtgtggaaatgtaaattctagggacctaaccccagagctgtttagtttaaccctagggatgggttcagcaagttttaacaaactctccatgggatttggatacacactcaaggttgagacctatggcattgtgacatagcccacactttaaagtgaagtattataccatgcagtgagattaggatgtaatagaatataagaaatggctaaggataaatgggagagacactgataaagataattttgcctatgggcaaaagttaataattagcagatcttccaaaagcatcagttaggtatttgttgctttgaagtgggaagcagtgtgacagttctctgaagcaagggcaaagtggggataagggagtgtgtgtgtgtgtgcgtgcgtgtgcattgcatgtatcttacatttgtcttaatgcttttcctttgtaaaatgtgtaaattttttttgattgggttaatttaattcacagtgtcatct

SEQ ID NO: 105580 - DNA, 1019 bp, Homo sapiens
tctaggtttacccatgaataatcagatttttattattgagacctaaatgtgtttgtgatggactactatataaatatatatatacatccactataaacttctccaatcctgtttttgagctctgctttttaatatatgtgttcttttctcatttgtttttaattgctttattttttaaagtaaaaggatttaatttttttcagttggcgaagttaactcctttaataagtacattgattatgccagtatgttgtaaacaaatacaaaagatttacattaaaaaaatttctttcattagaattagggtatgtttattttgaggggataagaaaagactttcaggcaggccattttatgtcagaacttcagagtaaaacatagtataacatttgtctacatagaactaatagttgaagtcattggttagaatgagcttttagagaattaagagaaggggaaaagactgataatttaatatcttcagttcagaataaataggtaaataatcaagaaaagaacattcaaagataaagggtaactgaaagatgccaaagaagaagataaataacaattactgataacattctaaagagacgtcaaagagaatgtcattacataaagggaattagatttgatctttaacatttttagagacctttgagagtaaagacagcagaagggctgctatatttaagttgccttcttctttttctttttcctttttttttttttttgagacggagtctcactctcttgcccaggctggagtgcagtggcgcgatctcggctcactgcaacttctgcctcccaggttcaagcaattctcctgtctcagcctcccaagtagctgggactacaggtgcatgccaccacacctggctaatttttgtatttttagtagagatggggtttcaccatattggtcaggctggtctcgaacttgtgacctcaggtgatccacccgcctctacctcccaaagtgctgggattataggcatgagcctctgcgcccggctgcc

SEQ ID NO: 105581 - DNA, 5285 bp, Homo sapiens
ctgtgcactccatgtgatgccaggagaccactggtcttgatgacctctgatttttcatctctgatagaacacaagaacaaaccatattgagtactgagatgttagatattgccctttatacaaatgtctttcaaacatatgtcaggtttttaaaaaattctttttaaaaaatgctacctggaaaatagttataaaactgaaaaaagttatttatgtacgagaaagtaagaatggggaaaataggtaattgttgaagcttggagtggatacttagggatttattataccattttctatacttttgactgtgtttgaaaattttcataataaagatatatatagcttagtgaaattcatactatttgttattaaaaagggcttttcatttctccagtaaacattttaaactgtgcagtccatttgaaagtaactatttattgtagtagtaattgcttattttgttcatttgtaggcaaagattgaaaatgtgcagaaaacaggtttcatcaaaggaccaatgttcaaaggtgttgcttctagtcgatttttgcccaaaggcaccaaaacaaaagttaatttggaagaacagggacgacagaaggtgtcattcagcttcagccttacaaagaaaactttgcagaataggtttctcactgcacttggcaatgaaaagcaaagtgatactccaaaccctccagctgtacctcttcaggtagactcgactcctaaaatgaaaatggaaattggtgataccttatctactgcagaagaatcttccccaccaaagtcaagggtggaattgggcaaaattcattttaagaaacatctgcttcatgtaacatccaggccactgctggctactaccacagcagtagcatctccacctactcatgcagcaccattaccagcagtgatagcagaatcaacaactgtagactcaccgccctcatctccgcctccaccgcctccacctgcccaagccacaacactctcatcaccagcaccagtaacagagccagtggccttgccacatacaccaataacagttctaatggcagcaccagtacccttaccagtagatgtagcagttagatctctgaaagaaccaccaattataattgtaccagaatctttagaagcagatactaagcaggacactatatctaatagtttagaagaacacgtaactcaaatattgaatgagcaagcagatatttcctcaaaaaaagaagattcccatattgggaaggatgaagaaattccagatagttctaagattagtctgagctgtaaaaaaacaggttctaagaagaaatcctcacaatctgaaggcatctttcttggttcagaatctgatgaagattctgtacggacttcttcaagtcaaagatcacatgatttaaaattttcagcaagcattgaaaaggaaagagattttaaaaagagctcagcacctttaaaaagtgaggatctagggaaaccttcacgatctaaaacagacagagatgataaatattttagctattcaaaacttgaaagagatactcggtatgtatcttcccgatgtagatcagaaagagagcgacggcggagcagatctcactctaggtctgagagaggctctagaactaatttatcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaaggtaagtctaattaatacttgtttgacaaattttaactctttttttgttgttagaaaaagcctttaaacaattcagactgtatgagattaaacacatgaaagagttgtgggataaagtaaatttaaaagtctaaaaaagtgtttttacctatttagatttgatagtatagattcctttccccattccccccgccgccccatccccaggaaaggagatgtctatttttttctttcattacttgtttggttttcaaggtacaatttaggctagcccagtatttctgtaattccttttacatgtgaaagtctgaccaaaaaaacagaataaaaccccagcaaaataatctgtacttagagaagaaaaaagtggttactttggattttattttcaaaaatgtgcagaatgaagtatctttgggtactgtattagtccgttttcatgctgct

SEQ ID NO: 105582 - DNA, 1364 bp, Homo sapiens
ttttctaaaaacccaactcttacttgcaatagtaagttaacatggctttttcctttcatgggttcttggccattggttaacattaccttaattagattggtctttttgttttgctactggcagggtcagttaggtaagattgttttgatttactgcaccatcagtccaattacaaagctcatgttataggtttttagtttgaaaaacctcaaaaaaaattttatatcacgattcaataaatgcttatatagcacttgctctgtacaaagtaacatgctaacccctgaataggctaagtgcctgctttcacttccttttaccaggttgtttggtgaagtccggaagctttaaggatcacatccttacacttcttggggaaaaacaatttttcataatatgtgggaaaatggactcagaagtgcatctttggtagacctgagtggggaaggaatcaagaatgttttatggttttacatgttttggagtttttatttttattgctttaatgtagtagaaatccactgctttggatttctaacagtgattatatatttttaaattctcgtgtattttttccttttttttttttttagaggcagggtcccactctgtcacccaggctggagtgcagtggtgtcatcatggctcattgcatccttgaacctctgggcttaagcagtcctcctgcctcagcctcctgggttgggactataggcatgtgtcaccacacccagctaattaaaaaaaaataaattacgttactggttttgaatccctggcctcaagtgagcctcctgccttggcctcccaaagtgctgggattgcaggcatgagccattgtgccaggcctcttcttgtgtattaacctgtatggagtaaagaattgtaacatgttttttgttgttgttgttttgtttttcctttttttcataatactataaagactggaggggatcatggtaggtatcctgagcaatatcacctgtttggcatatgaagaaaatgaaggctagagaagtgaagtgacagcaaactcttgagatagtaagctagttagtgtttataatgctagagagaggagagagaaaggcagtatagggtttaaaaaacctggatttcagagtcagacctgaatctgaacactattttaaccttggacgatgacttcatctctctgaacttgggttttctcatcttttatataggtattataatggttaacaacttactggggctttttgggaggattgaatgagataatgcatgaagagcacttggcgcagaatgtggcacgtgtaagtgcttctagttggggtcatcagggaaaagttaaaaggtaggatttaagttgaggatgaaaagac

SEQ ID NO: 105583 - DNA, 1454 bp, Homo sapiens
ggctcactacaacctccgcctcctgggttcaagcgattctcctgcctcagcctcccgagtagctgggattacaggcgcaccaccacgcccagctaatttattttttattttcattcatttatttatttttttgagatggagtcttgctctgtcgccaggctggagtgcagtggcacaatctgggcttactgcaacctccgcctcctgggttcaagcgattctcctgcttcagcctcccgcgtacctggaattacagccgtgcgccaccacgcccggctaaattttgtatttttagtagagatggggtttcgccatgttggccagtgtggtctggaactcttgacctcagttactccgcccgcctcggcctcctaaagtgctgggattacaggcgtgaaccaccgcgcccggcccactttcagtttttaaccactgtttctcaattggaagacacatcctttcctttccgttaccaattgctggtaaaatccgattcaaaattctagtggaaaaacaacagcaacaacaacacaaaaaacgctaaccctatgaacccccaatgtcaaaatgatctatcgccaaaaactcttcagcgtctagaaagtttagctattggatttacgcgttcctatctctccttccaaaaataacaactcgtagctctttcaagttattctacttagtctcatcttatcatttctgtaggaaagtgattaataccctttttttcatgacattgcctctaaggccccaagaaccacacaggagaggggagctgccgccttggagacttcgggtgggggcagagcgccgcgccgaggtggaggtaggagccccgagggcacagcgggaaggaaggcggaggaggctgccgggagctcggcctccgagcaatcccccgcctcgctgggcttccatgcttgctaaagggtcgagatgaacgggcaagggagagagagggcgaggaaaaataaaaaagagaggggcgagtgggacgaggggcccgggagcagccgcggccgcgttacctcagagcccagaggcctgggggaggggccctcggcgctgccgcggactccggggctcccggcgggcaggtcctgcagggccgcggagcgagaaggctgatgtctcgggtgtctcggggagttctcccgacgtcgcctgctgtttgtcagtcgccagctgtgacacggtagcgggccgggtcacgctgcccccggccgccaggcgggttgcgggaggggtcgcggtgccgcctctccaggtccggtctggcccacatcactggggccgggggtttattgttccggagagccacaggcacggtcggcctggacccgccgggcagtgttccgctctgcccgtcccggcctggggtcaagccaacagctgcaaggcacgccgactggcggcagatcggtggcccgtgtgtgtctctttaaggggccggg

SEQ ID NO: 105584 - DNA, 1049 bp, Homo sapiens
ccacaatacttgcctaaggcaagtccctctcctctttctggctggttcagggggtcagttatcatgtccctgaaagggacattctgtggatcagtttgattactatgtacatttaaaaggtagcagcaagccaggtatggtggctcacgcctataatcccagcactttgcgaggccaaggagggcggatcacctaaggtcacgagtttgagaccagcctggccaacatggtgaaaccctgtctttactaaaaatacaaaaattagccaggcatggtggcgggcgcctgttatcccagctacttgggaggctaaggcagggagaattgcttaaaccggggaggcgggggttgcaatgagctaagatcgtgccactgcattccagcctggttgacagagtgagactccgtctcaaaaaaaagaaaaggtagcattaagcctggtatgttttattttcctgtttgttagaaacctagattcatttttaatcttcaccagcatcacatttgaaaatagtgaattgggcagcttggcatttgtgctgaattccttataaggcgttgtgtaggagggaagattacatgattacaccaccagacccctgggtctttgatattaggagagcttggcatgtaaggagttggggagttgggcttgtctcatttaaatctgaggcaggcctctctctgggcagtcttgaggagagacctcagcctccccaagctatggctgcctgtctgtacagtgattatggtgctctttccttccttgcagggtgtgctaagggctgaaaatagcaagtgggccatgcacagtggctcacacctgtaatgccagcactttgggaggctaaggcgggaggattgctggagcccaggagtttaagaccagcctgggcaacatagtgagacccccgtctatacaaaaaaaaaattagccaggcatagtgccatgtgcctgtagtcccagctactggggagtctgaggtgggagaatcccttgaacccaggaggtcaagactgctgtgaaccatcattgtgctactgcactc

SEQ ID NO: 105585 - DNA, 1070 bp, Homo sapiens
actacctagcattgcatccttgggcacatcctttttgtttccttagatgcaaacagaaagggttaggtgaggtgacctctccctgtccccatacaccaaagagcaggcctgcagcagagggaatactgggagagctccttgtccccatacctcccacaggagtttgacatcatggggggctgctgtgccctgcacggtcactccatggactgagctttgcctctgactgtcctgtacctgtgcctctctccccactgcaggtggaacactacaaccaccacacagccacctggcaccctgcagctggcatgctcaacaagcgctgccggcacggagccgcctccctggggagcaagatgtttgtctgcgggggctacgatggctctggcttcctcagcattgccgagatgtacagctctgtggcagaccagtggtgcctgattgtccccatgcacacgcgcaggagccgggtctccctggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtggggcagggatctggtacagacataggcgcttccttccaggaacagtccctcaggagaggcagtggaccagaagagatggcgaaacgtgagctcgccggaggtacagtttttccaggtgcttaagccctcccccactgtgccacccttgtgaccttcaggcttgggtcatcaagatgcacagcatggaacacaagctcctctggatcctgcagctggtgacatggaactgttttctggtccacatgaacacaggctccatccaggcccagctcctacccaccgcctctctgtgggccagctgttcacagaaggccttccatctgatgctccccatcgcctgcttgctctccagccgagtctggccaatttgccatggggaggctgcagtgtccaagcctgctg

SEQ ID NO: 105586 - DNA, 1823 bp, Homo sapiens
tttccagcggcccgcccgccacgtcatctctaccacagcaccagtcctccacggctcttgacaatacgtgggagggcaagttcataggtgaggtctcatgctcttcctaggagggaggagcgcggcgggcgggacccgcagctgggcttggcccgggagcggggaataagctcgctccgcgcctctcagtttagtggatgaagactactatcccagaagccgtttcgcctcgggctggcgagctcctccccgccctactccctccgcgcgaagaagactgagcatgcgcaacagggacagcgcctgcgcaaaagactacgcgagcgggtggctgggttcactgcaactcccggcaggccgctggcatttttcattccctcccgtgaccagtgacttccggcacgaaggggcggggctgggctcgtggctgagccagcagctgcagcagctacgggagtggccgggtggccggcgggtgccagccgccatggaggccgtgccccgcatgcccatgatctggctggacctgaaggaggccggtgactttcacttccagccagctgtgaagaaggtgagcttgccttccatcttcccccctatccgccgcgtatctccgtcgtctgcaagcgcgtgacgcccccctgcgcgcccatcacctcctcaggcccggtcgcagggtccggtgaggccaggaggggccttcgccggttttcctcagcctgtcccacaccccggcgcccgcaggccattcttctcctccccgatagccccgtgctagcacctgcatcttcatctgaacccggttcccgacttctgccccgagtcatccgctgttcccactgaggcagcacacttcctccttctgacgctcggacccagttctgccccgcccctcctccatgccaggaccgccccgcgcgggagcggtgggcggccctgaccgtgcggattcttttgctgcgcccggccctcggtgcgctgtcaagtccacgcccgcctgggacagacactggggatggctcaggggcgtgtgtttaagacgtgagccccggtggcccagggagatgcccgacccctgcggtgagggtttgttttacaattgctgcgattctgtatggtctcccattcgggagtctctttggaccaaacaatacaatcccacgacatttttaggagggttactgcttttcgtaaccgactggagggcataaacagtgttgtagagctcagagaaatcttactgtgttggaagaacagacgggcaggtttggcgttgactaaggcaaggaacttctgtggagaggttcaggtgtggtgattgaacacaggtgccctccgagacatccgctgtattggtagcactgagggctagagcagaaatgaaaaggaacaaccaggaggccgtcgcaggtggggggccttgtgggcttagcacagcagatgccagagtaagccccaatctagatggtgcaccacttagcgagacgcttgggaagacaaataggaaaaagaaaatgggtttggaagtagtttcccaagaagctgtctcccctctaatcgccatacaccattgccttagttcagacagtgtttgagtccatcatctagcctcttggggccaggaaatgagggtaattgatccaaaattctagaattttgttaacggttatccagacgttgctctcttcttcatctgctgtttctttttcctacctttttttttttttttgagacggagtttcgctcttgttgcccaggctggagtgcaatggcacgatctcggctcaccgcaacgtcagcctcccgggtttaagcgattctcc

SEQ ID NO: 105587 - DNA, 1361 bp, Homo sapiens
ctcccgggttcaagcgattctcctgcctcagcctcccaagtagctaggattacaggcatgtgccaccacgcctggctaattttgtatttttagtagagacggggtttctccatgttagtcaggctggtcttgaacccccgacctcaggtgatctgcctgcctcggcctcccaaagtgctgggattacaggtatgagccgccacacccagccagacccacgtaattttttagtggggaaatgctgctggccttgcatcttcttaacttgtgctttggaggccagagtgctgattcactggaaactgatgatggatgactcttgtcctctttatcagtgagtgatttggcctcaggtatttctgtttgaagttctttattctttctggcccaaacacttgcccttaaccagctgtacttgagctcaagtccagcttacttggactgagctgttacgttcatccctgattcattcattgaacaaatagttattgagtgcctgtcatgtgccagccctgggtacagtggtgacaaaaacctgtgtcttggctgggagcagtggttctaacctgtaatcccagcactttgggaggctgaggcaggtggattgcttgagtccaggagtttgagaccagcctggccaatatgatgaaaccccatctctactaaaaatacaaaaattagctgggcatggtggtgcgtgccttgtaggcccagctacttaggaggctgaggtgggaggatcacttgaacccagaggtggatgttacagtgagccaagatcacaccactgtactctagtcagggcgacagagtgagaccctgtctccaaaaaaacaccacaaaaccctgtcttcatgaaacttacctcctagtaatctacacagtaaccctcatcctcaagtgcaggtgtacatctggctggtagccaccctgcctgtcacttggcttctcttcatctcccatcctcccactctggctgagttgatctctaaatctctactttcccatcaggctgctcatggcctgtccccagcttgcttcagcctgtctctctaacttcactccccagtcctctcctatgagaactttcagcttctcttccttccacatctggtcactgcccttgctcaggcccttactggaattcccttcctcctgtttatcacatgggttgaactgtacgtcattagggtcctctcagccacccagcaagtgtttgggccagaaacaagaaagaacttttccctcctctgaattcagactgtcttgctgtccaccactgggttagcctgcaccacagagtgcacgctggtttttttttctttttttttggagacagagtctcgctctgtcacccaggc

SEQ ID NO: 105588 - DNA, 1396 bp, Homo sapiens
catggactttttgggatcccttggtgtgtgcagtcggccagctgtgatgcattttcctggcatttgtgagttagctggcctgcgtgtccactgccccatatgacaacaggcctgcttctcccatcctgccccccagaatgctgtccgtgtcccacgagactttgagggctgtagtgtcctccgcaagtacctcggccagcttcattacctgcagagtcgggtccccatgggctcgggccaggaggccgctgtccctgtcacctggtgagagccgcaggcagggctggaggatcccacggggagtctgggtggtgggggtgctcctcccctcccttcccccttctccttgctgcataggatggggaatggcctcatatggtccccccaggcctccccacatccccacaatggggtgtttagtccccttacctaatctcagggccctggctagctcctgccctcgagataactggggtgccatgtctgcaggacagagatcttctcaggcaagtctgtggcccatgaggacatcaagtacgagcaggcctgtattctctacaaccttggtgagctgcctgatcccttcccccggccctactccccagtcctgccagcctagctttcagctcttcagatggccacaaaggcagtgggctgataaagggaggactccaggattcccgcccctccactgacctccccacagccctgccagctcctccactgttttctgggctgggcccgtggggagcctctgctggggcgaggctctactgggctggctgccacacagagttgccactgtgtgctctgtctgggagagagggcctttcttctttgactggacagcccctccccactgtggttttgggctgcttcaggcaggaggagagtgtggctggcctcagcttaccctgctagtcagccttagcctggctcaagggagaagcttggggagccccagagttctgtgcaaacatccctgaagcttcaagattggaccccttggacaggagcccttccatcctctgccaaatgcagagcaggagactgagggctgggcaggacttctgagtttccctgttccctccagcttgggtgtccttggactcgttgccctggttctcagagccatgttgtcctgattgtggataacagcagtgccccctctgtctcaccttcacatgggtgtgagcagccccaggcccctaacactgtcccctccctccccaggagcgctgcactccatgctgggggccatggacaagcgggtgtctgaggaggtgaggagaggggcagtagtggaacatgtggacataccagggaggggcagcctcccaagtatggatgaatcctgacccatggagtggacacaggccatcctcccactccctcc

SEQ ID NO: 105589 - DNA, 1097 bp, Homo sapiens
atccagggaaggggatggccagggagggggcagttgggcctggatcctggaccaaggcagtgagggacaagcaaggggccttggctttgttgaatcaggagcaccgtggtgctgcttggagtgggggcagctgggggagagggcagtgaagagggatccctcagtctgcccctggggaaggataaagggaaggggaagcgggaggccttgggtgagcgagggagtgcacctcacgtgtcgccccagggccaggctcaggagtgcctcctggagaagtcgatgttggacaacaggaagagctttctggtggcccgcatcagtgcacaggtagggacggggctgaggggaggccttcactttactgctgactcccccactcattgggccccaccctgttctcaggtggtagattactacaaggaggcatgccgggccttggagaaccccgacactgcctcactgctgggccggatccagaaggactggaagaaacttgtgcagatgaagatctactacttcgcagccgtggctcatgtgagggcctggggccccagggcggggcagggcggggctgagtggccacagctcaggaagcaagtcgtggcgtctcttcttctttcccagctgcacatgggaaagcaggccgaggagcagcagaagttcggggagcgggtgagctacagcgaggaggggactggggaccaatggcagccttcagtgagatgccggtgtgctcccgctccttacacaccagggggtggccttctctgtctcaccctggccatcaccctgctggaggcctggtgtcttaagtgttgtcccatctgtgcagccctcgtccctcggggtctgaggaggtggggcaggctccctacagagcaggtggctggggcagggtgtggcgccaccttgctgctgttggctggggtggtgcccggctgcctcctgagctgcttgtcatctgatggacaggcagggccgggtgggaggcaggaggagaaagggtccaagcagaggaggacagagcaggctttcctgccaccctccacaggttgcatacttccagagcgccctggacaagctcaatgaagccatca

SEQ ID NO: 105590 - DNA, 2005 bp, Homo sapiens
ctgcacgtcggcaacctgcgcctgctcagcgggccgcttgaccaggtccgggctgccctgcccacaccggccctctccccaggtgagccccaccagaccccattgggagactcgagctgggggtttctctggcctcactgaccactgctgcccacagaggacaaggccgtgctgcaaaacctaaagcgcatcctggctaaggtgcaggagatgcgggaccagcgcgtgtccctggagcagcagctgcgtgagcttatccagaaagatgacatcactgcctcgctggtcaccacagaccactcagagatgaaggtgggctgggtgagcagggtagaggggctctggctccgggccccacccttaggagtcgaggccctgagtgtccgtccctggcccccaccccttcctcagaagttgttcgaggagcagctgaaaaagtatgaccagctgaaggtgtacctggagcagaacctggccgcccaggaccgtgtcctctgtgcactgacagaggccaacgtgcagtacgcagccgtgcggcgggtactcagcgacttggaccaaaagtcagtgcccagtcctctgctctttcccggagccacctggagcccagccccatggttcacctggagctggcccttctgcccaccaggtggaactccacgctgcagaccctggtggcctcgtatgaagcctatgaggacctgatgaagaagtcgcaggagggcagggacttctacgcagatctggagagcaaggtggctgctctgctggagcgcacgcagtccacctgccaggcccgcgaggctgcccgccagcagctcctggacaggtttgtgtggccctggggctgtggtgcggctcgggtccagacaggctggggtgatgggagcctggccccactttttccttgcctgtcgcacagggagctgaagaagaagccgccgccacggcccacagccccaaagccgctgctgccccgcagggaggagagtgaggcagtggaagcaggagacccccctgaggagctgcgcagcctcccccctgacatggtggctggcccacgactgcctgacaccttcctgggaagtgccaccccgctccactttcctcccagccccttccccagctccacaggcccaggaccccactatctctcaggccccttgccccctggtacctactcgggccccacccagctgatacagcccagggccccagggccccatgcaatgcccgtagcacctgggcctgccctctacccagcccctgcctacacaccggagctgggccttgtgccccgatcctccccacagcatggcgtggtgagcagtccctatgtgggggtagggccggccccaccagttgcaggtctcccctcggccccacctcctcaattctcaggccccgagttggccatggcggttcggccagccaccaccacagtagatagcatccaggcgcccatccccagccacacagccccacggccaaaccccacccctgctcctcccccgccctgcttccctgtgcccccaccgcagccactgcccacgccttacacctaccctgcaggggctaagcaacccatcccggcacagcaccacttctcttctgggatccccgcaggttttccagccccaaggattgggccccagccccagccccatcctcagccccatccttcacaagcgtttgggcctcagcccccacagcagccccttccactccagcatccacatctcttcccaccccaggccccaggactcctacccccacaatccccctacccctatgcccctcagcctggggtcctggggcagccgccaccccccctacacacccagctctacccaggtcccgctcaagaccctctgccagcccactcaggggctctgcctttccccagccctgggccccctcagcctccccatcccccactggcatatggtcctgccccttctaccagacccatgggcccccaggcagcccctcttaccattcgagg

SEQ ID NO: 105591 - DNA, 1043 bp, Homo sapiens
gctccaggccccttgtggtgctgcacttggccttagagtggcaaagggtattcctcaggccctggtggcccctggaagcctggctctggggagttgcccgttgtgtcctccctgcccagaccctagtggcttctgaggagataagcctgtgggagaagcagctccagggttctcaggtacaggagccatcctctccccagagtggcccaggacaggagcctgttagttgagtgctctgggatggacccacttgtggccaccacattgccctgggtcgggttcatcggccgctgcatggtgtgcagacactggaaagtgctgggcaaaatcattcaccagccgggctgggctggccttggggcagcagtgcctcttccagggagctgaactgagatgggaggaaggctgaggccccctgggactaggacctctgggggactctggagcaggtcaggttgctggccctctgaccgtaggaatggtagcagctttctggctccagctgaggtggagcttaggggtggggacattctgtgtcaaacctcagggtgcttcagtgtatttccaggccaagaaactcagcccctaactgtggaaaggcaagcaggcccctccagcagcaagtgttggcaggtgttagcaggaggacttggagaggcaggagaaaaggacgcagtggggcctgtgtcctctctccatccccaggcctgaggtccctgtgctgcttcctctcagcatgagggctgaagctgctgggggttggggcccattcctcccactgagtaccccctgccccactgcaggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtgga

SEQ ID NO: 105592 - DNA, 1049 bp, Homo sapiens
ggtggctcacacctgtaatcccagtactttgggaggccaaggcgggcagatcacctgaggtcaggagtttgaaaccagcctgaccaacatggtgaaaccccatctctactgaaaataaaaaattagccaggcatggtggcacatacctgtaatcccagctacttgcgaggctgaggcaagagaatcgcttgaacccaggaggctgaggttgcagtgagccgagatcacgccgttgcacgtcagcctgggcaacaagagcaaaactctgtctcaaataaagaaataaataaaaataaaactgattcttagcagcagcagttcagtccctttgttagtcattcctgaccaggtcaagagggagtaagaatgtaggtaactggcattgtggaagaaaatctttaataggtttgttggtgttctattgtaaagagggttgacattatgcacgtggttatttgtgacaaccattacaaccaactaatataatttggtcttacttcaatttgggtgttgctgtgccatcccaacagttactctaaaatgtgccagtactcatcttcttgaatatgtgtgtttttaggctttaaattctctgaaatcagctttcgttcattaactgaaattcctttattttttcaatactatttaattattattatttttttgagacagagttttgcccctgttgcccaggctggagtgcagtggtgcaatctcagctcactgcaacctctgcctccagggttcaagcgattctcctgcctcagcctcctgagtagctggaattacagacgcatgccaccacacccagctaatttttgtttttgagtagagacggggtttcactgtgttggccagctggtcttgaactcctgacctcgtgatccacccgccttggcctcccaaagtgctgggattacaggcatgagccactgcgcctggccacgccctgctaatttttgtatttttagtagagacggggtttcaccatgttgcccaggctggtcttgaactccagacctcaggtgatctgcccacctcagcctccc

SEQ ID NO: 105593 - DNA, 1167 bp, Homo sapiens
gttgaccttcccctccattttggcttggctaactcctacttgccctctgagattcagctcacatgagctcacctcctgacctgctcctccgggttacaggggatgcctcttcgttgtgctcccatacacctcatgcttccctctcccttggtcttatcattctgtattgtcagcatctgtctgtctcctgggcccatatctctcacttgttattcctactgtgggatctggtacactcttaagtattcaggaactgttgactgaatgaatggttgcctggcaggatggtgacacttttagtaacattcaggaattcaggagattgagctaattttgaagactgttggtttagatgaagtgagctgaaaatatgggttggctcattatgggtgaaatatgggtgaagttgtccagtaggtgactggaattagggtctgggagcacaggtaggggctggctgtagcagcagcagggagggtgatctgtgagaggatgtacaggggagtggaggcaacgagaggctggcactccctgactctgggtgtcctttccagtaaggagcaggcttccatcttgtatctgatgcagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcaggtatgcaggggcctcctgggcaacaggcttcttgcccgtgtacctgtgattcttgactacataggggagagtcaggcctgagggactgtctggttgggacatgacttcaggtggaagggaaacactggaaattgtgagacttcaggtaatagacctgctccagattgcgcttagcctcatggaccagcccacgttttccatgggggtcccatttgtgaccaaagtggggcactcttaaagaggagacagctgtctagagtggaatgcaggggcatgccatcaaataacagcaaaattcctccgcagtactgcagcaggcgtcgtctattcaggtcaacactgttccttttttttttagacggagtcttgctctgtcacctaggctagagtgcagtggcgcgatcttggctcactgcaacctccgcctcctgg

SEQ ID NO: 105594 - DNA, 1934 bp, Homo sapiens
ttgtctcaaacttctgggctcaaatgatccacctgcctcagcctcccaagtagctgggactccaggcatgtgccaccatgcctggctagtttttcttttaatgtaacaattaaatggaaatacacatctgaaaacagttggggcattatgggtttgggagcacccaggggaatgaagacaggcctgtacattgggtgatcagatacacttctgccaagtttggaaggtgtcttatgccctcttgcaagctggcatctagtctgatgggttcccctacaaggcatagtaactcactctctttttcatgtttagggtgtcagcctgaccatggcgcgggagcgtgggcagcttgtgttccttgagggactcaagtctgcagtggacgtcgtcttccaggctcaaaaggagccacaccccctgcagtttctcaggtcagtcagcctacagcccagcccggaagcaacacgtggcaggtgggcccaggcagggttcctggttgctgtgtgattccttcttattgtgcaggaggatggaactggcttcaggagtcagacacttcatctggtgttgcagcatcatcaaatgctggctcttatcatggggctgagggtggacatttgtcccaaaagctatagagaggatcatttgctggaaggatggcagaactatatgctttgctgtgttttccagccctggcttagagccctagtatacacctgtgctctgcaacagtggagactgcaatggcaaactatgggctatgggtcagctgcctgtttttgtaaatacatttgttttgtttgttttgtttcatattttttaaactgtttgtcttttttaaaattccttttttttgttgttgttgttgttgagatggagtctcgctctgtcacccaggctggagtgcagtagcgtgatctcggctcactgcaagctctgcctcccaggttcacgccattctcctgcctcagcctctctgagtagctgggactacaggcgcccgccaccatgcccggctaattttttgtatttttagtagagacggggtttcaccatggtctcgatctcctgacctcgtgatccgcccgcctcggcctcccaaagtgctgggattacaagagtgagccaccgcgcccggccaaaattcctttttttaaatttattttttgtaagtaaaattttattggaatacagccacgttcatttgtttgcatgttgtccttggctgtttttgcactacagcaacaaatagagttgagtagttgggacagagaccatatgacctgcaagcctaaaatatttacttttcagacatttaagaaaaaatttttcccctggtttggtattcaacatcacaggcctgagactggttttcctgcttttcctcctttctgaacattggccacaaacatagctctgtgaagactccccgcttggctgctgttcttcgtccactacaaagtggtccacacaggaacttcccccactgccttatctctcagacacacacacccttatgcagtgggtgtgaggccatgtttcctgaccctgtgtgtgacttcacacacatcccttagcatctctgacttggggtttcctcatttgaaggcaggggctggttatacctcatcccaaggtatggggagatgtcttcattgttagtgaagataacccaatgccaggggctcatccctggagcataaggcagtaggccagttgccctgggccctgggctctgttcctccactcattgctgagaaatgatggccaggggtagtcactggagaagacggagataggcaagctggcttgtgtcagaaacaggtcaaatctgttacgtatacagaagccttaggccactgccactcaccatcagggcaactgagttgctgtttaacttcttcttttcatttttttttttgagacagggtctt

SEQ ID NO: 105595 - DNA, 1024 bp, Homo sapiens
aactgattactgtcaagttttcctctctgcctggccatttcttgtaaggatgactttcctaaaaagttgctgctaatgagttactttggttccttttagttcattcaagtcttggagctttttccttgtttcagtgatgcttccttcaaccagatagaaaacgctgatattattatttggttgctgtatgcattgtctccccccccccaactttttccctcttccaggatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagttattcattttcttagtctttgtgtccactcctttaagtttgagttgagtaaccttcattgaagatgtttgtttatttatttatttattttgaggtggaatctcgctctgtcacccaggctggagtgcaaggctcactgtagccttgacctccccagctcaagtgatcctcccacctcagccttctgagtagctgggactacaggtgcaagccaccacacctggctaatctataaattttttttggaaaggcagggtctcactatgttgcccaggc

SEQ ID NO: 105596 - DNA, 1034 bp, Homo sapiens
caggcacactgcgtgaatgaagccaccagaaacccagggcagctgccccaacactgggctgccctgatggtcctcacaacggtgctgtcgagaccatgggggtaacttgggttgtgctaagatttgacagaccttccgggatttcagtttattcctaggatttctccattgatgttcctgtgctttttttttttttttcctatttaactctttcctactctccagactcttctcttgcatgtatttgttaaagcactgactgcccaccctcttccaatagatgtttgcctctggccaggcctgaacccacatgacccctgggttgaagggtgcccatactgctgggattgaatgctgggagcagtgagtccacagtggttcctaggaacttatgccagatgttgatccagctcccttgtgatgaggtacttctattaagtcaaaggcagttggacctgctgtggaattcagctacccttggcttaataggatcaagttctggagcaaacacctgagttaggagagccccatcttggtgtagacattcctttgcctcttgtgtttgttggaggtattcagcttgtctaatagcactgtttgcatatctcttgcttttgggatatgcttcttccatcccttggctcagaagacagttttctaatctagatcccatgagccctcgagggctcaggtttaatctgggagcccaccttcatggcatcagagctctgagaccagggtctgtgaggagtcacttagtccacttttcttcacatcatgagaatgtttctgtacccctgtatgcccccagagaatatgtgatgaaggagttgagggtgggaggttatcttgaaagacataaaagcaagttgtatccttgtaagaggagaggtgattataggtcctcttgtcctgttctagattttagtgtgattcaaagtccatcctacctaagatacttatagctcagctctccagctttcatgaccatggtttcccccaaacagtacagaagtacacgaaataaaaaagtg

SEQ ID NO: 105597 - DNA, 1038 bp, Homo sapiens
gagaaggctattgtttcaaacatattttacttggtccccggaggcagcatgaaactatgaaagaaagagccttaccccttttttcaaggctctccagaccacagttctgggatgggtgtgggtggttgccattcgttcatttatgcctgtctgatatggagcctccctctgttaccagccctgtgcactcaagtgccttgcagtccagtgaggaataactgtagataagatgagatgatgggcattaagtgtaactgctgagaagccttcatagagggaaaggtgataagaactgagtttttctggcatgaggagtttaccaggcaggagaggtggagacgctaggctaggcaaataggctgcagccatagttctgctgagaaacaggttttgaaccaaggcaactccatctggagatatgtatcagaaagattaggagatagaatctccatcttggtcacttatttggtcttctaagacagcaatgggaccgtctcttaaatactggagttgtcctatctccttgggctgataccctgaactgtcatttgggtgagtaacacattaaggggtagacggtcggtttgggggaataaactaagtaactaggttgcggttcctcctgccgactaagcagacctcctggtgcgtggtcttgggttgccctgtgagccctgaagctgtgaatgggccccacagatcactctaaagccaagcatccatgtgtgcccggctggggatctagacccccctggtctacccaggaacctgagttttggtggtctgagacacctgggggacgacgtatcccggagaagggaccaggattaaaggccgctccccaggctgcccggagactagaaggaaggcgaggtagccgcagtcccagggagggtcttaccccttgctcccgggatgcgttatggcgggcctggctgtgcgagatctaggctagtggctttggctgcgaacggattagatctgatccgattagagcctgggcggtcggcttcgcccccttgccaggctctgccaacg

SEQ ID NO: 105598 - DNA, 4375 bp, Homo sapiens
aaatgaaaacttggatagaacttagcaaatgaaggcatatagaacttaccaaaggttacatgagactgtgatgtgccttaagtacactctaatactctgggaggcttcatggacagagacatgtctgactcttctctggcccccagagtctgggacaaagtaggtgcacagaagaaagacactaatttatctaggtatataagatcacaacaactttttaaaattatctcccttaagctagtggtcagtggttgtgtagtacagtaggtacctctttttcttggcaagaaaatgtttgccaagccaccctgtggaccatacataaatgagctcgcctatcaagagagttgaccagttttccatccctattgcagaggtagtatcactggtctttaccaatttaccactgtcatgtcctgctggtcacccatgttttgtacttcaggattccttcccaaagggacctcagtagagctccttgagaatgtggagggtttcaggtggaaccttcccacctgctgcctggttcctgccataagtcagtgctctggaattctgaaccatgtgaattggttctaggatactaggtaggccacactggatgagttgcttctccacttcagcccttcatttcctccactgaaagatgacacaagggattagatcagtgagcttcagaatgctttcaagagtcttaagggtttggtagaaacctcttgggcatagagttgggtgaattgattggtgagcaatgctgcactttatttcatatgttttcaattctgacaagatctaggggtttttaaaacccggattaaatgatctctcgggttcttttgtacactaaagcaggtaaagttgaaataggaaagagtcccagacactcatactaattgttcccttcaggacatgacctagtttgggccaaaaatcgaaggactgcagttcaggagctgtggaggcctccctggactatccagtttgtcagcaactgcctcaagtgaagctctctggccctggtggagacatttatatagcaagaatttattgataatctattttgtgcccagctaggctagggactgtgggggcggggggggggcgggaagaaaaacaagacatagaactgtcccaggaaggagcttattttttaactgaagaaataaaattagaacccttgaaatacaatgcaatcaaaattaacttctgaaagggcctggagcgattcttggaaggagttggcctggaaggagggtgggggaaattcagacacctcccactccccagccactagggttaggctaagcaacttgagcagtgccctagaggttcagaaggaattgacttgcatagaccacagtggaatcaatgcctcacagggtgcattggttgcctgccactaaggaaaggacttctgtgtctttttttcactgaataggctctttcctgagtctcttgtatttccagcaataacgagttactcttggatatgtttgcagatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattacccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctggattctagtcccattctctgcattcatacaccagtttcttcatatatcctatgaagaacctaaacatttggccccacctggtcttggtttgatcagcagttaaaattctgtgactcgggcttccttcccgactgcccaccttcatgatgtgtaaggaacatacattttgagggtacctcacccactgttcatttgcatggtcaaagtgaaaatgagtggaagttctccaaaaatgatggccaacatcctggcacctccaggtgtgagaaatagctttgcttggtgaatgggataatgtttgtcaggatgcagtttagacagtcccaagttggaggcaggccttgagggcagaagattctgtgaaccttgggggacagcttttgggtactcacagatataaaccctgtgcagaaaaaaagaagtgattgttttcaggatgcttataaatcgagtgaagcaaaaga

SEQ ID NO: 105599 - DNA, 1138 bp, Homo sapiens
cccccattaacacccttcttccaaaaaacccagaatacaaaaagctaaacatagagattattacagattattgctctgttgatatttcagatcctttggaaggttggatatttgtatttaggagttggatttaagttgatccctttcttacacccctttctagtatacttacagtactttaaatctccctccacaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtgtaagtaacatggaggggggatgcattatctcagggtccgttctggagggctgtagataagggaaggaggctttgttctctccccgagatttggcaggtccatggatgatgcagtctgtgacagtggcttctcaaagaccagttttcagtctgtgttcttcagcacccctgatggacaggtgcacaggtgacaaaatgcttctaatcagggttgtgcctttatggcatgcactgtcagcattggggccataaagatattcctctcccacacctgtttaagcctgtcttgttatgactctcaacagacatgtagagctactggtggtggttttccctacagcagccttttgtggatacagggttcaaaagtgatgcgtgtaaagaaaagaatagaagtgagtttagagctggaattacaaatatgtttcttatagccatttttgttatattagtagtggctgtgtaggctaagaaagtagtattcaggggctgtgttgagaggaaatacgaagttccagcaagctcaatgaggacaacactagtgctgctaagtgatacttgtctgaggctgtgtttagagaccaggtcatttctcccataggctcttgctcggcttcagccttggcctgagggttgtttctgagaccctggcctgccttttactccagaaggccttcccagtgaggatgatgctgaaatgcagccagtagtaggtcaggtaccccagccacatctgtaatcttaggttcatgtagaagttcacgt

SEQ ID NO: 105600 - DNA, 1089 bp, Homo sapiens
gccttattgagaaacttgacagttgatgggcaagcacttctaggtgctggaaacagccagtgcagaggccctgaggcaggagtatgactgacatgttcagagacaagggagtaggtgggtgggctggagcataaatgagtcaagggagttaggagcataaagtcaaagagatcatggtgaccaaatcacagaaattcttgaaagcagtccagaggcctttttgctttactctgaaatgtgaaataattgcgggaccttgagttgaggactgaagtgatcttccttacagtttatcagggatcactctgtctactgtgttagagagagtaaattataaggcagcaaggtcagaatcagggagacttggtgtggaggctgttaggttaatgcacgtgagatatggtggcttggaccagggtgtcagccgtggaagtgaagagaaatggtgaagttctgggtggaatttcaagatagagataatgggctatcctcacaaatagtaagtttagaaaaatttgttatattttatgacaaactgaggaagaaagaacagcaaaaaagaatttcatagtgtcccagagtaattatatttaactttgttttctgtgtagttgtagtaattcatcttctgtgctgcctgtcatacaattgaatctattgttcaacatttgctattacattaaaggtagttttatttgagattagaaagccatacccagtagcaggttcagttctgaagcagaaagacttgtggcctcaagaagcaagcacactgcaacaaagataaaatgacaagtcacaataatgatgcaggctccctttttggatttctgctaccagaagtacacatggaagtagcaaaatgcaattatattgttttcttttacctcaggtataaaaagggatggatatgtctgttttggatttggggttttttcagtgaatttctcatcactgatacaaagcattgaaaaggaaggtgtgattatttactttagctctgaggcttcaagtctcagctgatatttcagtccttggcattgcagatagatttttgtggccctcactgtcttttactctttcccaccc

SEQ ID NO: 105601 - DNA, 1055 bp, Homo sapiens
agaggctttgtataagagtgtcaggtgctgtcctcagcagcctgcctgcctgcccacccctagaaaagttttagggaggaaaggatagtgaggggacagaccgagtgccaggatggggtggtaggtggcaaagtacctcctgtcctcatctttggcccatcagggtcctggtttgccctctccttcttgatagcccttttgaaggtagtagtttaccacatgaggcatttcctttaatcttttaagggttgatttatctctataaggaccagaaattcagagacagttattttagattgtacgttacaaaggagacatatagggtaccattgtaaattatataatctctactttgaatattgtcagcattttcttaatgttctttaagcaaatgtttacctaaatagcttgaatgatcttgtacccttagcacctggctgcagtggaagaaagaaagatcaagtccctggtagctctcttggttgagacacaaatgaagaaactagagatcaaacttcgacattttgaagagctggaaactatcatggacagagagaaagaagctgtaagtatttggaattttttagtggctttttcacaattaaaccttggtcacttttcacaaaacaagttagataaaataaatggtagcctgttctcttggtctccatggctaacttctgtccttttttctgtgtttgatttgccctttcaaaaggattgttagccagtgatgttaaataaaaggcactctgttaactctctaaagtgaattatctaaatctcagcttcttgtgcgtgttggctgtgaagatacatgatgatattaaattcttcactctacaaaacttagatcttagagttatttcattacctacttgttaccaataaagtagaaactgtataactctattatctgagtcagggattttctttcttttttttttttttttaaagttttaatttttattttagattcagaggtacttgtgcaggtttgttacatggatatattgtatgatgcttaggtttaagcttctattgaagctgtcacc

SEQ ID NO: 105602 - DNA, 4502 bp, Homo sapiens
aatatctgggtcatagtgtttccccagtacctgagtcaaaatacatacttgtcaggcatctgttaaataataatgaattatttttattttgcctttatattttaatacatacagaaaatcgaaaatcctaagcagacagcctagttcatttctacaaattccagacctagaaacagagcgttaccagcaccctaggacctcccctttcccaattgaatctgctttctgtataattcaccccttccccctgttaaccactgttctgagtgctgacaccatagattacttttcacctgtttttgaactttatcatacagtgtgtgttgttttgtgcctgacttcttttttcaactgtatggctatgatattcgttatgtattactgtatatatttgtatttcagacactctcacagctgtataataatagcttttacctttttccacattggagtacttgttcttattcttttacttgtagaaggagctgaagaggaaaaaatggaagccgaccctgatggtcagcagcctgaaaaggtaaagtctcacagcagtaaaaccacagatagcatgcctttcagaccataatggtttgttttttgggtgtttttgagtccctcttaggggactctaaataattctatcagctacttggactttgctggtttaaggtatagttctcacaggatataatataggacatttttcatttgttcactggggaggtgtattcactccctatcctcttcttttatattttaaacatctaatttcattgcattagaagaagaaggaatatgaatttcccacaaaagaagagggaatatgaatacacaagttgggactatgaatacaaaagttatggttcttggctgggcgcggtggctcacgccgtaattccagcactttgggaggctgtggtgggcggattacaaggccaagagatcgagaccgtcctggctaacatggtgaaaccccatctctactaaaaatacaaaaaaattagccaggcgtggtggtgggtgcctgtagtcccagctactcaggaggctgaggcaggagaatggcgtgaacccgggagagacagagcttgcagtgagccgagatcgcgccactgcactccatcctgggcgacagagcgagactctgtctcaacaacaacaacaaaagttgtggttcttgtgaatatcgaattttaaggtttgagtcctattcttgtgccaggagagaatgacagaatagtaagtgatttcctatgagggctaactgcctgcagaagaatcttaagaaaagaatgagaagatgacatatgaggtaggttttaaagagtaggtagaactataaagattgaaatagaggttagaaaatcaaagattcccactagttggagaggagagacactaaagccagtgtgtgaagagcttcaaagtagccagtgtgttagtggctcaatctctcttctgtaggagactgtaaatgcatgatgggtgaggcagaacaggaggttacaaaggtcaggatgtgggcctttgtattccttttttttttttgagacagagtctcactctgtcgcacaggctggaatgcagcaacgcaatcttggctcactgcaacctccgttttctgagttcaagcaattctcctgcctcagcctcccaagtagctgggattacagccacgcgccaccacatccagctaatttttgtatttttagtagagacgtggtttcactatgttggccaggctggtctggaactcctgacctcaggtgatccacccaccttggcttcccaaagtgttgggattacaggtatgagccaccacgcccagcctctgggcctttgtgttcctaatactgttactgcacatagggatcagtcagtcactatttgagtgaatatatataagccaagattgaaggtcttgattatatgtggtattctaaaattgtatatagttaaggggagggtgagggtaataatgaaattgattatagttcctgcattattctaaagacgatatttgtacttcacatttttaatttcatttaattcctaaaagagtctcagctgggtgtggtgtgtcatacttgtagtcccagctacttggaaggttgtaggatcacttgggaggctggaggatcacttgatactaggactttgaaaccaccctaggcaacatagggggaccctgcctctaagcaaacaatatagcctcatgaagtcagtgatagtcagttgcggttttttcagtttctaaagcatgatcactgatgttctctcatggttcttcctgaaattattagcagatggctgtattaaaagactttgtcaacttttccagcagcatttcaacttgcttctttgttgatggtgtgacatttaaatgctcttaattctttaaatcaatcagtaattattaagtacacacacacacacacacacacacacacacacacacacacacacacacatatatatattttgttgtggttgttgttgtttttgagatggagtctcactcttgctgcctaggctagagtgcaatggtgtgatcttgggtcactgcaatctctgcctcccgggtgttcaagggattctcctgcctcagtctcctgagtacctgggattataggttcccatcaccatgcccggctaatttcttttttgtatttttagtagagacaggatttcactgtgttggccagctgatctcaaactgctgacttcaggtgatctgcctgcctcagcctcccagactgctgggattacaggcgtgagctactgcacccggcccggcctgtttttaatcaacaaaaatatcagttaattcccttcacattcctctgggcatggtaacccttgctttatagcagagtatgcagagagggcagcgactctgtgctttggaggaacatcttgtgagcactcaagtgttgaagtggtagaaagtattgcttggaatgtattagttcttttcgagctgttctctacaagtcacttttgaatctagtctatttcttgccaaaaatattggaaccttttgctagtctaagataattactcataaaaaggtctggggtttttttgttcactgcctgtcctcttgttttatatccctttcaggcagaaaataaagtggaaaatgaaacggatgaaggtgataaagcacaagatggagaaaatgaaaaaaatagtgaaaaggaacaggatagtgaagtgagtgaggataccaaatcaggtaatttgaggaaactccttagatattattatgtaaaactgtaaaaggcactggagaaatgaaggtggtttatatagaaatatttcctcatttattttgggtttgtttcttaatgtaacaataagtatgtaattgagtttcattcagataggtgctaatactaatgctggtggctacacttttttctgtgcttttaatatgtagaagaaaaagttattcaacagtattgaagtcacctcacagacttcccatttcattttctgtgtcagttgctgatacaccccatcatgcctgtcaggcttagagaagtagtctgttctcagcttctgatttcctacagacactagagttcctagagcatttcattgattgatgagcaagtacgttggccttagacttagttcccctgtatgttcctttaaatatatatatccaagggacctccacatagaacttagcaaaatgataggaaaacaagtgtgctgtttagaaaatatgtccccaatagaggcaaacctaaatgcatggaatggctcaacagaactcttaaaaagaagaaaaaggcattgacatctctttgtcatatcagtcctagtttgttatagtggtggaggtaaggagaaagatgggttttcgagagtgggcacgctagtaacaaagctttctgatattttcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaaggtttgcccctgacagcccttttccagtgctctcttaaggcatgaatggtcgtattgtttttagttaattgggaacatttagtataaagagctttgctcccaataggagatgactgcttgaatggcatttctaggttaagaaatccacaggcaggaggagggttatagaaatagtagatccagtctaaagggtgacttttttcattccattcattataccatttagccttgtaaagactgcagagattgaaggcaaattttaaagtctctttaaggaactgattatcattttgtttttaatttgcctgcagaacttatcttggactattgttccaataatttctaccagattgaaatatttatgatttttaagacaaaaacctgtttccttgcctaaatacttcaccctgatcttacagactgaaaggagaga

SEQ ID NO: 105603 - DNA, 1063 bp, Homo sapiens
gtgagccaccaagcccggcctgaattatttcaaagtaggttgaagacattcgatgattctttgtagcctaaatagtccaccatgtatttcctaaggataaggacattttcctacatcagttatttaatacaatgaattttagtccctttttgggacaccagccctttccctcaagagagttggaatgtacttgtacattcaagggctagtcaagggtttctcaaaaatcttttattgttaccctcatttatatttcctgatctcaagtattagtttcatttcttttgctactgagtggatttactgtctgcatctcaattctggtttggacaggttttgagggattgagttaattgaagtgttttccttacaagttgatgacttttggtaaaatttaatcacaaatagaataatcaagagtttttaaaaatatatcaatgagtagattgtctaccgagctccttaacagcctgtggaatacaggtttcccatgagtacatcttgagccagttgtcacagctctgtgttaaagaacccaactaatggttcctagtttttaagaaggttaaggactaactagtctctagaccattatgagattaagataatcctgaaataaataataccgaagaagtaactttctaagaacatacagcccagaaatgactgttagaattctcgcctcagatgctattcatagcttataagtagccttgctcttctcaccatgaggatttccataacattatttttaaagtcaggcacttctaaaacaccatgtgtgaaaacaccctaggccaatgcatgtaagaaaaatgtggaaccatatttgatcatcagacttacatcacgtggagtgggcttctctctttctctttgttatatttaaagggctctttcaagtatagtaaaaacatattgaaatatagactcaaacttctgaatagctcataattggacatttaatttctaaggactgactagggtttacgtgactttcctgatgtctcatatttattaggtagtaggatgtatattttcaggaagaaattggcttttgtta

SEQ ID NO: 105604 - DNA, 1417 bp, Homo sapiens
gtgagccgagatcgtgccactgcactccatcccctgggcaatagagcaagactccgtctcaaaaaaaaaaaaaaagtattacaaaatttttaagtaatgcaccttaaaattaagagctttaggaattggagggacagaggttttttattgtgtattttgtgattaatttagaatttggtgtaactagcaaaggaagtcatttaatattcatgggttacacattaattgtaactagaactttgtcacatcatagaactctttcttggttttatggatgtttaatccttgctgtttttgtttttttgacttattaatctagtaagcagttaaaatatggacagcagttttgattattactggcataagttgaaagatctcttatttcaaggctctgtgatgtgtaggagaaaatgtagaaccatagaatttcattattattactattttttgtctcatttagtcctctcatttttctggtatagagggactgagagcctgaagaggttgctacacctaagacaataatactgtgttgggtttcctggtggtggttttacactgaagcaaatttttgtgcaaagttagattgctgttccatttttattcttgaaccagaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttggtgagtcactgctgcttttaagggacagggttaatatatgtttgtattcctgtcagtttactcaaataattgggtttacttgcactaaaaagtgagtacaatgatcagtataaacttgtcttttaagattagtacatgattttttttctcttgtctgtttcttttggtagctagaactaaaaaattatcttgtaactgttaatggtattacagttgtgaattatctggttgctgtttgtagatccaggttttgaatagacagatacaagaatactgaaagatgcatggaactgtaggtgaaaaaaagaatattgaaaggacttatgattatgttaatttatatgttgctgagtgggtttaaattcattgttttgggggtttttttagctgaggaaaaattcctgtaacataaaattcctcattttaactgcttaaaagtatataacctagtagcttctgctatatttacaatgctgtgtgtctatcaccactatctaattccagaacattttcctcatcccaataggaagtcacatacttattaagtggtcactccccattccttttgctcttcagctgtggtacccactaacaatctgctttctgtctctatgggtttgcctattctggacatttaata

SEQ ID NO: 105605 - DNA, 1076 bp, Homo sapiens
actttttttttttttttttgagacaaagtcattccgtcatgcaggctggagttcagtggtgtgatcttggctgcctgcattttgttttctttgtgtgccaagaactgttgctaggtctcaaagtccttaacactcttgttgttaagtactatattttgtgacagaagtccttagtatctgctgtaacagaatctcaatttctctctccatttttgtatgttcttttctgaatttggtctcatggattctacttattgccccgccgtgatctcccttaaagaactgctgtgagaaattacatagctatttgcagagccaaatccacatgacatgtgtgaaatacagaagtgataggcagcagaggttgagagcatagattgaagagctaccacactggcagcattgaattctggctccatcagttaccaaccctgtggctaggacatattctctaacaactcagtgtttgtttcctcacccataaatgggatgatagcagaccctacctgcaatatagagcgattatgaggattcaattgtcagacatacattgcttataacagtgccctgtacacagtaaagtatagatatgtggtagtgaggcagatagcctatgtaaccacgtgttagtttccaattctgcagttaactaccaccatgaccaagtttgaatttatgttacttcacattaatgtcattagattacttgttgttatacattaataaacagttgttttgcatattcgtggttctaaattcactcataactttaaatgtgcaatataatatcaatgttttttatgctcttgtcttaatttgttgttgtatttttaaggaatctgaagatttttgagtttctaagtaacattgtttctgagaggatacatgtccaccttatgaattttgccattgctttttagatacttggcatatcgaaattttatgattgacacgtatcgtctaaacccccaagagtatttaactagcactgcttgtcggaggaacttgactggagatgtgtgtgctgtgatgaggtaaactgtttgactttttctgagacatttaactgtaggaat

SEQ ID NO: 105606 - DNA, 1022 bp, Homo sapiens
gcccagcccataatttggtttcttaatagaaaataatttcattaggttacaaataataaaatcaccacagagagaaaattgtaaaacatttcaatatcaaaaaaagtatttaaaatacgtttaaatgtatgcaataaaaatgtgtatcaagtaaacatttacttcagattaagtaaaactggacaaggaagaagcaagctattatggaacgagatctgggttatgagttatttatttagtctgaagtcctgtgcattgaaacagactttcttcaatcaacttgttaatcttattatgagagacctaccttctctgcattgattccctcatcatcataaatgagcaacaaaaccttatcagctggctaccttgtaccttaaatactgtgaaaggttgtttttacttgaaatttgtttttcaaatatctgatcgaatcggggagcttcattttatttaacctaacaactgaagtgtaagagatgttatatatatctctctctgtagttctttctttctttgaactttgtcttcttttctataggaagatgaagatcctgccaaaggtgatcagagtcgatcagttgaccttggggaagataatgtgacagagcagaccaatcacattattattcctagttatgcatcatggtttgattataactggtgagtggaccacttccatctgtgagcatggtactgagcagtacaagaactttccttgaaatcaggttgtgcctttctgcccatgttccttatcagaaattactatcactttggatgaagggagatggagagtgatttttatctttggaatgtgtttgtgttttttgtttgtttgtttgttttgttgttgttgagacagagtcttgctttgtcaccctggctagaatgcagtggtatgatctcgactcactgcaacctctgcctcccggtttcaagtgattctcttgcttcagcctcctgagtagctgggattacaggttcccgccgccgtgccaggctaatttttgtatttttagtag

SEQ ID NO: 105607 - DNA, 1135 bp, Homo sapiens
gaacttcatcatgccttacctagtgccagcggtcacagtagtgataaaaagcttaaatattacaggcatataataatgtaacttgttgttctttaatactacctctttcctattctgtactggcagttttacttttcattgtggaaatcaactgtctagtttacaaattttacctgggctttctttcatgctaagccctctatcctcagaaggcattgtcttactaagattagtaagggattggttatcacccgtttttttactcatcattctttactcacttcttctgaaacccaaaatgttgttattttagcaaaactcaggagacaagaatcgtaatcaagtcctgtatctgttattaagatcatgactatgatattagctcaagtagtaattaattgtaaattccccactgtttgaaatttttaatgatctttgctttgaatttctaattacctctgtgcttctgtgtagaattctaatttagtgaattattcagagtgattttgctttaataatgcactatttcattccttttctctgtccagtatcagttcttagaccattaattttccaaataacccaaagaacatttacctgtttttaaaatgaattgtgtgttttggttttgcagatgagcaggatgaagaaacagtcacagcaggaggaaaggtaacaattcagttaagcctggtgtgagagagcttctctaagggtcctgtgtaccgaacagtagaagcactgaattggacataacccaatttttggactatgaagcccttctggtttttgaatttttttttgtttttagtttttcccctaaggaaaacaaatacaatataagaaccatttctggaaggtgtttttgttagttttttcttttgagacaggctgttggttctcactgtaaccttgacctcctgggctcaggtgatccccctcccacctcagcctcccgagtagctgagactacttgtgtgcaccactacacccaactgatttttttattttttgtagagatggagttttttatgttgcccaggctggttgcgaactcctgggctcaagcaatctgtctgcctcagcctcccaaagtgatggcattacaggtgtcagccactgcgctcggcaaaat

SEQ ID NO: 105608 - DNA, 1060 bp, Homo sapiens
gtcccaattacttgggagcctgagatcaaaggatcgcttgagcctgggaggtcaaggctgcagtgagccatgatcgcaccactgcactcaagtctgggcgacagactgagtccctgtctgaaaacaaactaaaaaggtattagttcttccttaattttttttaaaagaatgaatggattagaagtgagaatcaaaacaaatgcatcataaactttaataaaaaaaacttttgtggaagggattgaaagattgttttcatgttttgttgagtattttgtattgtttgcttttatgatgaaactatatggtgcttgggtaatgagaatatagtctgttaaatatttcatagctgggcttatgatttttacctgaaagtgtattgaatggtgttgcagttgtagtgagatgcatgtcgtttaatcatgtcctattctgttttctttctaaaaagaagtacaacttttcccacataaacataactcttttttttctttttctagtgaacctaaagaaagatagtgaaaatacacctgttaaaggaggaactgtagcggatctaggtaagcacctaaaatctatacactggtctgtgctttctgtcttgaatatgtcatctcctttgatagtctattcttccaaggtcttgttctgttggtcaggctggagtgcagtggtgtaatatagctcaccacagctttaaacttctgggctccagcgattttcctaccttagtcttccaagtagttcggattataggcacacaccaccatgcccagcttgatacactccttcttttcttttttttttaagacggaatctcactctgtcacccagggctcactgcaacctctgcctcctgggtttaagtgattctcctgtctcagcctcctgagtagctaggattacaggcttgcgccaccacgcccagctaatttttgtatttttagtagagacggggtttcaccatgttcaggcctgtctcgaactcctgacctcatgatccgcctgtctcggcctcccaaagtgctgggattacaggcgtgagccaccgtgactggcc

SEQ ID NO: 105609 - DNA, 1125 bp, Homo sapiens
tcttttattggctggttagatgtaatttgggggaagttatctaattttttctttttaatgtttgccttttttatttttaaaaattcttttagatggagtctctctctgtcacccaggcaggagtgcactggcgccatctcagctcactccaacctccaccttccgggttcaagcgattctcctacctcagtctgctgagcagatgggattacaggcgcctgccaccatgcccggcttatttttgtattttcagtagagacggggattcgctatgttggtcaggctggtctcaaactcctgaccttagtgatccacctgcctcggcctcccaaagtgctctgattacaggcatgaaccaccgcgaccgacctactgtttgtcttttaaagtgatcttgagcatatgttctacaaataatgaaggtgtacaacctcagaaactgtttgctatcagtagctataatcagtcttgtttatatttcatatacttgtatgttttagccaagctagcctttatgggaagcgcagaagtcagaaagaggaagatgagcaagaagatctaaccaaggatatggaagacccaacacctgtacccaatatagaagaagtagtacttcccaaaaatggtttgtattcttctgcatgagagtgttagatttaatttagtcattctcagcaataccatgggatgattcattgcttgctgtgggtccacagttctcgactttcaagtatgaatagattgtcccttttatggatatctttttttaattttctttaatcatttgagtagttttactctttgtttatagagaaaacttacagcgaccaaaaacatctttaatttagtaatgttttaaaattaatggtttttaaattgcaacagaatcacattcatatgaaaaagtggaatacgtacctatatatagtttaacttattgaaatctctagggaatgctttatgtggatgcaaatttgaagttctctggtaatgaatttcttctaagtgtgatgaaccttagttaccagttatgtaaattctggcctaacttctattcaatgtaattaaattcaaagtgggctgggcatggtggcttatacctgtaaccccagcacttggggagac

SEQ ID NO: 105610 - DNA, 1178 bp, Homo sapiens
ttcccgcctcggcttcccaaagtgctgagattacaggcatgagccatggcacccagcctagacattgactttaaatcatgttgccatcttgcttaacatttcttatgacatgaagttatcttctgtttattttagagattaagaataattcctataatgctacattttcacaggatcgtttggcctgtctttgtattttgtcagtttagtagagtgtatttcacatttttccagtagttattgaaatacaattctcacctcaaaacagaatgtgaacagtagcagtttttagttgtgcagggtttcagcatgtctgttatagcatagtttgaataactgatagccgatatttccattgatgatatatatcacctgaaaggtcagggaaagtttcttgattactggtgttcctggatgattaatgatattctttttatttgctctgaactaaggatatgctgttgtctttgtgtgtggagattcaccttttgccaaggatttgtagaaactgaggagcaaagatagctgatacttatttccatttacttcttcctagccagtcagaagtccagaaagaagagatagaaaagcatcagctaatgctcgaaagaggaaacattcgccttcgcctccccctccgacaccaacagaatcacggaagaagagtgggaagaaagggtaagaactattacatgattcaaagggcattaaaacaggccggacgtggtggcttacacttataatcccagcacttttggaggctgaggtgggcagatcaactgaggtcagtagttcaaatccagcctggccaacatggtgaaacctcgtctctactaaaaatataaaaattagctgggcacggtggtgcacgcctgtcatcccagctacttgggaggctgaggctggagaatcacttggaatttttttttttttttgtatctaagtatgtattgagaagcatgactggtaagaagtttaagacattatattcaccatgtttagtgtctccttttctgattttaccacttgtcccatttgtgatcaaataagctcatagaagagatgaatatgtggctgcttgatgttctgcaaagcatggcagtacaacgcctggttcagggctacacttttgtacttagtgagctttggttgaatgaggattacgatttctactgaat

SEQ ID NO: 105611 - DNA, 1021 bp, Homo sapiens
tggggcaggtgatcggcctctgcgaatgtgctctgtcatcaacacttagagtgttgttgataaacccaaagacatccttcgtgcctaaagcaatgactgattttggctctgtgctgttgaatgtttttatcagtgattttcatgaacataaggatgaaatgattaagcaaaacaaatttgagggactttgctatcaaaatctgggtctagtataaattattgatgctttcttgttctctttaatatggaataaaaatagagatgattaaattacaactcacatatcattagtagtatcacattattaatgttttatgcatttgaggctttgaaaataaatcagcttgtttccttctcaatactgtaaaaccttgagtgattttgttatttatgtagatattgatgctttgatatggttttaggttcatgtgaaatggattttggacactgatattttcaatgaatggatgaatgaggaggattatgaggtggatgaaaataggaagcctgtgagttttcgtcagcggatttcaaccaagaatgaagaggtattttctttggcacagtttctcatcattaagtctgtcttcttggcctaaatgttattaaatcttcatcagtaagctgtcatatacaaaccacttaggaactttcacatctgcctgatggctgatgtgccatcaggtgaaaattccaaagtggctgtaatagccatctcagaaacaataacctcccaaaaagtggtatgaaaatcttaaaaggttattaagatttaaagtggcccatgcagaagggtagtggtatagctgattttgcccactagatctgaagtgtaatatcacagcagaatttaatgtagctgttggttttcctatgcaaaactcattttgtttagtatgtatatatattttttgagacagagtcttgctctgtagcccaggctggagtacagtggcactatctcggctcactgcaacctctgcctcttgggttgaagcgattctcctgcctcaagcctccc

SEQ ID NO: 105612 - DNA, 1043 bp, Homo sapiens
tagtaatgatgttgatgctgaaattgaagatccaccaattccagaaaaaccatggaaggtaaatgatttaacaaaaaaaatcttacaataatctttttaaaattttttttgagatggcgtctcactctgtcgcccaggctagagtggagtggtgcgatcttggcttactgcaacctccgcctccgggttcaagtgattctcgtgcgttagcctcccaagtagctgggactataggcacacgccaccacgttaggctaatttttgtatttttagtagagacggagttttactggattggtcaggctggcctcagcctcccgacctcgggtgatcggcctgcctcagcctcccaaagtgctgggattacaggtgtaagccatcgtgcctggccaaaaaaattcttacaataatctaatagctcttctcagctgttttctacagcagtctctctaaggagatacagaatgttggtttccctttcctgtcatccatttacaagatacgtacggccatgaagactttattatctaggtcttagatgaaatgtctgcagtgcttgatgtttgaggagaatccaaaggcaggtcagattgtggtttgtgagagaggagtgtgaggagtagagttgaacatcactgatgatgtcatttgggtagcttggaagcaatgcctgtgtgacttttagaatgatacagacttactttattaatcatttctaccataatgtaataagagtccatacattgacttttaatcaacttttgatgtggaaataaagtttatggggcatggtggctcacacctgtaataacaacactttgggaggctaaggcaggaggattgcttgaccagcctgagctaccaaaaaaaaaaaattatctgagcataatgtcaagtgccctatagtcctagctacatacttggaaggctgaggcaggaggattgcttgagctgaggaggttgaggctgcagtgagccgtgattgcaaccacttcactccagcctttataacaagttaagaccctgtctcaaaacaaaaaaat

SEQ ID NO: 105613 - DNA, 1026 bp, Homo sapiens
aagagtataaggttgggttttttttttttttttttttttttgagatggagtctcactctcacccaggctggagtgcagtggtgcgatctaagctcactgcaaactccacctcccaggttcatgcgattctcctgcctcagcctcccaagtagctgagattacaggtgcacactacaacgccccgctaatttttgtattttttaatagaaacgggatttcaccatgttggccaggctggtcttgaactccttatacttcaggtggtccactgccttggcctcccaaagtgctggaattacaggcgtgagtcactgtgcctggccaggttccatattcttttgaactgacctctgaatggtgactaaaaggaagctaatacttgtcatcatactagatgtcatttggtttcatagtttactggtcagtatagtgatattcacagtgttttattttggttaaaattttgtgcctattttatgattttgttggagtaggtggtctgatttatgtcagtgagttcttgttgataaagaggctccttgagcaaagagatgtgaagaaataagagagtaagctatatggatatctggacagtgagggagcaatctgtgtagagtgtatgcaggcttagtagggaatgttggaataatgttatcaaagcctgtgtggctcaaatataacatgaataaggacagaagagcaggaaatggggtcagagtctctgtcagataattagatcttgaagccatggcaagccatcgttaggttttttactttcactctgatagggtgagagcagttggaagtgttggatcagtagagtgatgtggactgacttagttttcaaaaagatcacaatggctatgtgaaaaattaactctttgagagaccaagagaccaatggcagaagcaggaaaaccagtgagcagagtggaggggtaagaattagatagattctagacatacttttgaagttagagctggtcacatttgcagttggtttgattacaggatgtgcttgagaat

SEQ ID NO: 105614 - DNA, 1007 bp, Homo sapiens
tcggctcactgcaagctccaacctcccgggttcacgccattctcctgcctcagcctcccgagtagctgggactacaggcgcccaccaccacgcctggctaatttttttgtatttttagtagagacagggtttcaccgtgttagccaggatggtcttgatctcctgacctcatgatccgcccatctcggcctcccaaagtgctgggattacaggcgtgagccacttgccattgctatttttaagattaactgtaatcccttccgtagctaaaaacactacattagaccattaaagtaaatttgggtaaaattggggaggaagattaatctggcaatctggtatggtatcttaatgaaaaagttgctgaatttctttaggtcatgcttctcaatattttttgtggcagaaaaggttatctgggggtggtttgtatattgcataaataatatgatattatttcaaaactaagagaatttgaaagtctgttcttttcatcctcagaacaattgtttgaccagacccaacatctacctcattccagacattgatctgaagttggctaacaaattgaaagatatcatcaaacgacatcaggtaatagacacaatcacttcagataataatagacacgatcacttcattttgtagttgtaagcctctaataaatgacaaccatagtaatgttttggattttttgatatatttgcatcaaaagaaatttttttcttgagttttttttttttttttctttttagagatgaggtgtcactttgttgcccaggctggaatgcaatggcactatcctagcatccttgctcactgtagctttggacttctgggctcaagagatcttccagtttttttgttgttgtggttgagagagtctcgcgctgtcgcccaggctagagtgtaggggtgcaatcccggttcattgcatcctctgcctccgaggttcaagtgattctcgtgcctcagcctccgaaattgctgggactacaggtgtgtgc

SEQ ID NO: 105615 - DNA, 1326 bp, Homo sapiens
gtctctgctcttgactgctactgtggccagttaaaaattttatttggagaaaacttgtctgtttaaatcacaagtcttacagctgtattagaattaaatacccaagatgctttcctttatctaagagaacacagatactgctgaatttgaacaaatgattttttttttttttgagacggagtcttgctctgtcaccaggctagagtgcagtggcgtgatcccggctcactgcaacctccgcctctcgggttcaagtgattctcctgcctcagcctcctgagtagctgggattacaggtgtgcaccaccatgcccagttgatttttgtatttttagtagagatggggtttcaccacgttggccaggctggtcttgaactcttgatctcttgatccacccgcctcagcctcccaaagtgctgggattacaggcgtcagccactgcgcccagcctggatatgtggactacttttctataagatgtaagatgtcttagatttaaggaaaattagatagatatgtcatggaattgatacttcattttcactgaggtggatcttaatatctcttttataagggtgttgatactatgtattcttatgttactgagagaatgtctcacacattttgtagagttattttaattttcaaatctttctaactcatttgcatcgaattctaaaaccaagttttcatttgtgtttaagctgggagacaaattaactagggtttttctttttttttaggcggaggtttgacctacagaacccatctcgaatggatcgtaatgtggaaatgtttatgaacattgaaaaaacattggtgcaggtaacttggaaacttaggttatttaaaaagtttacctttaatatattttcagttttaagattggctggccaggcgcggtggctcatgcctgtaatcccagcactttgggaggccgaggcaaggcggatcacgaggtcaggagatcgagaccatcctggctaacacggtgaaaccccgtctctacttaaaaaaaaaaaaaaaaaaaattagccgcacgtggttccgggtacctgtagtcccagctactctggtggctgaggcaagagaatggtgtgaacctgggaggcggagcttgcagtgagccgagattgcgcccctgcactccagcctgggcaacagagcgagactccgtctcaaacaacaaaaacaaaaaaaagattggctctcaaaaaaacaaaaaaaaccacagattggctttattggattgccaaaagaacaaaggaagaaaatgttctgaaaggtattgttttattatttttatgggtgtttggggattagag

SEQ ID NO: 105616 - DNA, 1022 bp, Homo sapiens
tgtcatccagggctggagtgcagtagggcgatcagggctcaccgcaggctcaacctctcaggctgaagtgatcctcccaccccagcctcctggataggattgcaggtgtgtgccacaatgcacagctaatttttaaatttttttctagagactggatctccctgtgttgcccagactggtcttgaactcctgggcttaagtgatcctcctgtttcacgctcccagagtgttgggattacaggcatgagccaccatgcccagcctaatctacttttagaaaaatgtattgattcctcagtttattcaagaagatgtttaaggaggttgtttaattagtatttgtttatatatttgaatttataaaacttagaattaagacatgagtaattttgtcagaagctttatttttctcatgtgtaatttgtatcatttttaggcaaagtgtttcatggatttcaaagctggaggcgccttatgtcacattcttggggctgcttacaagtataaaaatgaacagggatggtaagtttttgtatttgtttgcatgttttgatcttaagttatttacttttaagtcctgtttccttgtgttagaaaatcctgtaagcacatgatgattaatgtgttttaccaagagccctaatttaccttgtttctacatccaagaaaaatatcaagcaaccacgtatttatttatttttgagacagggtcttaaaaataggaccaaccaaggctgttggcaaggctagaagtgcagtggtggaatctcaggtcactgcatcccgcgcatcagattcaagcaattctcatgccccagcctcctgagtagctgggactgtaggcgtgcaccaccatgcctggctaatttttctatttttagtagaaatagggttttgtcatgttggtcaggctgctctcaaactcctggcctcaagcactccacccatctcagcctcccaaagtgctgggattacaggcgtgagccaccgcacccggccacaaccaagtatttattagggaa

SEQ ID NO: 105617 - DNA, 1179 bp, Homo sapiens
ggccgctgggggtggagggcctgagggaaagcggggcccggcgcagtcccagtccgggtgcagggccctcggccagcactcgataccctagacaggctttcccttgggcatttctcgcaccaggccttttccctccagcggaggcgggctatgacacataacccacctgcggttgttgaccgcataatgattcgacgtcggtagcgagggaagagcaaggctcaaaaaccggcgctcactagggcagaatgcagcctacggaggatggcggaagaggcggctgaggccgcaggacgtgctattccaaggcacggccgcacgagtgctacgcatgcgcgtgcgctggctcgcgtcagatacagtgccagttcccagatggggcggggccgggcgtccgcgccggaagagggttggctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaaggtgggttcgcgcgcccgtgggggccgggagaccacgcgaccggggccggaggcggcagctggcctcgcgggcctcgggccgcccctcccccccgcacgccacgagggacaacaaaggcaggcgccgggcccgccacgcccccgccgcccgctctgggcgcccgcgatcccggggcctgactggggttcggggctctctcctctgagcctacgcacccatggtgaaagcccctgctcagtctcgtgtgccagagcaggtcgagctcagccactaagcgagtgtgactctctctcttttgtcagctgccttaggtgtgtgaacaatgatccctaaagaccgagcaagcgtggtaaaagcagcttcaagttttgtttagagcgtattcaaagtctcgagggggtttgctacctgttgttgaattgctaaacgactgggatgattgtattcgttaa

SEQ ID NO: 105618 - DNA, 1024 bp, Homo sapiens
ggcgtggctacgagctgtggcggggaaggcgggtggaatcccggagcccgagctggaaaccgttccccgctcagccatgacccgggctgtttattcgcatcaggaggcgcgggtggctcgcagagggcgagaagacccttcccgctttcacactgcaggcagctaagtcgccgagaaaggcagcaacttgacgcccgaccccgccacccaaacccgctcgctctgcgaccccagagcagccggcgccaacccgtccccttcgcgactccgccggaagtcccgcctgcaccgccgccgcgccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggtgaattgggctttttattctcccctttcgtgccctcttgaggagcctgccgcggccgggggtggtcgtcgtgaggagggggcccggtccgaccgccagcctggcggagagtggggcggagacgccggcgggcccgaggagcaggccgggcatcctaggcctgcccgggaagccggcccggccgatccgtgggcagccaggcctcggcctgccgttgccatggagcccgggcgggggcgggggccagaccggtccgccggggcgggcctcgcagccaggggctccgcggaggccgtgggagaggccgcttcattggcgcaacgacgccttcgcctcgggatgcgccgtttccccaggcagggcctggaggaagcctcctgagtgccccgagacctttgtctacttctcctccttcccggtgctgcccggaccgttcgtcca

SEQ ID NO: 105619 - DNA, 1091 bp, Homo sapiens
ttcaccatcttggccagaatgggctcgaactcctgacctcaggcaatctgcctgcctcagcctcccaaagtgatgggattacaggcgtgagccaccaagcctggcccactacaaagatttttaaacattactgcattatggccggtcgtggtggctgatgcctgtaatcccagcactttgggaggctgaggcgggcggatcacaaggtcaggagttcgagtccagcctggccaacatggtgaaacactgtctctaccaaaaatacaaaaattagccaggcgtggtggcgggtgcctgtaatcccagctactagggagactgagacaggagaatcatttgaatccgggaggtggaggttgtagtgagcagagatcatgccattgcactccagcctgggcaacaagagcaacactctgtctcaaaacaaaacaccattactgactgcattacaaggaagaccgctttcttttggatctctatgaaatgttctagagctctgtaaattctgtctctaaaagatcctgtcttgattctcatagtatcgtttttttagattagtacaggaaaaagaatggtacatgagcctaaattgacatattgggctagaggtttagggacttttaaaaagcaaaactggccgggcacggtggctcatgcctgtaatcccagcactttgggaggccgaggcaggcagatcatgaggccaagagatcgagaccatcctggccaacatgatgaaagcccatctctactaaaaatccaaaaaaatttagccgtgcatggtggcgtgtgcctgtagtcccagctacttggaaggctgagacaggagaatagcttgaacccgggaggtggaggttgcagtaagctgatattacgccattgccctccaacctggtgacagagcgagactctgtctcaaaaaaaaaaaaaaaaaaaaaaaagcaaaatcaagagtctatttgcaagcaaattaacttacaaattttttttttagaggcagggtctcactgtgttgcctaggctggtcttgaactcctggcctcaagcgatccttcacctgggcgtcccaaagtgctgggactacaggcatg

SEQ ID NO: 105620 - DNA, 1824 bp, Homo sapiens
actacaggcccgcacaaccatgcctggctcatttttttgtatttttttagtagagacggggtttcaccgtgttagcaaggatggtctcgatctcctgacctcgtgatccgcccacctcggcctcccaaagtgctgggattacaggcgtgagccaccgcgcctggccggaatgtaacttcttaaagtaaatgttatcattgttgatattgtattgaagttttctctgtgatataccatatcctatgggctgaaatttccagcatcccttggggagtggaggccatcagggcagacctgctatggacctgaaagattccgccccaggtcagccctccactccccacctccccacaatttgagaatgagagggaacaggagtcaggagccggagtgttggccccagtagactccaatcaatgttggacatgattctgattggctaaacactgtgtagatgtttttaaacaaagtccatttaaggttactgcactaatcaaggagtactggattataaaaacatctataaatctgagtttgagtattttttaaaacaaaattgttaaaccagatgtgttgcttttttttcttgtcatctctaagtatagtcctcagttaaatatactaataagcaaaatgcaccaaaacttttggctaatagttgtgctttaacttaatatttgttatttcatagagactgctatgaaaagctttttattctgaatcactgtacagttattctttgatcctgtcagtcaaatctcatttttagggtcttgactaggttttatgaaagcccagtaaggcagtttgcccataaggcagtcatcagtcctgtttcctgatgccacatgacagaaggggtccatgtagaatttcgtttcttcctggaagtcccaaggaaacctgcaagtattatgataactaggaaggaaacctgcaagtattatgatgaactgggaaggaaacctgtaagtattatgatgaactagatagaactacatgtctctcatgatgaaatgcatctccctctgtttaacaggatatggggagttttaggacagggaagaaagtgctcaattagaaagaagcaaagacaattactctagagtggagctggccttccagtcctcaagactggggagcagcagttggggctcattagtgaagagtttcatttttttcattttctgaacagtgctctccatgttactgaagtcttctttgtgggttgctggaccaggaatattaaccattgcctcttggccctccttgttctcaggattccagctttccctcctggccagaaatgttcagcctggactcattcagaaaaggtaagactgcaactgtgcttgtgacctcatgcccttccttattgggatgggcagctctgagggctgtgaaagtctctccccagtatgtagttcttgcacatttctttgggtggttttccaaaggcctttcctatagccttccttttgcatggtgcttagaatctgtgccaacccttgccatggcctttgccatgcttcctcccagtgcccccttctgcgtactccctgcttattaaaatccttttttttttttctgagatggagcctcacttctgtcgcccaggctggagtgcagtggcacgatctcggctcagtgcaatctcctcctcctgggttgaagcaattctcctgcctcagcctccgtagtagctgggattacaggaaccagctgccaagctcggctaattcttttttttttttttagttgagacggggtttcaccatgttggccaggctggtctcaaactgttgacctcaagtgatccaccca

SEQ ID NO: 105621 - DNA, 2153 bp, Homo sapiens
agacacgtggtgcttttgagttgatgtagtaccaaggctttcagctttctcctgttgtcctgtcacatcctcacaacttaagactaagagaagtatataggatgggtgttaacctcatagggggtagctaagggaacaggaagagtttgagggctctctctaaggctgtcacatatcacatcatatgagacgcttgccttcttcctgtgtggcgttgttagtgctgttcctcagaacctgtggctgctcccagcactgtccagcagccctgttgcccagagctcctcacggatgctctgagtgagtcagttcaggggtctgtgactgtgaggggtgagaacatgtcgccctgatgccctctctctttccccagatcgggcccagcacaggcagcgtcagtgcaaacttcccccaccccgccttccacccatgtgtgtcaaccctaccccaggagggaccatctctcgaggtaagggaggagccttgcctccagcaacagcttggtccagggtctgtggggaggtgggtggcaatgggagccctggtgccagggccacagccctccagaaagtgagtgaggaagggtgggattagcagagctattggagccctgagggagaaattacttggaaaagtctggattttttcatgatcccttgactcatggcctggaccctgcagtcttcttgggcctccttgtgtggcctggactaaagcctaggctcagtttgggtggttctctcagcacccgcatggagaatccgcagggcttggggcctcgaggctcctagaagtccctgatcaggtggctcagagagcagggtgcttgtagcagggctggaacagatagccctgactcaaccctagtgctttccatcttggaggctttgggaatacacacagatcactttcctgtctcccatgtggcacctcaaagcactttactgacattaaaatgtgcctctcagtccacttggcaaggtaggctgtccttttgattggggagaatgttagagcaccaggtaagtggcagcttacctcaggccctatcagtacccagggatggcgccagggataggacccagggaagcatcgctgcacatgagcgcctcctcttctccctcagacttattaatataccttttccaggcctgctaaggccagtgctcctggaagcctttttgtcctaatagctgctcttttctgccccataggctgcctgttcacacccctctgcctagcagaaggagccctgttttaggtcatagggtcattgtctcatctagagacagcatgtctactctagggtctgtctgtaaagtgctttgaaggtcaagagctcaggaggagtgtggggaacacagagcacctcagtttctgcagcccatgctgctgctgcgtcccaggcagttttcacactcctgctgctgcggccctgactactgacagcaggatagaaatgagtacttctagccccctgaccatttgacttaggttttaaagaaatgccacccccctaccgttaccaaaacaagagttgattgcccttttttttttctttcttaaaatgccctgtaactcgaaaaggctgaacgttaacatttccaacatggcaggtgagtggctctgagagtgtcagatgtgctttggctaagcttgaagacggttagtcggggttaaccaggcagttggctaggcagtgccttcttgagcacacgcggaggagaacactgatcgcaggatgggcagttgctgcctctggggcagccccacaagtgctgtgctctcttccccagaggagtgcagacccctgagcctggtggtctctcctcacagctgcgcctccaggaggcatccgtgggtgtgtgcattttgccttctctctctcagctagaagcaacagcccctcttggcctgcggatagcgatcaggcctctcccctgtgctttctagctccctagaggcttcactggtgctcctgcccttaaggagatgtgttgcagcaacagtctctctggtgtttatataaggaaaacagtgcaccgaaaatggtggccatttatattgatcacagtactcagcagaatcagatttggaactgaaaaaaaatgatcacctccctacctccttgaccccccttcctccactgccaa

SEQ ID NO: 105622 - DNA, 1971 bp, Homo sapiens
cttccttagatgacattgagctaaggcctagcattattttccccccaacagcctcattccatcttcctgccttccatccacacgactgctggtttagatttgctggagagtgagctctgcagggtcctagccctgggcagcgccgagcccgcctactgaaggcccagggctgtggtgagcgaggacgggctgctgatgccctcgcctaggcttgggcttcgggtccgcccggcccgcagggggcgcgcggcgctcgggccggccgctcccgttctcttcgcccggtccctgccgcgcacaggcctcggggtcggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacggtgagggcatcggcgggggcgggcggtccgcagcgcccttgactcctgggatggcagagctaggggcgcgggccgaaatcgggcctggcggccgggggtcctctcttccatagtggccaagttcgccatccgtcggcgggcagcggccttgctgtttgtaaagcttagcgtggcacaggcccgaatggacccttagagtacctgctcccggcaagaataggtgagaggtgcgagacctcgagggagtggggaaaacgagtaaaagtccaactcctgccaggatgagtggccaagggctagagcttctagggacaagcatgccctcaccagtgtgagaaatagcccaaagtaactcctgggacatcaggatctcaaatagagacagaatgactgttctggtggattccagctttgtgcctcccaaatagtgcagaggataaaactgttgaaagcatcaaggatgggtagagagcgccagcctccaccaaccttatagagctgaaggtgggggcggggtggtggtctcagtgcagctctattgttaaaccagtgggtgtaatgggctactcgaagttgggtccctctgtgacgaaaccccccccgccccggccaagtccacttagatatggtttcttaactgcttaactgcttgactcttagttgctttacaagttaccgcttagagggagacaggatcaggtgtcctccatcctggccacttgacacaggagtctgtcccaaggaaacagtctcaaaccaggcagcagagttacatcagaacgcttggaagcactttttgaaaatatagagtcgcctccaacatcgctcccattctcaggtcccctgtggggagctggatgtccatgcggtgaaaaagctccccaggtgatcagtgtacacgcaggtgcacatgtgcatatatacagctccttttggagctgccagaggctagagtggagaatgatatggccccccatgttcctagcagacctcttcatgacctggttaagccttgtgtctggtacaagcttaccctaggtagatatctcttccctttctgctctgagattaatccaaaaaacaagaaaaagaagcgaggtacctctcatggtatctgatgcatcaattttccccttgattccagagaacttgggggaggagtaattcatgcctgctcagatgtagaggttttctttcttttttttttttttttttgagatggagtttcactcttgttgcccaggctggattgcagtggcgcgatcttgcctcactacaacctccgcctcccgggttcaagcgattctcctgcttcagcctcccaagtagctgggactacaggcgcctgccaccaggcctggctaattttttgtatttttagtagagacgaggtttcacaaggtttcactatgttggccaggttgtcaaactcctgacct

SEQ ID NO: 105623 - DNA, 1038 bp, Homo sapiens
tattttaggaagagccttgcattgtcttgatctccagtttgtgtgtgtggtggatttttgtttttgtattttttgcttgcttgtttgtttagtgtcttctttcagacatcagactggggggtttattgaccaaccaggcttttgtaggtgatgtatgaaatgaggagattgggcggagaagaggatgctggtaggatcccttctgtggtgtgtgggtcattggcccttcttcaggagatggttattcaagtgggtctggccccactcttccctgtaaaccctgaagtcattcctcttttcttttccaagatgctcctgggtggtttggggtcatgagccaacatcctcagaatccagcccagggttgccctgatacacaccccatggagtttttaaaagaaaaagaacaactgtaatgcttttgttcttattttcttagcttctagggacctattaaaagagttcccacagcccaaaaatcttctcaacagtgtgattggaagagccctcggcatctcacatgcaaaagacaaactagtctacgtgcacacaaatggaccgaagaaaaaggtaactctgctggtggcaaggaaaaacattggtatgactcagaaaggaggctgtttgtcctttctgtcttaggtttctttgtcaaggaggccatagaatgggtttcctgaattaaaatggtcagcagagactcagagcaaagctaggtttgaagaagagccagaatacacgtgcctggtttagggaagaggaacacagggcaaatgaggtgccatcttatctaagacaggcgcctatacggatccttggtttttgcccccatcgactaaggactgcagagggttagagttaatgataattcttgcccttacagtcttatagattctggaaccatagaagcatgccagcaaaccattctggatgattttttaacatttattttatttatttttgtagagacagagtcagagtctctctgtcacccaggctggagtgcagtggcacaatcataactcacagtaacctcaa

SEQ ID NO: 105624 - DNA, 1022 bp, Homo sapiens
ctaacatagtgaaatcccgtctctactaaaagtacaaaaaattagctgggcgtggtggtgggcacctgtagccccagctacttgggaggctgaggcaggagaatggcgtgaggcaacagtgcagcctgggcaacagtgcaagactctgtctcaaaaaaaaagatgaagatggatcccggcttggcctctggctagaacatggcaccttgaaggagcaaaacaacttggggtagaacagattgtttcacggtgagacagttagagccttataaggagttaatgatgggattggggttctgtcctctgttctcaactctgaacctagcacattgctgctgtgaggtctgctgctgtgaggtccaccactgtttattttccatgtaatttgcaacaactctagtctggagtggcaagacttctgatttctctcttctcttccccagaaagtcacactgcacataaaatggcccaagagcgtggaggtagaaggctatggcagcaagaagatcgatgctgagcggcaggctgcagctgcagcctgccagctgttcaaggtgacccttcctcagtgaaagccactgagaccttcctcctggaaactccttgccctttgtttttattggtagaggttggcccagtgttctaccactcacctgccctgagcccttcccacttcctgattcctttcttactgttcagccaatgagatatatatatatatatatatatatatattttttttttttttttcctgtgtttttggtttttttttttttcctttgagtcagagtttcactctgttgcccaggctggagtgcagtgatgcgatcttggctcactgcaacctccactttctaggttcaagtgattctcatgccttagcctcccaagtagctgggattgcaggtgcccaccaccacgcctggctaatatttgtatttttagtagagagggggtttcaccctgttggccaggctggtcttgaactcctgacctcaagtgatccacctgcctaggcctct

SEQ ID NO: 105625 - DNA, 1444 bp, Homo sapiens
cactttgggaggccaaggcgggcggatctgttgggtccaggagttcaagaccatcctgggcaacatggtgaagccctgttgctacaaaaattcgctgggcgttgtggtgcatgcctttagtcccagttactttggaagttgaggtgggagggtcacctgagcccaggaggcagaggttgtagtgagccgtgattgtgccactgcactccagtctgggtgacagagcgagaccctgtgtcaaaaaaacaaaaaacaaacagtatcttctgctcacccattgccatgtggggttatttgtttgcatcaaagctaggcatctttgagagttccatgcccagttctggactaggggctgaagtgggtaaacagatgaaaaaccacggctgcacaacacaacttaacggtgtagctggacacggaccaggccgactgaggtgtaaagatggtatcaatccttaaaacgtcccttttcccctccagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaaggtacagatggaggatggggatgcagcagaggctggctgtgccttgacacggggatgggcgaatgttctctgctagctttctctgagatgggagcgcccctgcctcacatttcagcctgtgtgccccatcactcagtgtgtgtctgcccattcttgggggacagccagctgtggtcttctatgtggctgggcttttgcagaacagcagcatggagcccctgctctctgctatcttatctgtgtgagggaatggagggagcagtccccatgcagtgtggctgtgggaggagcagagacgcccggtttcccatccatttcatgccttctgcccttctggctccctgctgcagcgcagcgtcctcacccctacatcgcagagcctcagggaaattggtccaggaagagagaattctttcagttaaacttttggtcctcccagggggagttcctttgagatgacagatgacgacagtgccattagggctctgacccagtttccacttcccaagaaccttctggccaaggtgattcagattgcaacgtcatcctccacagctaaggtgagttgggtctcctagaagtttgtgtgggggccgtttacttggtcatgtctggtgttccctaaaggcaggtttagagagggctgagggggtgtgttcctcc

SEQ ID NO: 105626 - DNA, 1005 bp, Homo sapiens
gtccaggtgcagggtctttttgctcccgcaggatgtgcctggtttttagctcatgctgacagcttcaacccacagctgccacgatgttgccgagatgacagtgggctaggagggcaggtgatggcattgcccaagcactgtcttctgcagtggaagtcgaggtatagcaggagaagcgagcctgggactagggtgcctgagcccatgggcctgctcctggctatgcagcagcacctctagcatggctcacgcctggcacctgctgagatggtggctcattctgtctctgggctccttggcattctgagaatgccccaagtctcttcccattccctacatttctgtaaccatctctcttgccttccatgtagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaaggtgagtccaggaaggtcctgggtgtggtgcatgagaatgtcttgaagctcccctctgccagtggcaaatgggtcccattttctaggaaatgaaaccaccacagcaggccttttgcctggcacaaagacagctggtatgcaggcctcgcttgtaggccctgtggctgttgccatggcttttccagaggccctgtggagatactttgcccgtgacccagcattttccacactgttggcctgaacctggtgaggccgggaggaaacttgctcattgttctgaatagtataaagccgggaggagccgggcctgttttgagaggcagacctggtgtccagtatgatcctgataacccgggttttgtgggcagaatgaataatgtgacttgtgactgcagtgatgattgaggaagcagtcaggatcaaggtagagacagtgtggcagacagctggcagttctcttttttttgagacagggtctctgtggc

SEQ ID NO: 105627 - DNA, 1036 bp, Homo sapiens
ccaacaggggccaaccccctgcctctgggcgtgctggcaccatcagctataaggacctaaaggacaggaatctggtcctcataccacaggaggtgccaacacaagctccttgctgcaggaacaggcttctgccctctccccagacttcatgggttttacccaccagcctcactgacaaatggccctccagccactgcaaagcttgctccttcccagacaggcccctaccatgccaaggtgcttctgctcacagtgcgtgtgcatcaggccaaagctcagatgcctccagttctactcagtccttgttctgccctcgagtcacaggtagcatatctgtgccctctttatctcaccaattgcctgtcccctcttcctcgtctttctccaggttcttgttacctctcaccatcagctgtaactaaaacatggttcccagagccaactgtacccatgaaatggtgcacctgaccattcagagtaaagcaggcccatttctatcttggtctgcaaactaaacctccaccaacatgggttgagattactaactcctcaggcagtcagagacaatcccaactccctcccactactgtgccatcagctaactccaccagcccctttcaagagaacggccatggccaggagcggtggctcacgcctgcaatcccaacactttaggaagtgaaggtagaaagactgattgagcccaagattttaagaccagtcttcgcaacacagtgagacccttgtctctacaaaaaatgtttaaaaataagctgggagtggtggtgcatacctatggtcccagctatgcaggaggctgaggtgaaaggatcgcttaagcctaggagatcgaggctgcagtgagccatgatcgtgccactatactccagcctgggccacagagaccctgtctcaaaaaaaagagaactgccagctgtctgccacactgtctctaccttgatcctgactgcttcctcaatcatcactgcagtcacaagtcacattattcattctgcccacaaaacccgggttatca

SEQ ID NO: 105628 - DNA, 1048 bp, Homo sapiens
ctgagtccttgcccaagggcaagatgtcatcactctgcagccggagttctggggcgatccatgaactctccacagggtactggagggcagggaggcaagcaaaacaatgaaaaagaaattcctcattcacacacaaccagccactctgcaggattcgcctgggtcagatgttgtggcccaacccgctgggcagaggattaatttagtccatgactgccccgggatccttgtgggcaagactgggctgttcaggccagggggatcccaggccccaaactcagtgaagagaatggggaggtactactgcctgtcgcaggtggaggccttcagtctggagagatggaggcagactacagggagcaggggtggtgagggatgcagggcctcttacatggttcaggaaggtctctatcttgcggaggatgggctcgggcacctggatggtgcatggtcggcgctgggtctcacccagctcacgcaaagaggccaggttatacatggcgtgtgtaagcggttcgttgttcctgtccaccaggcccaggctctgcagggggacatgcaagactcagtctatgctctggggctccccaaaaaccagcccagacaagctcaggagctccaacgcataagttgtgccaagtaatctctaagagattttggattttggctgacatggtgatggagggagaaattatgaactaggaaaatgttaacttaccaaaataaacgttttaaaaaatgaactaaagttaattcaggccgggcgcggtggctcacgcctgtaatcccagcactttgggaggccgaggcaggcaaatcacctgaggtcaggggttcgagaccagcctggctaacatggtgaaaccccatctctactaaaaatacaaaaattagccaggtggggggccggcacctatagtcccagctactagggaggctgaggcacgagaatcgcctgaaccctggagacacaggttgcagtgagccgagatcatgacggtgcactccagcctgggcgacagagcgagactctgtctcaaagaaaata

SEQ ID NO: 105629 - DNA, 2131 bp, Homo sapiens
tacaggtgggatcctgtgcttcctgcctgggtggcaggagatcaaaggagtgcagcagcgcctccaggaggccctgggcatgcacgagagcaagtacctcatcctgccaggtgagagccccggcggagggaccagggacctttggaaaccagcctgacctctgtcctagggactgacccaactgggactccaggggccccggtttctgaccaagctgtggcacttttcactgggcatagtgtttatctgcgcctgtttcatcaaaatggggtcaaaatccttgccctgcccacattccaggggggaattctggtggaagcagtgcccataactggtgtgtgtcttgcccaccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtggcacctacctcctgggcccggccaaccactgggggagggactccgttttgaggtggtccccagcccagatctaccttagacctgctttgtgtgtcttcagaaggccgcgcttgtggggtctcagtgttcctgatgtagggggctggtgagggttactcagggagtggggaagcactgaggaagtggcatttgtgtgctgcttacttgccacctcctccaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggtgcggcggggcggggcaggggctggcctggggaccaggcaggtgggaggcaggctcatggcgggctctggctctgtcataggcggtggagttcctgtccaaggctgtggacagtccaaacatcaaggcagtggacgaggctgtgatcttgctccaggagatcggtatgtaggggctgggctgggctgggctggggagtggctctcgagggtggtactgacagctgagccgttgcaggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtcagtcctggctccttcctggagccgtccacccactgctgttctgagggggcgttgtctagcccctgcctgtgatccggctgccctcttctcccctcccaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggtcagtcgggcccacacctgctctcctgagcccctcccacccccactgagtttctgtcacctccagcctgtggctaggggctgtaggtccaccacacattctgtctccctaggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgctgcctctgggagggaatggagttcaccaggtcccagcctccttccctgtctgcagctccttgctcagccccacccgtcttttcctccatccctgcaggtgaggcagggcaaggtcacccggcaggggaagttcaagcccaacagcgtcacatataggaccaaatcaggcaacatcctgctgcacaagtcgaccattaacaggtg

SEQ ID NO: 105630 - DNA, 3314 bp, Homo sapiens
gtggggccggggcacctgcctgggattctccaagcgactgtgccttgagccagtgggtgccagggcagcaagggtgggggctgtgtgtgaaacccaccaccatcaccccatcccactccccccctcgactgaccctgcactgtctcccccactgtttcattgtagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagtaagtggctgggctcggcctaagggccagccaggggccctgccactggccgcaaattgaaactcctttgtttttgactagagtgtggcctaaattttaatgaagtaaccttttattttccaggcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcacgcaggcttcgtgcttctgtctcgttttgcatctaccacctccctggatcttcctgccctcagctcagcccctcagctgtgaacttgtggatgtggacacgggaaggaccactgtgccacatagccctgcgccttggctacctgtggaactctcccctagtctgcctgataaagggctacttgacacttacttgcttacttactgtccaaaactacaaggacagtgacagttctgacaggcttcctgtggtgggtaccgagagcagcagctgtgccaggggactggggtggttaacagcaccgctgcttcatgctctttcttggtgaagggaggaggttccaacccccttctctcttaaaagacttggggccacagccagcccgttccccagcaataagcatctcactctcttctctacctaccttcctccttcctctttggggaaccgtggcccagtgtatggaggccctgagagaggagcccctagtgg

SEQ ID NO: 105631 - DNA, 1018 bp, Homo sapiens
cttttgcagcatcagttttaccggctgggaagcagggaccgtggccgtgatgacagggcattcatgagaattcagtgaggctgtgcctgagaagcactgcatggcccagttagcgggagggcattcccacacagagtagagaagcagaggcttcgccctggaggctgtgctcggagccccaggcctgcccaagcctggcctgcagctcagtggctgtggcatggggtggtggaagggatggctttccttttcttggaggtattcccactggctggacggagagattgtctcagcctcactgtgatatgagaagtcctctttagacaaacgtgttcactgttcttcatttgccacccagaacaggtcacgtctgtctcatttctagattgggcatatcgctagtcctggttttgcctgcagggatattcctctgccaccctaggtgaccagttcctttgtggttccaggtggaggagatgtcaagattgaaagtcagaagttgaacttcaaggagaaggcccaggccaaggtgggatccctcgataatgtgggccacctacctgcaggaggtgctgtgaaggtagcgagtgggtcactggggagacacagctggggaggggtgggaactatgcagttagggtcagggtcctcacaggtaggcacctgtcaccgcccctcagtctcttcaggagtcatgtcttcacccacaccattgccgttttcccaccgtgtatcatcagtcctgactgaggcagaagtgaagaggccccagcccagccacccctcacctgtcagctggaggcagaaccttgctcctgagagccatggccttcctaattgagcccatccagccatttgagaaggccacggactgggacacagaccacccccaggcgagcgggggttctgcaccacacagttctccccagctgtctcgcgccaaggggaatgtgggttcccgccccatgtcaggctccgctcctgggttaggagcaggacagcacattcttagctgcca

SEQ ID NO: 105632 - DNA, 1062 bp, Homo sapiens
catgccattctcctgcctcagcctcccgagtactgggactacaggcacctgccaccacgcccggctaattttttttgtatttttagtagagacggggtttcaccatgttagccaggatggtctcgatctcctgacctcgtgatccgcccgccttagcctcccaaagtgctgggattacaggcgtgagccaccgtgcccagccaaggtgcaccacctttaaatgcaaatttttgcatttttagtagagatagagtttcactgtgctggccaggctggtctcaaactcctagccacaggtgatctgcctgcctcagcctcccaaagtgctgggattacaggcatgacccactgcacctggctgggaaaattgttataacatggattaagcaggaatactatgattacacacacacacacacacacacacaacgcgcacacacacacacacacacacacacacaccaccccctcacctctcccaaggggaaaatgcattgaaaaggactagaagtaaatatgttattccaggttctctgggcaaggagttgataggtaaggatttgagatggaataaaggggatatttcatgggagccttggtgctggtgtttggacctggtgaaatgacagaagagctgtctggagcatgcatggacagggtctgcacagaaagacctgtggggtgtggaaatggtggtttggtctggctggaggtggggttagaagtgaaggctggtggccgggcgtggtggctcacacctgtaattccagcactttgggatcctgaggcaggcggatcacctgaggtcaggagttcgagaccagcctgaccaatatggagaaaccctgtctctactaaaaatacaaaattagctgggcgtggtggcgcatgcctgtaatcctagctactccagaggctgaggcagaagaatcacttgaacccgggagatggaggctggggtgagccaagatcgtgccagcctgggcaacaagagtgaaactctgtcttaaaaaaaaaaaaaaaaaaagtgaaggccaggcgtggtggctcacgcctgtaatc

SEQ ID NO: 105633 - DNA, 1184 bp, Homo sapiens
cccttatcatttttagactctgttaacactcctgcctcctccttggtgatcatgacatcctgcccatggcctacagatacccccagcagttgtatcatgaggaatgcggccatgagctttcattcttgccccacacaactccttcctgcccctccttcctggtcatcttctcaccactgcctcttcctggcctgggtagaaatggcatcctttacactcgggtggaattgcttgaccagactaattagtcagcctggaataggatcagctgaagtgaggtgacaaagatccagcccacgaggggcccaggcagctgctgagcctggctttgtcctggatgaaaacagaaggtgaacaggggttctgagggaactgggtcacttgtgtaggtgagacatagagatatatttgtgtgtgttgtgtggtgcatataagagctctgaaaatagtcatcattaatgtatcacctgctgtgatctttccacactgcctacacatgacctcacatgtgtagggttttttgttttgttttgttgttttgagggtgaatgtatttttaaagccttttcactttaggaggcttccttaaacagagaattagggagactactgtgagccatctttcctggtgggaagatgaggataaacaacagctgaccacagctggacccaggtgctttgtttccttccataatctctgtcagtccctccctaaagccaccacaaggaaatgtgcagtttaaaatgatgagccccccagctgggcaccatagtaagacccccgtctctacaaaaaaaagtcttgctctgtcgcccagcctggagtgcagtggcgtaatctcggctcactgcaacctctgcctcccaggttcaagcgattctccttcgtcagcttcccgagtagctgggattacaggcacctgccaccatgcctagctaatttttgtattttatgttatgttatgttattattttatttttgagacggagtctcgatctgtcaccaaggctggagtgcagtggtgcgatctcggctcactgcaagctccgcctcccggattgatgctattctcctgcttcagcctcccgagtagctgggactacaggcgcccgccacaatgcccagctaattttttatattttttagtagagacggggtttcaccatgttagccagaatggtct

SEQ ID NO: 105634 - DNA, 1624 bp, Homo sapiens
gcagcatacttaaattgcttaatctggagctgttaagaaattcaggagggacaaaaatgaggtggaatcctggtgctgttggaagacactgatggcaagctgagatcagtctagagaagagcctgagagttgcttgtggtagcgacagtggctctggtgtgcccagcaggcctctgggctgtgctgctgatggcctatctccccgtctttgctcttatggtttcatggtgcaaaagttacaggagttcttgggtggggagttgagtgacttgatctagtgaattgttttctgcttcaacatacctaaagagtctgacactttctatcagtattgacttcctgtgaccgtggcagctgcttggggcatatcaggacatttggcatggggtggggggtattgtaattggaaaatcatgccccagcacactctcagaatcactaatttggttgtcttagccttcctttgtgccttttcttcattagctagtgtcttgatctgttcctcatgtcttaagactatggcctgcagctccttcttttgtggtcctctactcaaggatctttgacttggtctaccctgggaaatgtatggttttgcctaggatcaaaggccacctgcttttgcctggtggcctgacctggatttgagtcccctacagccttcttcccttcttggcttttgagctcttatcctcttggtttgaaatttgccctccctttatctccatccaggccaaagtagagaaaaaaacagaggcagctgctacaacccgaaagcctgaatctaatgcagtcactaaaacagccggcccaattgcaagtgcacagaaacaacctgcggggaaagtgagttttatttagacccacctctgcaaggtgaagatggtaaaatacttcttccagcctgagccacatgccctctcttgcactttttccctttccctaactagtttctacttcttctcccctatattcccttctctgtgcttgatgactcggccatcagaaaattttttgtattaaccttgaaagttaatagagttgggagcccattagccctttggagaatacatatgtgtataatttttggctggataaaatggatccaaagactttcattcatttccttcacactgaccttgatgtgaaacctacctggtatggatgcaaatacagtgcacccacattcgttatcaagaagacatggcaggggtaatttccaccacctggaaccctggagcccctgtgctttaccttgaagtagaagatccctctcataacgctgctgggtatggagataacttcatttgtcctggttccccgggtcacctcttaactgaaagttaggatgctcattcccaatggaaacccacttagtataggtatgcagcatcaactggagggcagaggtaagctgaaaccacaggttctttccccttgcctctgtaaacctggaaaccaggcccctcctgagtgcttgcaacacctaccttccttagctgtagcaggtaggtgtgcctctgccagagaagcccgcactccagcccttagggaccagcatgggaagtctcagcctagggcattcctacagtgaagaaagctgcaccgtggcttctgggtgact

SEQ ID NO: 105635 - DNA, 1758 bp, Homo sapiens
gccactgcactccagcctgggcaacagagtgagacttcgtctccaaaaacaaaacaaaacaaacaaaaaaagaagcatcttgtagcgtgactccttggggctattgctgacctgcaggcctcattcccactttcctatttccagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactggtgagtattgcctttctctcccatgggaactagggaggggaaaatgggatcttggctttgccccagccatagctctagctagtatcacaaacagctgtgcaggcctgcttacgcaccggtccttagtggactacctggaacagtggtagccctgtgggcctggtacttaacaagccttgatctctgtgtgagcttagcagttgtatgtattcagaaaaatcttgagtgaaggcagaaaaatgtactgctcatgaatttccaggtagaatttactcttgccttagtaacccacagcacctagcacgtggtgctcatgggcttacatgatgataagaagagggcgtggtgctcatgggcttacatgatgataagaagagggctattcaagtccataggcatgtattgacagcctacttttaaggccacatagaaggcttatcagggcagtagagaagaataagactcagtgcctgaccatctaatttaccactccattcccagggactaacacagtccctggctcaaagtagatattcagtaattgttaaataatgaggaatctcactattggatgaactatccaacaggtcagtttgttaaatgttatattaataagtatattttgtacagccattaagactgagggaaaacctgcagaagtcaagaagatgactgcaaagtctgtaccaggtaatagcccatccgccattttgtagagccctaacttgaacccccacctcctctgtggcttaagtctccctttttctctctctccctgaacccgtgttatctctcactcccttctttgcagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtgggtccagggagcttggggtcctggcatgctggcccctgcatcttcccctccatttccacccactgttcccaggcccaccaaagaagcaggcagtcaggacactggactcagcatcagggtatttcagccggggctctgtagtgggttttgtgccccagcagcagggaggcggggtaggctgagctctgggctttctcttcctgtctcagtaagaaaggctcctgttctagatgttggggtctgagtttacatttttgcttggatgtaaaaggattcttttgtagaagaaacagaggaggcctcagagactctgcaagtgagag

SEQ ID NO: 105636 - DNA, 1168 bp, Homo sapiens
tggtttcattccattatttattgagctcagaagaaagaaatgctaattttaagttgcatctatcctcattgcttataattttactttgaattgtgcaatttatactttttttaatttgtttttattcttgtctgtttgatgttgccctttaaaaaataaaaataaaaaataaacaacaatcaacctaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaaggtaagtggtcacctaactactgtgccgaggaaaattgttcccctctgagtgtcagatagacagatccttgttgctaacagacaacagaatcaggctggtggaattgggaaaaggcaagggaaatgggggagagggtgatttgaaaattggcatggctactctggacgcgctgcctatgggttagccctgctccacgaggagcagccaaaaaaagaaaaaagaaaaggaaatcaatttggggcccattgatgcagacattaacattttgaagcccttttatgctcttacctttcccttccctgtttggaggtaatactctatctacttaggttcttcctcctttctctcagctacctactctttacctatttaagcacttattaaccagtttcctctactccacataccagttagatattcttttttggtataattcccacatcaaatgtaattctttgtctttccctgttatcatcctgcagaagttttatccattactattgtgatataactagttcttccagcttatctcagcatgttccagcatgatgtgataacttactttgctttgggcattaggccacctctcactgagctacttctgaagtcatccagttttccaggtcacccacggtttctgtattgcccagaaactggtcacatttggagcagcattagtgttacagaattgctccaggaggagaggatagtggaggctgtggctgcattccttaacatcttgtgttatttgagaagggcctt

SEQ ID NO: 105637 - DNA, 1052 bp, Homo sapiens
tggtatcatctcattgttttctgctcctcccctgtaaatacaactaaatagtctggaaataattgaagataattccataaaagaatatgaggtagaaagaaggcaaacctggtagggatctcaggacttgaggaatggcaatacagtgaattccctgggactgatgaattgattgattgattgattgattgattgattgatggtagagatgggatcttgctatgttgcccaggctagccttgacctcttgacctcaagtgatcctccttgcttgacctcccaaagtgctggtattacaggcatgagccactgcgtccatcccctgggttttctttttgtctcctacatatccctggctgggcactggagaggcctgtaacctggaattaccaacaggcatagactgaaaagaaaaggaaaggaaaaaagaaaacaaatagagaaaatctgttctctattgccaaaaaaacaagaaagaaaaaaacccagcaaagacctaatggtgagccctgtttcactacccatccccagcagtgggctcagtctgcctgcaggtacagtgtcaatgcagcccataagggccttcctgttgtccactccatactcagcagaagctataggcctggtccgcccacatcaccagcaactgcagggaggcctgtcccctaccaggtaacagcaccagtggcttctatagccctggtgtcttgtaatcctctacccaggggcaggagactttcgtaggtttcagaacctctacttccttccccttagcaagagaaagcccccgaggtaggtgtttcctgctcccagcaaccccagcagagatcaaacaggaggtctgcctgggtcccaggcagccagagagcagtccagaggaagctctctattctatgtttccagcatcactcagcccctatgtgctgacactgggtgacacaggtaagtccctacagccctttcaggcagtaccaaaagggattagttagaaccttagcagaatcagaacacaacaggccataaatgcattgcaagggctctaggaaccaaat

SEQ ID NO: 105638 - DNA, 1066 bp, Homo sapiens
tttcccagccagtggtagtataggtaatggaaagacccaacagaagagcacagttcattgaaggagttagtaagttccacatcagacattgcttttgtgaaactctggggatatgtgggtggtggtctctagaaattgcctgatagctgggcttggtggctcatgcctgtaatctcagcactttgggaggccttggcaggcagattacttgaggccaggagtttgagaccagcctgagcaacatggcaaaaaacccatctctatggaaaaatacaaaaattaggtgggcatagtggcatgtacctatagtcccaactgtttgggaggctgaggtgggaggattgctcgagcccaaaaggacaaggctgcagtgagccaagatcatgccactgtgctccagcctgggagatagatcaagatcaggtctcaaaacaaacaacaaaaaagaagttgccttatatatccatgagacaagggaaagggcttggtgagaactaccttctgggagagagaaagcagtttctgcttatgcacagttacatttatttgtataggtcgagttactgcatgcctgtatcatagacaatgcgactttatgaaatatgttgtttactgaaaaatgctgaacttattgaaaaatatttatagtggtctggggccagtggcagctagttacacaagtaagatcttctttgagcttgctgtagaacaaaggcattagccgggcgcggtggctcacgcccgtaatcccaacactttgggaggccgaggcgggcggatcatgaggtcaggagatcgagaccatcctggctaacacagcgaaaccccaactctactaaaaatgcaaagaattagttgggcgtggtggcaggcgcctgtagtcccggctactcgggaggctgaggcaggagaatggcatgaacccaggaggcggagcttgcagtgagccgagatggcgccactgcactccagcctgggtgacagagcgagattccgtctcaaaaaaaaaaaaaaaagaacaaaggcgttaacaaatttgcacagttgttggctatggtttttcccc

SEQ ID NO: 105639 - DNA, 1054 bp, Homo sapiens
gggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggtatgtttctaaattttgcctccattgggaacaagcagacagcaaggaaggaaccaaagtgacagattaccggcagagcactaagcagctttttacagctgggttctgtgactgcctggggaaagcttaattcccttgtgttggaagcttgctgggagtgaggcaaggaagagaacaaagtgaatcttgcagggtcaagctgaatgtcttgctagcatgacagataatgtgaattgagtgtgcaagtttggggtggaatggggtcagagaatggtgggtataaaaactagaccccctttcttgacctcatgtcaccctgtccaacccatcccccatccacccagccctcagctccctgttggtttgaaccagatgattcctgagctctaaatccttcaatcccaactgattgatttccttgcttgaaaatctgtcactttatatagattcacaatgggtttatcagcactaacctcctctcattaagttgcacaatctgggtggaagctctgttttctgtttttgctttggagaacgttttacttttgttcaaactgaaaaagagccctttaaagctagctatttaatattctttctgtgttcttcatgtttgacccaatcttgcttctagttttctctttttgtatgtgttttgagaggatttgtggggagaaaaagaagaaagagaaagcagggagagaaggagagacttgcaacctaataaacagctaaattttgcggtctttgtgacagccttttgtgtctttcttcctggccctttcttttcttccccatctcccatccccccac

SEQ ID NO: 105640 - DNA, 2312 bp, Homo sapiens
tctgatagaatatttccagtatgctatgttattgcaagacagtaacttacagctagacaagaaaaatcagctttgttcaaagtaagagtatagcctgtccttatagtgtaatttttttctcacagttttgttttatggttccttcagtttgaatatacaatatttgagctcaaagcccagggcagcaaaggaccatgctgagttaaatgggggcagtaagctctggtgagtggggaaaactccaagctacaattgttagagtccctaagtctggaggtcagagaaagatgcactgcccccagtgtgttcacatgacacctaacagattattaggctggaaagagcagggcttggtagtggagggagcaacccagctcatccaaggaaccaagtgggggcagggacaggcgtaaatgcataaggggtatgttgtcacacaaatgtcttataattagaatatctatccccaaagccctgatcactgaagtctttaaatgaaccctttattaaactcttccattatgcagagctacagatggagctcttacgggttttggggaccccactcaagtcagttttcaagttagtttgataagttgctatgacagcaaacccactcttcctctgagaatgaatgcctgcaatcttaatactacgttaaggtgtggttttttttttttttttttagtccaattttgaacaatttcctggattcattgttcttcagggttatagctggggattggcaaatgagtctcggttatttttaaaacagttttctgagtggttgaatgtggaagggtgggcatggtatcagataaatgagtgtgtgggtatgcacgtatctatatcagtgaaagccaaaataattactatccttagtgcttggattggcaccatactgtgttttaaattgcagatctaaacagagtgctagttcacgggaaattacattctcagattaaagtagcattttgttgtgcagaaagcagcaggttccttcctttctttcgctttcattcattcttcctttctttctttctttcacatttgtaagtgcatttaatactcaactgcttgaggagagaggggcattgagggagagatgaattttgtcatgaatactggggaattggtgtgatgtcactgcaagctctgtgtgatcgtaggtggtattagagctccaggagcgaaagcagggagagcagtggaggagagacgatgtcgctctcagacaagcagacagcctctctcactgccgcgtacggtcagctcagtaagggcaagcctgcagagtgccgaatggactccccaaaagaaatcagtcaagccggattcgaatggcagaggacagagggcaaactgaatgaaattgggctgaatgtcagcatggacgggcaaccaaaagatgggcttgtgaagaatgccagcttcctggagcagaacaagctctgcttttttgaggggaagctagacaaagagctgagcattgaaatgcaggacaaggactgtcaagaagcctcaggtcaccttgagagcaggtatgtgatttcagagacctgccatcccttggaggggaactcggtacaccagaagacctccgagttccatctgggactcatagaggggccagacaaaaacaaaaccattccagttcaggggaaggtggcagggaagaatggactagagaccaagagccagtcagatctggatttccctggggctgctgacatccctaccagatatgttaaggagcaggaaaccagtgtttggaaccccagctttcatccagtggctcaaggctctctgggctcaagggaagcaactccgggagagatggagaatagcatcacccctggctgcccagtgattggggtggtaaatgataactctgagcagctgaagtgtgagtccccactcctggtgtctctagcccacccagcccccattattgagcattcacccaccaccattccgccaatcactatggtgttcacccaggaacatttgaatgcaagctgtcacatcagagaccatgataaggagttggagaaattgagttctaccgaggaggctgtgctcaaccaagccccccagcagaaaaaggcagtgcgcagggccctgtctgaatgttctcacctctcagttcccccagctgtcaaccttgcagataagtaccctgaactccctgcccgagaagagccttcttctggcctgctgcctccccctagtagcccaatgcctagtcctacacctgggaaactgggagctcctgctatgaagcgctccatgactgtgggtgaggaacagac

SEQ ID NO: 105641 - DNA, 1052 bp, Homo sapiens
tgtttgcttctcatcctttttttaatcagggagaatcatgatttattttcttgagttaaaacatgagaaatgtttctaaaatgtagaatatggtttctgaaatagttttacctttatgtatgtatgtctaaacacttggaacgtttacttccagggaagaaactagattataacttgacaactttatcttttattaacaaggagtgagtgtcatcaatcattgttaatagtagaattattgactttcattgtaatgataattgtttcctggaggcaataactgggaacagttggtcaatctggaaagtagtgttgccttggtaactgataagaaagaatgcagagaaactagttgtctgtcatgtataaaaaccaaggccctgaacaggttaaatactaactccaagcacaaggctaaaacagaaatatctgccagtacatgtactgggattagagacctgcaggctttgccaagagtcctggaaaccaccttctgcccagacacacaggaatccatgcgctttcttcaaactcagacagaatggaatagaacttcacaatatttagctcaaaggacattccagatcaccaccgcttgggttgggttgaagacagctttaatgatggaacggatcaggtcaaatgatgcagatgcagtgtaaaaggaaactacccatcctttcactgagcagatcttttttgaaagcttatttactgtgagtcaagcactgtgcagtgcacccacatggcacaaatgcacagttcacattcctaccttctagaagctcctgggaaagtcatataaataaaagattacagtgtggtttctaaattctaaaaagagatagagtattatgataatataaagaactcaggaggggttcaaagagactttgcagaggtgagtgagtaggaataggacctagaggcaaggggccgggtgcggtggttcacacttgtaatcccagcactttgggaggctgaggcaggaggatcacctgaggttaggagttccagattagcctggccaacatagtgaaaccctgtgtata

SEQ ID NO: 105642 - DNA, 1703 bp, Homo sapiens
cattacttggtataaggattcacaggaggaaagaaaatatttcatgtctagctatgtgcatgagatttttttcaatttatatgtagcttgtgctggtgggactaaatatccaaactgcttttaggttaaatgaaatcagtccacctccttatgaggaaatggtggcctcaaaccagcattggtaggcaccgatttatttgtgtttctagtaatgggaaatgatctctcaatgatacagatacattttttgaccagtttgttgcttatatccattgccccacagttccatgtgggtttgagttttgggcatagtctgtgtccatcaaacatagtccataaaacttgcccatgttgtgttcctcataattttactcttttttggctctattcagtcaagtaattggaatgagattaagaagatgattcctttaagatttagaaatggtagccccgtttccccccacccccaattccccaaaaaagtatacatttaatcgtggcttccctgaatctagctttcaaaaaatgttcccttgtctttgagatttttcacagcctacaagtgacactatttcttaatcactgtttcccagcttgcatgatgtagctactaactccagaatttaaaaaaaacaccaattggttttagtagccagtcaggcttttagagaggtttcatcatgggattgtgttctgcatggtatggacttgttcttttgggtaaagcttgtctatgcatgagtatgtacccactaaggaatactgctgtgtgagtaaagaatgctaaaggttgttatttgcataagacattctcatcttctctgtttttatcttctattagctaccctattaccaaggcagaaaatgaaatagtatgtagagggctttccagcattcattgagatttccagtgttctatccagttctttcgttttggtttctagacccattctttagtttcagcagtgatctaaaagttaacatgtaatttctgtgaaatcccagccatctctttttgctcagtatttccaaagaaatgcagaaagaggatttgtttttcttgaggaagcaagaccagtactgcagaacttttggggccctgcctgggtcaggtcaggctcagagactgtgttagcagtggccttacagagtgggtatgggaaggataatgggtttgggacaaaatttattgtttcttctataaattctaccacacctttcccctaaggacaatgtatacctttttaatagttaaaaaaaaatttttaaactaattgtcgaataggttaatacattcacatggtacaaaggagtatacagtaaaacgtaagttggcctccctccattaaccgccttccagctttccctctccagagcaaccagtgttcacaatagcttatatatccttccagacaatttatgtataataagtaataacatatatatttcctgatttcatataaatgagacgtatacatacatactgatgtgtgctattctttttaaacttaatttttaaagagatcttttaagactcagtataaagaagccaggcgcagtggctcacacctataatcccagcactttgggaggccgaggcaggcggatcacctgaggtcaggagttcgagaccagcctcaccaacgtggagaaaccccatctctactaaaaatacaaaactagctgggtgtggtggtgcatgc

SEQ ID NO: 105643 - DNA, 1256 bp, Homo sapiens
ctcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaacaccagaaatccagtcagatttcttacatagcaaagtcgaagctcctccttcagaggtggcggatacgttagtaataatgactgcttccaagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggtatgaacctgccatggggaaatgtgtgtgcttgtggcttttgagtcagcatcagaaaggcaaagagcttgtgtcttggctccatccagactctaatcatccttgttaatcattggtttgttggcatgaaacctataactgctacggtgtgttttctgcagccaatgtgttccttgtgtcctgcttgaggaggctggtaacttggt

SEQ ID NO: 105644 - DNA, 1420 bp, Homo sapiens
gcaataagttctcagtctaagctgagagtagaggaagagagcaaaagtaacaagtcagtactacaaaaccaagacaagaaattgctgaagcaacatgaatacaaaccacagcctgcaccccacctgaagactcctgtagataaaagccagtcagtaggccctctcaatctgaaaggacccctagcagaagtttctgcatacaatgtagaaacccctttggatatcagacttaaagagggttgctctcctttcttggaccaagaggttatgggtgtagtttcaaaacccacagcagcaaaagaaataccaaatttggtacccactttgatagcaagtaatccattagaatgtaatctaaaagaagggaataatgaaagtaaaatgactaaactgcagaatgtcaaactgaaggagtttcctgaaggagctgaagaggataaagaactaaaaaaggaagcttttcccaacgaaagacaagagatcagcatctttacttctgagcagctgcagggccaagtgttggtacaggtccctggggtagagaatgaaccatttaagagaatggcaggtgatggcaaaagcaggaagggaaggggaagttctgggaaaatgagaacagattctgggaaggtaaaagcaaaatctgagctgccatttcttctggacagccagaaggacggaagggctgttctcataccgagtgagccagtctctaaaactgaaggaatgactactcaggataagagtgaggagctggggctgaattcttcaaagcaaccaggcactaaggctgatctcacggaggcagtggtgatgggggagcctaaagagatgactcagcctaaggtggcaggcaccatgcaggcattgattcctttggaaagtggatcaggcatgactcagacttctggtgttagcacagaaacaggagatgtagtcaaagatatgggtgtcaataaccagagcaaggaaggaaggtgtccatggaaggatcatgaggcagctccctggatttctgaaaagcctaaaaagagaggcaatgaaggcaaaagcaaaaagtttaaaaataattattccacacagcctgctagaatggagaggaaggaagaaatccttaacccaccttttgaagggaaggatggagatactggtagtattccccataaaagcaaggaaataggatttactttccccaaaatgcatgattcttcgttctcacatacaccagatacacccacagtggaagcagttgacaggaagggtggaaattttcaggttaattttgttgagcttgggactcttggggaaaacaagataagcacagtcaaggcttctactgttactgaaccacctgccaaggtgacagatgtgagctgccaagagcaaatccagggggcaggatttgttccttcagtagtat

SEQ ID NO: 105645 - DNA, 1075 bp, Homo sapiens
tttgggaagtacatttaggagcagaatgttgaaatttaacatatttgtctttcaaagtaggatgctctggttctggaatcatgagaatttttctctgaccaaaatgtggattcagtatattttgtgtgtgtgcgtgaagtgacttaagtctggccttctgatctagttcccagaatctgtctggtttgtttgacaagtattagtttaatattggtgacctagtcttagaattataaattttgtccaaaatcatgtatatttaactgaagcaattaataaatttcaccaaaaagaggcaagcactaagaatgaccaatataaatcagatgagatttacaggcagtaagtgcttatttttagaggttaaaagatgtgaaatgtttcatttttaaaagttcaatcctgctacttctgaaatttcaaatattttataaatgtttgaaaacaatctttacctgagatgatgatctgttaaatatttttgctagcgccagttaaaagtgagaaatgttttagaaaagactgttttcctgagcaaattacagtaagtactatatgtattagtgaaaatagcctccttaaattagtcatttatatggtctggtttttttgtttgtttgtttgttttttgttgtttttaagaaacaataacgaggagttttttgtttggaattttagccaacttcatgtattgcggtacccctcccacacaagccaaacaagtttgcagacccagtgaccgcaggtcaacccggcccaagcctgccagggtccctcctgagctgctgggaggctctcctccatggaagactcttgatcacaggctgggccactgctctttgtctgagtcaggttgggtctctggttcatcctcctgtggtgggcctgggaaccaaagaaaaagtattcatgttgactcacttgaaccccagagggatcttggcagggaggcctgggatatagaaagcacaccaataatgatgaagaaaaagaagaagaaaccaaagcaaaagagatattctcaaccacgggctggaggaccttcggatgatgacaatgcagataagcctaaagg

SEQ ID NO: 105646 - DNA, 1173 bp, Homo sapiens
cctcataccaatttaaatcttttttcattggatcattcccacccatttaacaaacgtttgttatttttcccatcttaaaaaacgaaacattgaccgggcatggtggctcacacctgtaatcccagcactttgggcggccgaggtgggcggatcacctgaggtcgggaattcaagactagcctgaccaacatggagaaaccccgtctccactaaaaatacaaaattagccgggcatggtggcgcatgcctgtaatcccagctactcgggaggctgaggcaggagaatcacttgaacctgggagacggaggttgtggtgagccgagatcgcaccattgcactccagcctgagcaacaaagagtgaaaaactccatctcaaaaaaaaaaaaaaaagtaacataactagacataccttcccaacttcagcttccaactaccacttcactcctttgctgccccttgtaggagaactcctcagaaactaatcccatatccaatttctggcagatggaaaatagctgaaatcatgcttctctgaaacgtgtgtggcttttgttattacctttagaaaccgtcacaggaacggggaaaaagtgcagcttgccggccgaggaggattctgtgttagaaaaactaggggaaaggaaaccatgcaacagtcaaccttctgagctttcttcagagacctcaggtaagttaggaaaacaaaatgaactctttgaaacaaattaggggcgatagagtagtgatggtagacattgtctctagttccctgttgtatggtggtaatcagcagtatagtttatgaagtcaattctcttagacagattttatctggtttagacagaatgtcagcttgttatatctttaaaaattactactacagcaaatcaggatacctaattttttttttctccactgttttttttgttgttgttgtcgttgtttttttttttttgagacagagtctcactctgtcgcccaggctggcgtgcaatggcgtgatcttggctcactgcatcctccacctactgggttcaagcgattctcctgcctcagcctcctgagtagctgggattacaggcgcctgccaccatgcccggctaatttttagtagagatgaggtttcaccatgttggccaggctggtctcaaactcctgacctctggtgatc

SEQ ID NO: 105647 - DNA, 1615 bp, Homo sapiens
aaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccaggtacgtgcttgtgcttattctcagtatttctctctaccaggttgtagtctcgagaagactaaggacaaacatcatgccaggtaaagtacagacagtcacactgtactttgcaagtttattcatactcctgctctcctagacaactctttcccgcctttaccctcctcccacctccaacaccttttctatgttcattctctgctgattgtcctgtttttcttgcagataagtcaagcaataaaatagaacatcgacaaacttctattccattatctacccaactacttgtatctgtatccatggtctctgcttatgaaagttcccgtttttataagtaaactgttcctgctcctaattaagaccaacctctcctcattttgccctagattccatctcctctttcctactcgatatattg

SEQ ID NO: 105648 - DNA, 1118 bp, Homo sapiens
ggtcaggagtttgagaccagcctggccaacatggtgaaaccccatctctactaaaaatagaaaaattaggccgagtgtggtggctcatgcctgtaatcccagcactttgggagacggaggtgggcagatcacctgaggtcaggagttcgagaccagcctggccaacatggtgaaacactgtctcgactaaaaatacaaaaattagctgggagtggtggcagacacctataatcccagctactcaggaggctgagtcagaagaatcacttgaacctgggaggtggaggttgcagtgagctgagattgtgccattgcactccagcctgggcaacgagcaagaatccatctcaaaaattaataaataaatataataaaaataagaaaattagctgggcaaacaacaacaacaacaacaacaacaaaactgctacaaagtattttaataaaattgtcttctaatgttggaaagggaggtgttaatctcattttgcagatgaagaaattaagactcgcagttttttactatagtatattatgttggttgtggtgttggaactagagttcaatcattaatattttgaatctttatattaccctttatatattatatagaaagtagccagtgaatgttgattaatggcactactgggatatactataccacctactaacaactagctaaaacctgaagaatgtcagcagtgtttcctttaaaacttgtttgcgttgtcggccgggcgcggtgtctcacacctgtaatcccagcacgttgggaggccaaggcgggtggatcatgaggtcaggagttcgagaccaatctggccaacatagtgacaccccatctctattaaaaatacaaaaaaattagccaggtgtggtggtgtgtgcttgtagtcccagctacttgagaggctgaggcaggagaatggcgtgaacctgggaggcagagattgcagcgagccgagatcgtgccattgcactccagcccaggcgacagtgcgagactctgtctcaaaaaaagaaaaaaaactttttttgcattgttttttattagtctgtgtcttcctggcaatatatgcagctgattttaaatatcaaatacctcttaggccgggcgc

SEQ ID NO: 105649 - DNA, 1373 bp, Homo sapiens
ccacagtcccagctactccatatgttgaggcaggaggatcgcttgagcccaggaggttgagactgcagtgaattatgatcacaacactgcactccatcctgggcaacagagctgagaccctacctatctcaagaaaaaaaaaaaaaaaaaagaataggtcaaccagccttcccaacatggcgaaatcccatctctactaaaaatacaaaaaattagccgggcgtggtggcgggcacctgtagtcccagctacttgggagcctgagtcaggagaatcgcttgaacccaggaggcagaggttgcagtgagccaagattgtgccactgcactccagcctgggcaacaagagtgaaactccatgacaaaaaaaaaaagaaagaataggtcatggttatgaccagtgggtacaaaagacatagacttgtgtatttattgcatgtttcaaggtagaaagcaaattgctgcatcaagtattgttgtcatagcctttaattacctattagtaatgcaaagaagcagagatttttgttttcttttctttttttcttttttcttttctttttttttttttttgagactctctctgtcgcccaggctggagtgcagtggtgcgatcttggctcactgcaacctctgcctcccgggttcaagcaattctcttgcctcagcctcccgagtaactgggactacaggcgcccaccaccacgcctggctaacttttttgtattttagtagaaatgcagtttcattgtgcccaggctggtctcgaactcgtgagctcaggcagtttgccctcctcggcctcccaaagtggtgggattacaggcatgagccaccacacccggcttgagatttctctcttctaggagagttctggcagatgatttggcctttcctcccttgttgtacactaagaggaaatgaggcagagtaggaaagaaaggtacccaaggttgagtgttgaatgagaggaccagggattaaaatcaaaatccctacctggctgaatgtggctctgctgccttggggtaggagattgggccacaagtccagctgggtgccaggaggaggaaggggtaaaaagggagtggaaaacccctccaaggacccactgaccctgctggcagacttcttattcaagtgtgaagaaatctgtcagaatctgagggaaccaaagacaagaaaaaagtacaatgtttggacataaatttccttaattcttgtaatgttttaggattctaataatcttctataaggaggatattaaatatccttaaataatttgctgtacttgggaaagtggtttttcttcttcagtttagagctagaatctcagttacctatagttgcctggagtcaattggtagaatgggt

SEQ ID NO: 105650 - DNA, 1047 bp, Homo sapiens
tcctgcctcagccttccaagtagatgggattacaggcatgtgccaccacgcccagctaattttgtatttttagtagagatggggtttctccatgttggtcaggctggtctcaaactcctgacctcaggtcatctgcccgcctcggcctcccaaagtgctgggattacaggcatgagccactgcacccggccctaaatgtgtttttaaaagatgatattttttcctcaaaatctgaacaatgttttttgcagaaatagaaaaatccattcggaatctcaaggagccctcctgaatagacaaaacaatcttgaaaaagaacaaagttggaagtctcatttgttgattttcaaaacttactgaaatgctataataatcaaaactgtgtggtattgacttaaagggagacatatagatcaaggaacggaatggaaagcccagaaataaactcttttatacatggtaagatgattttagacaacggtaccaggaccattcaatgggaaaggatggtgttttcaataaatgatgaggggaaaactggatatccacataaaaaagttggatcctgctgggaacagtggtttatgccaataatcccagcgctttgggaggccaagtgagaggattgcttgaggcaaggagttcaagaccagcctaggcactataggaagacctcatctcttaaaagaaaaaaaaattggccaggtgcggtggctcacacctgtaatcccaacactttgggagtcccaggagggcagatcatgaggtcaggagatcgagaccatcctggctaacatggtgaaaccccgtctctactaaaaaatacaaaaaattagccgggcatggtggcaggcgcctgtagtcccagctactcaggaggctgaggcaggagaatggcatgaacctaggaggcagagcttacataagccaagattgcgccactgcacttcagcctgggcaacagagcaagactctgtctcaaaaaaaaaaaaaaaaaaaaaaaaaaaaaaaaaaaaaggtagtgtgggcctgtagtcccagctactc

SEQ ID NO: 105651 - DNA, 1110 bp, Homo sapiens
ctcctgcctcagcctcctgagtagctgggactacaggcgcccgccaccacgcccagctaattttttgtatttttagtagaggcggggtttcaccatgttagccaggatggtctcgatctcctgacctcatgatccggccaccttagcctcccaaagtgctgggattacaggcgtgagccaccgcgcccagcccacttatgatttttgatagttattgtaaactctcttttatccagaattataaaagttaagaagttcaaatgactactgatatttaatgtcatttggtgagaaagtcacttgacagaaaggtgtgaagaagttattccaaaaggaggtttccatggtatatcaattgttgttagatgctttctaatactacatttattaatttctaacactacatttagtttagtgcagttaaaattcacattcaaagtcttcctaaagtgcctcctgaattatcagataaaatttactacattcagtaacatttaatttgataactttgttatttgataacccagtatgcagtatctgggaagaattcaacaaaatgcgcagttccctagccattctgggttagtgtttgtttacagtagggttgcaagtacaatatgttgactgaattaagacattaaaaatattttatatctaagtaatttgcatagcataaggaactttttaagcttggcagacattttagttaagaacacttaatttaatgtttttagatttcctttttattaaaacagctcagtaatctgttctcaggtttaaagcacagattttaaatactataaggaataattgaccattaactttcttatacataccctaggtttaaagcttttggtaattgaagcaattcttgaattttgttattgtcctcatccctgatgcgaagtgaaacctggcttcatttggattcttcctccttattgacttgataatatggtgggaggctagagggtgttctaggcaaagacacaggactggtccagcaggcacagaatgttagtttcattcctaaatcatgtgtaatactgtattatcctcaattttatgttgatgccgtttccattacagtgaaggtttaacaagacttaa

SEQ ID NO: 105652 - DNA, 1018 bp, Homo sapiens
atgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctccaccttactaaaatctaaataatgatagatattttaagtttttaaattgagtagttctgagtaatcctagaatatttttccaaattaaataatcctttattatttgcaagttgggccaaatttttttttttttggagacggactcttaacaatctaagattgtttcaacaggactttcttattcccattcctaattttttcaaactaattgcttaaatctagaaccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgac

SEQ ID NO: 105653 - DNA, 1029 bp, Homo sapiens
tgtttatattcacttttttatacttttatgtctctttttgaactaaatacctaaaactgattgttgagttgagtattgcagaatttgataggctgccaaattgtctcataaaaaggttattcctatttacattcccccaaatgatgtaatgaaattacccttgtcaatgctggttatcaaattttaaaaggttttatcactgtaatagctgctcttataccactcgctggatatcagtttttgtaatttccattttcttataatatgcattctttaatgaagcaagtttttaaaaatatgcattctttcttgagcgaggaagaataaatcttataagcttattgtgtgaatgtgaaagggaatttacttatgccaaatgtgggatggagcatatttatggcatctctctggataagtaaaatgcagtttgtgaagacttagcagggtatatgttacatagcggctatttaatagaattctgttgtctttccttccttatttctttcttttatttaaattatattctggttttggactgccttgttcttttagattgttctctttggctgttcctcttaagtaacagaatgaatgatcttttcaacaagaagcttgtgtgaaagatttctgccttgtatttatgaggactaaggggttggacagcatgtttgtggtcttccaaagtaaaatcttgcattttttattttagtagcatatattgtagatattcacttattgtcttaggaataatatctctgaattcttcggtcagcaaggtgactgcagagctaggctggttgctaaaatgttagatatagtcagagactttcagaaaaagttgtacatccccaaattgatctatatagtcaatccccaaattgatctatatagtcttatatgcaattgcatataagatcccatcaagaattttagtataaatcaaaaactgattctaaaatttatatggaaaagcaaagaaacaaaacaaggccaggcgcagtgactcacacctgtaataccaacactttg

SEQ ID NO: 105654 - DNA, 1044 bp, Homo sapiens
tctccatctcttgaccttgtgatccgctcgcctcagcctcgcaaagtgctgggattacaggcatgagccaccacgcccagccaataattttttttaaattgtgtgtttgaatttcccattttagccttcacttaatggatgagttggctgtaaaaatctagcttcaaaatagtttttctcagttttaaaggcatcacttcattttttaaaaaaaatcatttagtgttacaattagaaataagcccatctgtttcttgtaagttggtaagtactgctgaggggaatttccctccctcccttcttgccaccttgccgaggctgtattcaaattcctgggctcaaatgatcctcccacctcatcatcttctttttgcttttcttttttccttcttttgtccctgtctctctactctctccattgtctgttcgttttcttcatctgcctctgtgatcatgaaaatattcgccatgttattgtttaccgttcacatttagggctgccatccacctggaattactttttgtatatactgtgaggtagagctcaaaatatccagttgacccagcaccacttattgaaaagacagttaattcccccactattttgcagtgtcacatttgtcagatattaagtatccatatgcatgtggttccgtttcaaaaccatttttttgcattggcctcttgttttgttttgttttgtttttccatatgttcagcacaccaagtacattggcctctttcttggtgattgtgcaggtaccacaatgttttcattactatatttatgtatttttagtttcaaacatatgacattgccataggttagaaactcatcagttttcagcattttcacatggttcaatccatcagtaagttttgatatccagtagtttaagttcctctaagtttgttctcaaagattatcttagctgttcttgactttttaaattactatgtaaaacttaggatcaacttttcagtttgatttgaaaagaaaaaacctactggactttgcttggggttatgttaaatctatagatt

SEQ ID NO: 105655 - DNA, 1030 bp, Homo sapiens
tgtgaaaaccagtgctaagaaaataacaaaatgaacgaacaccaaaacacccatgtgtttacaaggaaacaagaaaacatggagttaaagtaagtaattgtgtctacttgacagatgttgggttttctttccctcttggactattgtgtttcctcaatttgtaggtttcatgtcatctttttaaaatagtagccgtcttttgactccttataagttatgttgggccaggccaccttaccacatgaattccctccccactttgcttggtatttgataccctgctttcagccaccatggcttcctccccacccctaaacgaagactctgattttgctctgcttgctctaccctacctgatggctttaggctaaattgtttatgctgaccggagtcagattttatttttagagagataattctggtgaccatatggagaactgggtgagagactgtcagtgttcagttgagtctagtgcagaatctaggtgaggggtttgaaccaaagtacatggggatggataaggaagactaagcactctacagacgatgatgataatatgataaattatataggttataatttactgaacacttgccatccctcataacaacttcatgattgaaggccttaacatttttatttatttatttatttatttatttatttatttatttttgagacggagtctcactctgttgcccaggctggagtgcagtggtgtggtctcggcttactgcaagctccgcctcctgggttcacgccattctcctgcctcagcctcccgagtagctgggactacaggcgcctgccaccacgcccggctcattttttgtatttttagtagagacggggtttaaccgtgttaaccaggatggtctcgatctcctgacctcgtgatccacccgcctcagcctcccaaagtgctgggattacaggcgtgagccaccgcgcccggctaacatttttattttatagatgagtaaacagtcatggagagattacataccttgcccaaatttacctagctca

SEQ ID NO: 105656 - DNA, 1004 bp, Homo sapiens
tgattctcctgcatcagcctcccgagtagctgggattataggcgcatgtcaccatgcctggctaatgtttatgtttttagtagccaggctggtctcgaactcctgacctcaagcgatccacctgcctgggcctcccaaaatgctagggttacagacgtgagccactgctcctggcctcattaatttatttatttttattttttatttttttgagaccaagtctaactctgttgcctaggctggagtgaagtggcgcgatcttggctcgctgcaacctctgcctcctgggttcaagcaattctcctgctttagcctcccgagtatctgggactacaggtacgcaccaccacaccctgctaatggggtttcaccacattagcccagccagtctcgagctcctgacctctagtgatctacctgccttggcctcccaaagtgctggagttacaggtgtgagcgactgcacccggctacttttttcatgaatttagaagtatttatcgtaatgattggctatgttcattgttaattctgtgttcagattttttctcttttctttttttcttgagatgggtctcagtccattgcccaggctctggagtgtggtttggcatcatggctcattgcagccttgaccttctggtttcaggtgatcctcccaacttcagccttatgggtatctgggactgcaggcgtgtgccaccacacctggctgattttttttggtattttttttgtagagacagggtttcactatgttgcccaggctggtctcgaactcctgagctcgagcgatctgcccatcttggcctcccagagttctgggattacagctgtgagccaccgtgcctggccctcagatttcttcttgagtaaactcaagcttacttattttcctttccctcttattcactaagttacagagacatgggggtaacaaaccatttgcagttaaagggcagtatctgacccatttgtttgttatatttttgtctgccctttat

SEQ ID NO: 105657 - DNA, 1026 bp, Homo sapiens
tttttagtaaagatggggtttcaccatgttggccaggctggtcttgaactcctgacctcagatgatccacctacctcggcctcccagagtgttgggattacaggcatgagccatcacgcctggccttacgggtattttaatcaaggaacaaaagtctagtgagtctccctttccccagtgtaaaaacacatacagtgctggaggatgtcttaacacattttcctactctgtctcacttgttttttaagtagtctcttcaaatatttgtcattccagcatccctttgttaaaattttcaaatttacaaatacatttatattacctattaaaaagtcattttccattgtttgctgacagtgaaggaagcacctggattttcttatatataggcggcttagctttagtcagagagtagattcttcctaatctcatagtgtcttgttcttcctaatctcatagtgtcttgttctttcctaatcttgtttctgaatttggtgatcaatcctttggctctgtaaacttttgctcttgacagtttttggaatcactttgcttttttttttttttttttttaaagattaagcgtgagtagttgctatgtagcttttagatttccttaagatgtgagaaaatctgagaggaacattttgacccagtggaaggcatcttggcagttcatgtatatagtcaatttgaaaaggaaaccaagtaagtatcagtgatttcactttgtctttctaaacagcacttttagaaccaggttattgtagacttattgctaggagtgagtgggttgagaacaattaaggttaagaagggggattgtagggctgggtggctcatgcctgtaattccagcactttgggagcctgaggcggaggattgcttgaggccagaagtttgataccagcctggataacatagtgagaccctgtctccattaaaaaaaaaacaaaaacaacttagtcggtccccagataattttagtgtacagcaaaacaacaaaaacaacaacaacaaacttag

SEQ ID NO: 105658 - DNA, 2243 bp, Homo sapiens
ccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggtaggtgcagccgcaggcggggtccgattggaggggcggcctcctcactgtcccggggctgcccgagccttgccctgcggcagctgggtaccccacggggcccgcccgaggcgtggaagggcggtggccgccggcctgcgagacgcgggggcgtccgagggagggggccaggcggggggctggcggctttgaccttcggagtctttgaggcgcgatctaggggggtctttggagtgaggggggctgagaggtccagcttttgagggtcggggcggtggggccgagcgacatgccttgggctctggatggggctgagccgcggagcgagggtcggccgcagtctggggccctgggtggggttcggaggtgtaggagaactcaggggtcgttttctgaggctttgtgggggtcagttgatgtgaggctgaggtgagccttagtatgtccagtcagggattatgggtggggctgaggggtggtctggagaaccgggccctaggcggggctcttcccccttgcaaaggccccgacactgtgtggggactaaagcgtgtgtctggcagtgggagtgcgaaagggtcacattagggtgggggtggggagggtacagggactaggagaggcagttggaaacattacccagaacagagattgtgatttagcacatggaacaagttctccgccggtgtgagttagatccctttggtgaaattgtcctgtggaggagttgtgagggttttgctcacttccaggaacgggtaaattaaatgcatttgctgctttggggaagaggcagtgattgattacctttaggtttgtgctttaggacccaagctcggatgaaatacgtgttcctcgcgaaggttagtgttacccagctttctactggaaacccccttttctcctttgccttctctggtcctgttacagtattgctccccagggcctctcgattctctctccctggttgcatagcattgcagtgtttcttgcagtgtgtgtgtgtgtgtgtgtgtgtgtgtgtgtgcgcgtgcgtgtgtgtgcgcgtgcgtgtgtatgtgtgtgtgcgcgcgcgcgcgtctcccgcccatttccctgctgctgtgcttttggcaactgcctctgctctttcccagggatggttgtggcattgcatcaggggatatttgtgcttgtaatttgctcactcagcccaggaggagggtgaatagtatgctgtagagatggggggcgggggcagggtgccgtcagcttggctgggtagacagagaaatgggtgtggtgagggaatacagctgctctaggcctttggggtaacactgcccagtcatcagcccaaagagattcaaagagcaccaccagcagctatttttataaatcaatcctgaatccaagctgagcacatggatttagagtgaacagttgtcatgctctattacaagctgggtgtttggtagacaacattaaagttgctaagcaggagactcccatctgtactgtgcagtgtgtactttacttgcaacttttaaactttgcttttctcaactccaaagattgggacatctctcttcaggctgtgtcttttaaattaacgtagtttgctgatccgtactactacttttcaaatgaaatgttttcacctcagttacacacttcctttcaaatttagcttcaaaataataaagctgtcactttttgagcacttgccatctcccaggcactagctatgtttgttaacagatgaggaaattgagactgatgggaagaagaggtcacacagatagttaagtggcaaaaatggtatccaaccaaaccaaggtctctccaacccccacatagtagttcagaaacttcagaattttggtttacattgggatgattcaagtgcttgagaatttattcatgcaaagtaaacaaactcaccagagactgataaaccagataccagttaatgcatgttggaagtattaagtgccatgtgcacaattggatttaatt

SEQ ID NO: 105659 - DNA, 1049 bp, Homo sapiens
gtggaggttgcagtgagcccagatcgtgccattgcactgtggcctgggtaacagagcgagactatgtctcaacaaaaaataataataataaaaaaagtcagtgctgggtgcataggatactgagtaactattccttttcatggcttggttgtgaatttcttggatctccctctgtgaccttgggcaagttgtgtagctcctctgagccttcagttccttatctgtcaaaggagaacaaattccaacctcattgtgagaactcaagggggtgatgtgtgtaaaactttcaatacgaagttctcatgagttctcccagaagccattgctcttcctctttccctaagcagcctgaggtaatctgtgaaaatggttcactattcacttgacccagagaaccccgcaaaatcatgcaaatcaagaggttccaatcttcgtgttcactttaagaacactcgtgaaactgcccaggccatcatggatatgcatgtacgaaaagccacgaagtatctgaaagatgtcactttacagaaacagtgcgtaccattccgacattacaacggtagagttggcaggtgtacccaggccaagcagtggggctggacacaaaattggtgtcccaaaaagagtgctgaatttttgctgcacatgcttaaaaatgcagagagtaatgctgaatttaaaggtttcgatgtagattctctggtcatttgaggatatccaagtgaacaaagcatctaagatgcgctgccggacctacagagctcatggtcggattaacctatacatgagctctccctgccacatcaagatggtccttactgaaaaggaacagattgttcctaaaccagaagaggaggttgcccagaagaaaaagatatcccagaagaaactgaagaaacaaaaacttatggcatggaagtaaattcagcattaaaatacatgcaattaaaaggggaaaaaaaacctttgaattttccctagaactcaataaggctcagagaaagggaaggtgtagaggtgagctgagtgcctggtgctcagaccccagg

SEQ ID NO: 105660 - DNA, 1035 bp, Homo sapiens
gtaatgctagctaagctggtataatctgaaggccatcccacctttctctttaggcagtcaaccaacagaatctctttcttacaaacaatatcattaaccagttggaatctgtctcaatgcgcgtgtaggaagaagtcctctcccccacatttttcccaacaagattgttttatagccaaatgtaactcaaacccgtaacacagcaactagccatctccagtatcactgattcccaccccaagaagttgaggtaagaggggagagactgtctcctgtttaagaaaaacccacctacacctcagtgaagccgtgatggtaaggaggctggcaccagagggcagggatgagtaggcactgaaacaggtctctctagaatcaatgaagtctgccccagctccttggatgaggtgttcttttgaaattcccacttttatggagttagataaggggacaaccggtgatgattcatcactccctgtctctaaaattaaaacatgataaacccagaaagttttaccttcaaaatccaccaagctccctcctgagaaaattctatccagtcatgtccatgccagcacccactcccttctcctaatgcccagggcttccagcccctctcctcacccttgggtggtccatccaacactgatttgatactctttgactcataatatgaccattttttaaaaattagaaaataaaagctatcaatatcacagcaacataaggaagatactcagtggacatgctcctcccccatcctgtggagcccacctacccccaccccccttccctgggaaacctacactgcaacattccagcactgagccgggggtggcccaacagatgctgcctcaagtgctttcctgactgtggctcctataccagccaatgtcatggaactggggtgaggaagaacagggccacacctcccaccaaatagatatcggtagccagtggtgggtctgggagatttagcttatgtcaggcagccaagcctgggtccaacgctctcaccaggacctcagttcttgg

SEQ ID NO: 105661 - DNA, 1117 bp, Homo sapiens
gggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttg

SEQ ID NO: 105662 - DNA, 1050 bp, Homo sapiens
ttgcctgtgaatagttgtcaaaattttccatctaggtccatctgtttcagggcttcatattttccacctcttcctaccaactggagataattttttctacttataattattctattctatactaaaagcaatgaaaaaaaaaaaagccctactggtttactcaacgtggacgattcttacaagcataatgttttttaaagccagatatgatagaatacatatcgtatgattccactttatggaatgaaaacactcacaggtcccttgccctaaaatattcacttaagaactcataattaagtattaaaagcagtaatggctagcactggcgtgggtggctgagttccccgttgcccttggtctcggggtcgcggtcggcactgaggctgcagctatcatggtgaacttacttcagattgtgcgggaccactgggttcatgttcttgtccctatgggatttgtcactggatgttatttagacagaaagagtgatgaacggctaactaccttccggaacaagagcatgttatttaaaagggtattgcgacccaataaagaagttacctggaagtaaagactggctgaattatagaatgttcacattttaaagttctgagagaaataaaaccatgaagaatcaaaaaaaaaaaaaaagcagtaatggctaatattacagtgatttctatgccaacacagtactaagtactttctgtgcattaactttttaaccatcaaatacaacctgattgtcccgattttacaggtgagaaaactagaccttgcaggttaaggaatgtgcccaaaatattgaagtaaaacaggacaactccagagtgagagctctttaaccaccatctatgctgttttccctttaaaacaaagctccaggcaagcaaccctgagaagctatttcgggggaaaaccaggcatcagtacagctttgccctggtaaaaagcactagaggctgatacactgttccaagcactcaaggctggaactcatttccatattctttctcatgacacttcccaggttgataaagaaatcat

SEQ ID NO: 105663 - DNA, 1863 bp, Homo sapiens
tgcctcagcctcccaaagtattggaatcacaggtgtgagccactgtgcctggtcagtagttgtatttttcaagcctcatatgatttgacaaggtaaaacgtttaaaaactatgccaagaaaatctggtacctattgtttctatggttggaactcacagaaagttatctgggtcacctctatctgaataaccaaacaatcatgatatgaatcagttttattcaccctcttctcaaatcctatttcccttgatgttatttgcaaataggagaaaaaacagtaaatacgctatgaaaatattaagacttgtacaaacatgacatttttgacaatctaatagacgtaacatcaattctggcaaaagtacaagccatgaatatttgttgcctgacttaaataaagacccaggtactttgtttagtgttttaattttaatgacaaaatggtgttttttgtattatttcttgagaggttttttttttccccataggtttctgtctagattctcctgggccattggacagtaaagaaaagtatgtattcactgctttcaaatgtttatatgtagaaaaaacgtgtctaaacttaaataccttatttaaatgaagttcttcatacactggactggagccctggatttacctgtgcctagaaacactctggaatctcaagaatgaatagtttgtgtcagcaattttcagaactttttctcctttattttagctataattttggtgttctgtttgggtcttacccaaacccttactctgtgctctgacatcatagccttacaagaacatgtggggtttttttgtttgtttgtttgtttgtttctgaggcagagtctcactctgccgcccaggctagagtgcagtggctcactgcaacctccacctcccaggttcaactgattctcctgcctcagcctcccgagtagctgggactacaggagtgcaccaccacacccggttaatttttgtatttttagtagacacgaggtttcatcgtgttggccaggccaggagttcgagactcctgacctcgtgatataccctcctcggcctcccatagtgcccatagtgctgggattacatgtgtgagccaccgcgcccagccgaatgtgtgtattttaagaaaagacatgggtttgttttttttcacctagaagtctagtgttgggggtgctcctgagaacaggacagcttcagaaatttattctcccatctcttgcctaaaatgggagtctgtgactgtacccccaagctacaggctaaacactatctctctgctaatatgaatacctctttacttgttttattctcattatttaccttctgatctcattacagccttgaaaatcctatgagaagaatacattccctacctgtaagttagttccttgtttattttgagctaatacctgttatctgttccttagctaccagcatgaccttgataggagacttaatttagagagtaaaaactgcttttctttagtctcttttgagacaaggtcttgctctgtcacccaggctggagtgcagtggcaaaatcttggctcactgcaacctctgcttccctggctcaagtgatcctcccacctcaacttccagaggagctgggactatatataggtgcacaccatcacacccggctgatttttgtattttttgtagacatgggggtctcactctgttgcccaggctggtttcaaactcctgcctcggcctcccaaagtgctaggattataggcaagagccactattcccagcctttccttagtctcataagtactcaagatgttcggtctggaggaatttgtcctccatctctaacagagctttattaaaccaggaagggttctt

SEQ ID NO: 105664 - DNA, 1009 bp, Homo sapiens
cttctgctctgggctccgcccccttctgagagccgatgacctggcagagtcccgcgagccgctttcttcttcccctctcattggcccagcctagctgccattcggttgagaggaggagaagttgcttactgattggtggattccgtttggcgccaactaggaaaggggggcggggcagcagctggccccactgagccgctattaccgcgaaaggccggcctggctgcgacagcctgggtaagaggtgtaggtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcaggtaaggagagaccggcgggcggtgctccgggcccctggcctcggtgtcggcctcggagagatcaggccaggaaacggaccgggagaagggcgagacccgtccgtccgggttcgccgctcggggacagccgggctagggcctgccatgtgcacccccgcccgggcggaatgttgggcggga

SEQ ID NO: 105665 - DNA, 1028 bp, Homo sapiens
tgaagcctgaaaagtttcccctaaatgtggcagcataaaggattcaggagaacactgacttttattgaggaagacaggtcaaatgttgtttggagtcactgcattttttaggcaagtcaattagacaagcttctttttttttttttttgagacagaatgtcgcccaggctggagtgcaatggcacgatctcggctcactgcaccctctgcctcccaggttcaagcaattctcctgcctcagcctctgagtagctgggattacaggcatgcaccaccatgcctggctaattgttgtatttttagtagagatggggtttcaccatgttggtcaggctggtctcgaattcctgaccttgtgatccgcctgcctcggcctcccaaagtgctgggattataggcgtgagccaccgtgcccggcctggcaagcttcttcttgaagaaggatgaacagttctcagcaaagaggagtcatcattcttctgaaccaccataaacattccagagaagaggtagatagaaggctagatcctggaggatgtgctgtggtgagctaggccctcaggcaggtggtggtgcccagcagaaatggcactgtaagccaggcttccctggtcctaggagaatgttttagactagatgtctaggagaagtctgggcactaccactggtcttcatagacctgcatcaggctggtcctaggcctcctgttccagctacatagtggacacctccctctgggctatagcacacagggccacagcgcaactggggctcttcctcctcataccagcgctgttcactgaagtcagggaagaaggctgcaatctctctgctggctgaaaccacagagtctgtaaggggagataagacagagaaggggttctcacatggtagaagcaagaggcagtcataatcaggttcagaatcctgagcctctactctgcctgccccttcagtcctggggcatgtaaagaaagtccacaggccacatctgccaacatggctacaaagaccagaaacacaaatgg

SEQ ID NO: 105666 - DNA, 1027 bp, Homo sapiens
gtgttactcaaagcttctaacatgtgatgggtgcagagactaaaccacatactaagttgaaagcaaaagaaagttgttttggaaaataatatccattttaggaccaataaactattagctgggaagattcttcacccagcttcctcttcctcttctttttgttctttgtttctgttctttggcctgagggggcatgaggatgaccttcatgtagggtcacatgatctacatgctatggctgcttgtttctgagtgcctccacttgaggcttgtccaggtcacacacagtgccctcaccttagtggatttctgtttctgcattgtctgaataggatcacatgtaccttttgaggtcacagaaaggaatggaagaaagggaggaacaaatactggaggaatgtctggagagaaggtctcattggatgatgtaggaagtgggctgaggtcatcaccctcttttgaccactcttaacctcttgacttgaaagaaagggagaacaaaattaggacttacagaattttggagcacagatggcagtcactactgtaggtaacctggtcactgccacaaataggttcactgggcttgatgtaggataaaaaccagcacttatttacattcttgaggcattcaacctgaaggtgagacacacacaactgcttcagacactttcatccaggtcctttggccgttattatgtatagcttgggaggtggatggaatacgagcaccagatcaggagttcagagaaaaggattcagaagcctcagtgtttgaccccaacagttaccacccacaatatgtatataattgcaaaataatatataatctgtgcactctccagactcccataaattctttattaagataaaaataccggccgggcgcggtggctcatgcctgtaatcccagcactttgggagtccgaggtgggtggatcacgaggtcaggagatcgagaccacggtaaaccccatctctactaaaaatacaaaaaattagccgggcgtggtggtgggcgcctgta

SEQ ID NO: 105667 - DNA, 1052 bp, Homo sapiens
caaattcgtggttcgtgtttgatcagtgtctgttttcccaccacgtgtctggtcattcttgggtctctgccccttgtctggcaccgggcagacaggaacttgggaaatactgttggctggcgggtgggttagccaggatggctgcagcagggcttctgaggagctcgctactgagtcaggtccttcatttcctaccttattcatcctggaaccccgcggtgactttgatgttattacccctcccgccagcgaggccctgaggtcccagaaagtacgtgaagtgaccggctgggtttcttggcctcctaccccactcatgccacagcgtcttaggagggctgttgaattttgcagcaaacacgttggccaaagaagtctcccctgatggcattggtctctgtttcagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggt

SEQ ID NO: 105668 - DNA, 1047 bp, Homo sapiens
gcctcactctggcaggcacttctctctgggtttgctttccccttagttacgcacaagggttcctgtgggaaacccccattcaggcctgctgaacccctcccctgtcggataggtgggaatatttgctcccgatggtgggaatgcaggcttcccgaaactccgtcagcctgacccattcagccaggaacctggggatctgagtgatgagggacttgtgctcactcatttttttctgccatttaccccatagtggtttacaagtgcactgcgctaggtgctggggtcacaatggggaggaagctgctgtccctggggaaggcaggcaggtgaagagacgagaattagggattgtgtggtgcgtggggattggaggcagcagtttctcatgagttgtctctgcccttggcctgtgtcttggtcatcctgagtgcacatgaaccctgatggctcctgtgtgtcctgcacagaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttggtgagggcgtggagagcccctggggacctgagccactgttgggcctgggctggccccggaccaactctgcagggacaactcatcactcagggtggggaggatgctgggaggcaggcagaagctggctttggaacatctttcttggacagcctctcatctggggagggggtccctgctcttggtctttggagaggttgagtaaggctgccccatgatggaggggctggtgtccctgtggaggaggagatgggctccactatgggaagggtatcttccagccctgcacccagttctgccttgcccttgcagagtggcggtctggggtggccgggcacctcattctttctgacgaggatgtcacttctgaggtccagggtctgtggaggcgcctgaacacactgcagcattaca

SEQ ID NO: 105669 - DNA, 1775 bp, Homo sapiens
ggtcgtgggatctggctggactgggaagggacagaccgggccaggagtcaggaaacattctctgtaaatggccagagagtaaatattttcgctttgcaggccaagtggtctctgttcaacaactcagctttgccactgtggcacaaaggcagccagggacgacatggaaacacatgaaagtggctgtgttctaacaaatctttataaaaataggttgtgggatggatttggcctggttgtggttggctgatctctaggctaaactgtgctgggctagacggggcatgggtgtgtgtgacttgcttgggacgggacaggctgaatcgtactgggctaggcttgagcttggctggcatggctgcattggactgtgctggatgaggccggggtgtgcctggggattgtcaggcaggcctgggcgagtaggactcatctggccatcctctcctgaccctggggctgagcaggaggaagagcaagcaggccctgagggactataagaaggttcagatccagctggagaatctggagagcagtgtgcgggaccgctgcaagaaggaattcacaggtgtggctgggagaatgggccccgccctccagaactctgcccaaacccactcccatcacacgggattggtgcttaacaggtgcttaacctggcctcttctgcttaacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaaggtacccccagctgcatcttcctggcctgcccctggccctgccccttctccagggcatggtttctgagcccgcccctctgtccccctaaaccccttttcccatcccttctctttggctgcagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggtctgtgtggctgttggggctgggtgggccctggacagctggagctggggtggggcctcgggctggggggtctgcaggatagagaggcccgcagccccacctgctgaccctggcactcccctttcccatcatctcaggacagagactgtggtggagaagctgctcaccaactggatgtccatctgtctgtataccttcgtgagggtgagggggcagaggtggacagggctcctgtccagggagggtcaggccctccaaacttctaagccctcagccaccatgcagctcggacacttgtgccagagcagagactcctgctcagcctgtcctcagtccccttaagcccatgtcctgtccccttccccagtgtgcgtcatgtcccatacacctctgccacctgctggggggccctaactgcctgtgctctcctaggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgg

SEQ ID NO: 105670 - DNA, 2143 bp, Homo sapiens
gagcccacaggaagtactggcccctgccccagagtctggagggaacagattgctagggacccagcctggtttaagctatccctgtgacccctgggccaggagagatgacctgagctcctctccccaggactgggtggtgtttacctgtgactttcctccatccccgctaggccagttggtatgacctgtgactgcctaggaggaaattctatttgtaaattacttcgattgggtggaggaggggagggctttgggcctctggccatggacttgggtcccagaccctgtggtctctgatcccaggtctacttgggcccagggagcgatggccacccatactccacacagagcatccagcaggggtctgcagtgagcagagacctcacctttgatgggacctttgagcacctgtatgtcatgacccagagcacagtgagtgccaggcacaagccagggcatgactgctgggaggggcctctgggtggggccagggacccacttgtgggtgagccactggtgtttggattgctggcctcaggtcctctttgctgtcacagcttctgaaggttcctgtggcttcctgtgctcagcacctggactgtgcatcttgccttgctcacagggacccatactgtgggtggtgcgtgctccttggcaggtcagatttctgaccccatcccagccccagcctcaagcccacaatgctcctgcataattgtcctgtccagaattcctgacccttagaccatgactctcaacccctgatccccagacaccccaattcctcacccccatcctctgcactgggcatcagtgccctgccagggcagacacaggagcctctatcatgcccactctagggccctgcccaggtcctccagattgtaggagtccctaccctatgaactcccagtggcccatgagggtcacagatagacactggtcatctcgcccaggtgcagtcgccgttctgagtgctcgaggggccagggcccagagcagtggctatggagcttccagcctgagctgggctgtctgcaagtggcagccatgagtcctgccaacatcagccgagaggagacgagggaggtgaatgatcagataggcagggccctggtggggagggctctgggcatcaaggtctgggtagagatcttggatcctgatgtcggacatgccagataccacatggcctcacacaagtcacttcttttaggagctcagtttccccatctatttctaactcaggccagagggtgtttggggaggcctgagggctgttgattgctggtgcctgcccacattgggtgtcccataaatgtgagccctggtctgctgcccactagccccaacagtgtgtccctggctctcttggcaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccggtgggtgagagaatgggccagcctggtgggggccagcccctgcttcaggggatgcggtggggttaaagtgtgaatccaggcaaagagccatgaatggatgcctttctctgggtcctcccactccccaaccacctgaagcctccattctgtgcccttggactgtattccctcatcctgggtcctcttccccattcaagggctcaggatatcggctctgggtctgagtgcacctccttgctgcttaaccctggccctctctccccctctgcagactacgtatccgtgagcgtggagctcagatttggcgctgttgtgatcgccaaaacttccctctctttctatgactgtgtggcggtcactgaactccgcccatctgcgcagtgagttcctcgccctgtccccaggcctgggcttccctgtggcgacccttgccccatggctgtgctctgtgcaggtgccaggcctgtgtgagcagccgctgggggtgtaactggtgtgtctggcagcacctgtgcacccacaaggcctcgtgtgatgctgggcccatggttgcaagccatcaggtgagtgtgactttgggctgggccataccgggggggttgggggtc

SEQ ID NO: 105671 - DNA, 1102 bp, Homo sapiens
tgtagagggtgtgtacctgggtgcctttacagggtggagtttgagcagagagagggacctcacagggagaaggccatgctgggggcctggctgggccctgccagccacggggctccttcctagctgacctttcccaggcccctcgggtgcctggctctgctgccctccccctcctcatgtgggctctgaggaggcgtcctctgtggaatgtgtttggtggccaggggccaggctgggcccagctccaccagcaggctgggcggtggggagggggtgcttctgtgctgcctccccggtggggagcccagggcttccacgtgcctgcagcccaggccccggcttcacactcggctttcccgcctgctaggtgactcccacacgggtcatgctgttgtctcctgatccagccggccctgccaggtgagcctgacctcacactagatatctaggagcagcatgactcctacctattctgagggctctcggaggtggggggcagcccttcaggccccacccctccgagctggaacctcttcccatctctcaggcctgttggttctgtggttattacccttctggattcctggcctgaaaggccctgcacccaactcttgtcttgattctaacattctgctggttcaggagacctccctctccttccttcttctgcccgggaaaccctcatccatgtagagcctctcctttcttggggtctgggcccctccttcccatcacctgctcttctgccccatccagaccctgcttcctgggcatggcctctcagcccctcaccctctgatctggggggatggtgagtggggtgcaggtctcctgagagaatcgtgcctgcagagaatgggcagtgttgtctaggaagtgtctcctatttctgaccttgttctagtgtgtggtcctggggtcatcctggacatagtgcctatctaagaagcctggtcctcctctgctcaccccctaggttaggaggagcatcttggcaatgccacagtcctatcccttaccagtggccccagggtgctctggcggccacgtgagccccactctctcgacctctcttcctgccaggtgaccatgcctgctctgg

SEQ ID NO: 105672 - DNA, 1253 bp, Homo sapiens
acgaggttcgagaggcccagggaaaggtgacagaggtgaggaggggagctggggtggctggccccgccctctgacttgggaaatgtgccaaaccagtcacgtggtgctgggtagccacatccagacttgtgtttagcctcatttctcacgtggaaacctgggcttgatgcttctggggtgaaggtctccatgtaactgtgccacctactttccccgaaaacagttactgtgtaccagtaagtccctggccactaacatccactctgtgaggccagcaaatacttcctttgtggaccatttggggattgatggtgagagttacgtggggcttgctgcggtactgttactgtgtgtaattacaacatcttttgtgaagatagagggcactaggaaatgtcacagtgtgaggtggaaagagctggtggtggttgtcaagtcctttgtggtggcagaaatgcattctgtcatctctgttcccactcctgcttaggcatgtagtagtgtagcgtggtgggaagaacctggggttcagctgggactttgagacaaacagtgccatctctttccttggagattgtgagcttggctgagctggtgtttctgggtttataaactggaggccacagcagtgcctttcatggcattgttataaggcataaataaggcaacacacgggaaacagcctaccaacacaggtttgatggacacaaattgtgtgcattgttagctgttttcaagttttttcaggggcatgttatttctgcttgaatggctaaatctcgtgattctgatgggtgtggcccaaggctgcactttgagcaccactgggtgagccaggattagtgtctaaggaattccgtttccaccctttgcagctcacaccccagtgacctcttctgggaatgcctcgctgggaatgcagctgagcctgtgtgggtgtggagagaaggtgcagatggcctccggttttctctttgcaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggtaggcacctcaggaggcagccctttcgcacctggacagtgaccctagcctggcagatcatggaggggccgggtgggaaccctgactggtctgtagtcagaggcctgg

SEQ ID NO: 105673 - DNA, 1016 bp, Homo sapiens
gggggacggcaggggagaaagccgagattgcataggagacagtagctgtcatctctgccaggaatgggtgactttgctggggtctaaaaatgggcagctagtagaggaggtgctgggaaaggaggctgagaaggttggaggaagccaagaggggcagtgatgttgggaagagagggtgttgaaagtggtgccagccatggcggacactgcatgctttgtctgatgaaggatacacctgcaggggtgttatgggatctcagcctgtgtgtcatgggtgctggccttgaggcctgggagtctgactgggctgctggggcctggatggtatgcaccctcatgggcatggaacccagccttatgaagggggcccaggggtttgggtgtggcaccagcttgggatcactgtcacagtgaagttcccttctgcggctctcagctcaggcccactttgcccagaagacatgtttctacccaaccagctgtgttttcaaagccgctgagcttctccaaagacagttcttagcacagcatgatggagaggaggctagggtgctgtggggagcctctgtctcatatcaccttccatcaggaagcccctttctattctgtatctggagctccttcagttccttcctgtctgcagctccctctgcttttctctctgtggcgtggtctgttggccaccaggtgtcgctctcacagccaggatcagtgcttagggactttgaggtgtggtttggccagaggagggtgctgttggctcagctttttctgggaaaatgggtcacctggccacctctttggggtcctcagagtcactggcactcttgggctcaggtgaggcctgattctggataacaggagactccctgctgtccaggtaatgagaagcaggcccaaacatcaaagcaagatggaaaagggaaagatgagagaaacctaacccgttgagcaatggcaggttggagaggaaagagaaagcttatggaagtcgtgaagtgtgagactgagagttg

SEQ ID NO: 105674 - DNA, 1042 bp, Homo sapiens
actgcaacctctgcttcctgggttcaagcgattctcatgcctcagcctccccagtagctgggattacaagtgcccgccaccatgtccggaaaatttttgtatttttagtagagacggggtttcgccatgttggccaggctggtctcgaactcctgacctcgtgatccccccgcctcagcctcccaaagtgttgggattacaggcgtgagccaccgcacccagccaaagttgttatttttttaaataacagtgctgagcgctgggatgctacagtgtccagagattaggcagatgagtacattttttgctgggtacgtactatatgtaggtaccaagctgaaattctagtgagtgagacagactataaccaaagcaaataaatgggatacatgttgcaggtcatgtgatatatgcatggaaaaaataaagcagagaaagtgggtcaggagtgctagggtgggagtgggatggccatatctgatagggtgcatggggaagacctcccaaggggctactatttgagcaggacttgaagaaggtgagggagcgagcagcacagatagcagctgtcgtgaaggccctgagctggggacaacttggtgcgttccagcaacttcaagaaggtccatgtgcttggagtggagtgaggaaagggagactagtgggagatgaggtcagagaggaatgagagccagtgggtaggttccctgtaggccatggaaaagacaggcttttaccttgagagaagtggggaaccattgtagaggttgagcagagagacaatggttccacctgtgtttggaaaggaacactgactgctcgactgacaataaattgtaggggctggaatagaagcagggtgacatctgtcaggaggctcttgggataatccaggctagagatgtgatgtgggtcactgggaccatttggtagcagtggcagaggtgagaggaggagggatcctggatttggaaagccaggggcatttgctgatagatggatgtgaggtgggagagaaatgaggaatcaggggtgatgcgag

SEQ ID NO: 105675 - DNA, 1113 bp, Homo sapiens
tccgattctaccctggcaggacaaccctagctcctcgtacctggcgtggcccgaccaatcgtctgccactcagttgacctctgacctgttagtacccgcccctggagcgccgcatccggtagcgagagttcaacttcctgactaggagccaatcagcggggccgcctcgctgtctacgacagagggtggggcagacgctccgtttccggtggcagggtctggggaagcggcggcaggcgccatgtccggccgcgaaggtaagtgttccggaaccgtgaggactgcggggacggcggggtggggaccgggcggcaggggcaggccgaacgtgctcgtgtcgcccacaggtggcaagaagaagccactgaaacagcccaagaagcaggccaaggagatggacgaggtgagggcgggcgcggaggcactggcgggtgcgggggcgctgggagacaggcctgagttgaacacgctctgcctctccccaggaagataaggctttcaagcagaaacaaaaagaggagcagaagaaactcgaggagctaaaagcgaaggccgcggggaaggggcccttgggtaagtgggggccgaatggagctcaagctggccaaacgctatgagcacctattgggatgagggcgcgggcatgtctttttcctgcctcctgaactgcgaggtctcgttttccgacgtccgctgcagcgaatggtctctagccagtctaggatttgcagcggcagtaagggccgggagctggaaacgaggtctcctgcctcccaggcagtctgggcttccattccttaggaagagctgcagaaacggaaacagtgaaatgtatttacctcagacgcagattcacagttaagtttctcaaagtctgacgtcgtccgcaatcttttgccccaaattcgtatttcactgccttctagtgtttgaaccttacttgacttagaagtttttttgttttgttttgttttgtttgagacagagtctcactctgtctcccaggctggagtgcagtggcgtgatcccggctcactgcagcctccaccttccgggttcaagcaattctcctgcctcagcctcccaagtagctgggattacaggcgcctggca

SEQ ID NO: 105676 - DNA, 1177 bp, Homo sapiens
tgcagcctgggcgacagagcaagattccatctcagaaaaaaaaaaaaaaaggacttctttttctgtaaaatgggttgatatggcatgaggattaaataagccaatctgtgaagtatacagaagtgtagatctagaccagtgcacagccagccactgcttgtactccatctcatcctcattttacctttacctagaacagacagtatcagtgaagctgctatccatgcttgtgttaaagtgaatgcccaatacaaaagccaggctttactaaggtccacagcaggcccgtggggcttctaccgtaagaactatatttttccctaattgtgactatttttcttttgcagccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaaggatggcgttcttgtgtggttgtatacctgacagaataccttacatgagtttagtggaagaatttgcacttttttttggtgggggagggggtggagtctcactctcacccaggctggagtgcagtggcatgatctctgctcaatgcaacctccacctcccgggttcaaactattctcctgctttggcctcccaagtagctgtggttacaggcacccgccaccatgcctagctaattttttgtatttttagtagagaggggtttcaccatgttggccaggctggtctcaaactcctgacctcaagtgatctgcctgcttcagcctcccaaagtgctgggattacaggcatgagccactgtgcctgaccagaatttgtgcttttaaaagaaaacccatctttatgttgtcacatccaaattgccgtatattttgatgagacttgttcatctgttcatgtaaggcgtctgctata

SEQ ID NO: 105677 - DNA, 1035 bp, Homo sapiens
gacttcactgccgacgacctggaggagcttgacaccctcgcgtcacaggccctgagccaatgtccggccgcggctcgggacgtgtccagtgagtgctcctcgcggccttttgctcggagggagttgtcaaccgcgccagatccccttgatggctgtggcttcggaacctcgcggccagcactgccttttcgcctttttaaaatatgggaacaccctgatttaagcagcggttgtcttccagaaggtcctttgattttagggggaaatgcattagccaggtcaaacagccgatttgaaacacagaaggctaagttgacattttacgttattttctaaagtttaggccacttggttcttggttctaagcagagatccttggaacacacctaccaccaccatcagaaccatcactacccatgcatggggacccattcttgtgacaagtttgagcggctttagatcttatgaagcccactgtctcccttgggcagtgtgagcatgggaggagccagacacaggcaagagatgaaataaatttattcttttatacaaccagtaaactgtgctaggtgcccaaacgtgaggaactgcagctgaccttacaatgaacaaaatacaaaaactgtccttcatggagcttacattctagttgaggagtgagtgaagtcttgaggactcccagaaagagaaatgttttgagtgcaccttgcatctgtacttgggtgtctcaaggcaccttaaactcaacacgatcatttcctggaaacccagtcctcctccagcacttctagcatggtgccggcaaagcagacattcagagaatgatgaccagatgttccacaaggaagtaactagcacgactctccatccagtggcacaaagcgactcttcccctttccttgactctacatctaatttatttggaaagcatgtcaagcttaccttcttaatccttctctggagtctatcctattcacattgcttctaccagctgcctgatctgtgttaccatgagtcctctcttgaacaatggtc

SEQ ID NO: 105678 - DNA, 1119 bp, Homo sapiens
ctcccaactatcatgaagacaggtgttttatgttacaaataagttaggattcaaagacattaaataaatggtgggctggtatttaattcttttttttattttttaaattttttgtagaggcaagatcttgctattttgcccaggctggtctcgaactcctgggctcaaatgatcctcccgcctcaacctcccaaagtgcttaggattacaggcctgaaccaccacacccggccagggctggtatttaaaccctcacaaactacccttacaatagagtccagtatctttttagagtaccatattgtctttcagaaagaaagctaatgtttaatattttaggacatttatgtcacagcagactttcatatgtatttttcattgtttgtcttttactggcttgtgattttgaagcccagagatatttttgtgtatatgatgggaccactacaagcatgtttcttttgccttccagctccaatcattgcagtctgaactccagtttaaagatgcagagatgaatgaattaaggacaaagctccagaccagtgaacgagcaaataaactggctgctccctctgtttcccatgtcaggtaatgatggtgctggagggatagttcagttttgcattatttagtaaaaaatctgcataacagtgtcaggctggtcctaaatgaaggccatttagacccctccacctgggcagagatcctcttttcctgaaggattcagaggtggtttagatgaagcttgcatggtttgagacatcacagcataaaggcctatactctagaaatgctgcctctgtatggcactttataaacataattcttcaggactagaaagacctggaaaaatgatctccaaattttgggggtgggctagtctctacttttatgtaatttgtttaactgattttgttgcaagcatgggtgtattttagttccagctacttggaatatttttttctcatttgctttctggggacccttgtccaacagccccatcctttgtggtcagatgtgctcaacttgttttttttttcttttttttttgagacagagtctcgctctgtcacccaggctggagtacagtggtacaatctcggctcactgcaacct

SEQ ID NO: 105679 - DNA, 1044 bp, Homo sapiens
agtagagacaggtttcaccatgttggcctggatggtctcaatctcatgacctcgtgatccacccacttcagcctcccaaaatgctgggattacaggcatgagccaccgtgcccagcctctgttttccttttgtagtccagcttttgagtttttataactcagtccagattgaggggatctgctgttttttagagagagacaatctaacatcagtaggttttcagactgctatgtcagtgtatcttataaatcggatacattgaccctcttcttaccatcaacctttcaaatccttggccatcataacacttctgagaaactgtagcccacttacatttttggcatctagcagctaaaggggcagtgtacagtagtgttacaagcgggcagtagagcccagtagcctggatgtgagtcccagtaatgctgttaactggcttatatgatttgggcaagtcctttagtctctgtgcctcagtttccctatatgtaaaacagacctaatgataaatccttgtagggtcactgaggaacaaatgggctgatgcgtatagagctcttaaaacactgtctagcacgtaacaagcaccatgtcaatgttagtggtcactgttttatctaattgcctcattttgagtgaggcaaacagcttgattttcttttcctttccttgtatgagttcctgttttacataaggaaggtaaaagatgcagggctcttgagccgctttggctcttgtttgttccaagttcgaagaagtagaacagcgtgtgttttaaactcattgcatgtaaaagtttctaatatgcccatgcttctgggctcaagttttgatttacattttatcacatttcagatagtaagccccacagtctgagaggtgactccataaaacaagaagaggcccagaaaagctttgttgacagctggagacagagatcaaacactcaaggtaccagaatccctgcttctcctgcaggggcctgcatggctctgagtaatatgcagaagaattgcccaggcctctgagaaccggtgccccgg

SEQ ID NO: 105680 - DNA, 2037 bp, Homo sapiens
ggacagttggcatccaaagaatccttactgtttccttctgaaagccaccgaaaagatctcccatgtcagaaccttctagagtcatcttgtcttctgcaggttccattttgataaacctgctcctgaagcagcctttgatcccagggtcatccctaagcctttgccacctcctgagtagtagttctgagtctcctgctggcacccccctgcagccaccagggtttggcaggtaagcataagactcctggaaagcttgtttgggaaggagcttcctggaagcaaattcctttctggccctggccagcctgagaagtctgtgggaagggcaggcagcctggagaatttggcaggcaggctgtttggggctcttgaccttatctccatcccacacttaatctatttttctttgtgtttgttgccagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggtattaagctgcataggagtcatgattctttgtgggtctcacctgacctcttaaggtctaacccatggcacttgtactttgctcacatcttgacttatctacactagttagttctaaggcttggttcagggagttctgaagtgatgggaagtggggccaaatgggagaaccaaggaagtggtttatttgatttaattctgcctctgaacaacaggtaagcaaaaggcacacatgattaaaggaggctgctaacctctgtggaggagggccctgccccaggacaagggttaagacaaggggcctctgaacctgagatgtgggtaaggtgaagaccacacatcacaagcacgttgaagtttagtggtttccctaaggaagcagaggatgtggagagggtctgcagcccacgggctgaccttgctgggagtctctgcctgtcattgtgcccatctttagcatgcatctggggtggcctgttcttcttaaggtttgtgggtagtatattatagtgaacctagcgaatgaacactgtgatcataaattcctcccttgggattccagagccgcaagattggggagaactgtgaacacaaccagcccaccccctcatccagtaatccagtctccctcagcactctaccaaagggtcagtttctatgttggaatgattccactggctgaatatatcttaaatcatctcatctctgagctcagcactgctgtttcctagatctgtttccatctgaatatttttggttggtctggcccatgctaaaggtggtactcagctggacacagcactgcagtgtagtgtgggcagtgggatcaggcagactcaggactcaagtgcccagcaggggcccagctcatagtggctgtttttttttgttgttgtttatttgtttgtttttgtttttgttttgag

SEQ ID NO: 105681 - DNA, 1128 bp, Homo sapiens
gggcatggtggctcacgcctgtaatcccagcactttaggaagccgaggtgggtggatcacgaggtcaggagatcgagaccatcctggctaacatggtgaaaccccgtctctactaaaaatacaaaaaagtagctgggcgtggtggcaggcacctgtagtcccagctactcgggaggctgaggcaggagaatcgcttgaaccctggaggcggaggttgcagtgagctgagtttgcgccactgcactccagcctgggtgacagagcgagactcagtttcaaaaaaaaaaagttcttaacgctatcaaaaaataacttggaaaccactgtggtgtacataaaagtggattttccttgcagtaccttctgcaagtggcagatattggacatcttacagcccaataatgaaaccaggtaataaccatgttaaaattccagcttcccacaaagggctgcacaccctggcaactaaaaagcattgaactttttgtctgctgtgcaggatttgccctaaagtgagttcaccccacatagtgagaccttgcttcctaaggacacactgagggatatcttgaccttctgtgcttagaaactgcagatgtctgaaggggtacacacctggccagaccccatagagtgtttcagaattgccctcctccccacccaccaggccagtccatcgtgctcccccaggctatgtgggttgagcaaacagcagcagttgccttggggcttggtttattggggtaatagctttccttttgcccctgagacctggggcagtatgcccagaacccctccctcctgcacaccccacagtaggcacattctcccactggcagcagatgtgttttctggcaagtagagaaaatggctttccttgccctgtgagaggtctcataagatccagccatagccaaggccatgtttgtcacctctggaggcctggtcagtccttctgtgggcacagaacatttctctcccacctaagttaggacctgcatccctgtttgggagcatgtggaagccaggcatcccagatccaggaggtcatcccacttcctgggcgatgctacaccagataagggcctgtcctctcagctgcagcagtcttgcagtggaagtgcccac

SEQ ID NO: 105682 - DNA, 1065 bp, Homo sapiens
cgcactgtcagccactgtctgtgcaacatcaccgtgagcgctctgaccacctgagagagggggggtgcagactgaggcctggtgccaccatggcctgcaccctaacaatccgctcagcctagccacctcacgtgagggggtttgcagtggggcctacagtccttgcacggggcccccttaccaccagagctgccagctgttggcccctacccactcacctccacattacactggcagttggagccagtgactgggggcaaggggctctgcacaccaagcttagccaggagccacaccacctagaacaagaacagagtggttccatcctgggcagaaggagaccagtccctgcgagggttttcttaagcttctataagagttcacttgcttcagcaactgtttgtctgcacaaatggggtccaagaagtggtgtgggaccttcccagggaagacccaggacaagcactcatgtgtcaccagcaacccacctgcctccagccccctattctgcccccacgtcccaaagccaagacaggatcagtcatcaggcaactctgccaagtcctgtctgcattgcatctgtgtggtgcacagcccccaaactgagtttacctctttagttgctttatcaactcttgttactaaaatgaattaaagctccgtttctcctcagcggaaagaaaggagattctgttggttcttaggatggggtggggacagtgtccagaaggggctctggagtttttacctcttgttccagctggagccattgtgtctccaaggccactctgtcaggccgtgatgtgatgtacatgtacagcagcagcaggaggcagccttctgaaaaggacagcgcacctctcactcagggtgccctttctcataaagagcgtgggctacatactgcagaagccctctgaggcccttgaccctgttcccaccccaacccttcccttgatctgcaggagcagtctagatgcccgccccaccctgctttacctgagtgggaacagagctgaggtgccagctggtcgtggtccgccagcagggagaggagctcaacag

SEQ ID NO: 105683 - DNA, 1019 bp, Homo sapiens
tgtgaaggtaagcctgccagaggccatcctgcccagcccccatggcttcttccagaggttccccaacaagtcagattcctgggtgtcccctcagcaggcccccgcccactgcagcctgttccagcactggggccattttcttttatcttcctgcctcagttcttctccaagcatattgggatgccttttgcatctatctgttgagtgtgcctggcagagccacggtttttccagaaatagccgtgtctgaattgcctttgtatcactttgtttgcagtagctgagggagcagggcctgggtgtggaagggactggttagttcctgcggacgttgggggaggagaggtgggacctgccctaggccctggcacctttgggccctcaccaggaacctctcctttttgtctcagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggc

SEQ ID NO: 105684 - DNA, 1748 bp, Homo sapiens
tcctcccatgcctctgagggtgggacaagcgggggagacccagggagagacagttacagggactcacatataccccagtttacacaagaggaaacagattgaaacaggtgcaggccacccgacaaggaagtagctataactgtattgcccagaccccttctggcaagaggggcatgccttgggaaggtgtggatgctggtctggggaggggcgaggtgccccgggtcacgtctagctctttggcaggttcggagcgaccttggccgttggcctgaccatctttgtgctgtctgtcgtcactatcatcatctgcttcacctgctcctgctgctgcctttacaagacgtgccgccgaccacgtcgtaagcgtgcccaccctgccccactgtgaccccctggggtggtaagggaagctgaccaggccctgctttggctaagctggagggatgggtggcaagcctggctctcaagacctggggagatggaggagggtcctgactggaattctctttgcagcggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggtgagtgcccctgccaactctagccctgcccgacttcccgagtctctgccagcatccctcgggcacccatcccaaactacatcactcaacaggcctctgcccctttctgcttgcctgccactcacacggcagcccaccatgctcacagccaaccagggtcctctctgctttcaggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgct

SEQ ID NO: 105685 - DNA, 1023 bp, Homo sapiens
ggtgggagaggaggagctaaagggacaggctggactttgctccttgcatgtgtgtcagccagggccccagggtcgccctctgggcctagatggatgcagaagctcctcctggaggctggtggaacagggccggtgggttaggtggaagtgggggtgggggtgctgctgagctagagtgtggttggggcccactgaggctggggtggctcttagaccccctagtggccaggctgcattctgaggtcaggccctgtaggcttggctcagggaggcagctctgggaggcaaatggggcacctctgcttcccctcctccccggcccccgccccttggctccttggctgctagccggctgctgggcggggccatcctgtgtctttaagagggtggaacggggcttcgcgtctgtgcttcctgtggctgacgtcatctggaggagatttgctttctttttctccaaaaggggaggaaattgaaactgagtggcccacgatgggaagaggggaaagcccaggggtacaggaggcctctgggtgaaggcagaggctaacatggggtgagcttgggcgccatgctgcgtgtgtgtttgagagacaaacactgagagatctctggagggatgataacggccttgcggtcgcatgtcattgatggcgtgtgaatgtgtgtgcgtttctccattcctgcctctggttgggccggaagacacctgtagtctgctggtcctgttttagggccttgtcctggacggcctggggctgatggctcctgctttgagagtcctgaggggtgcttttgagcctggagtctttagctctgtccctgggctgtgctgtggggccctgctgaagttgtgcagtcccagggcggggtagggtgggacccacaccctccttgggcctctgttgggcagaggctgctgggggatgccctacagctaacaaagctcctagagtttttggatgtgtttgatgcagttaccaagcatttgccttttgttggaataaagcttgggttgggcat

SEQ ID NO: 105686 - DNA, 1030 bp, Homo sapiens
agagagcaagactctgtctcaaaaaaaaaaaaaaaactttgtggaaatgtaggccaggtgtggtggctaacgcctgtaatcccagcactttgggaggccaaggcgggcagatcacgaggtcaggagttcgagaccagcctggccaatatggtgaaacactgtctctactaaaaatacaaaaattagctgcgcatggtggcgggtgcctgtaatcccagctacccaggagggtgaggcaggagaatcgcttgaacctgggaggcggaggttgcagtgagccaagatcgtgcctctgcactccagcctaggtgacagaggaagactccatctcaaaaacaaaaaaaaattataataaactttgtggcaatgtggttactgatttgtaacttcatcctgttgtggtcagagaagatcctttgtatggtatctgtcttctaaaatctgctgagacttgttttgtggcctaacatatgttctctcctggagacagtctggtggacacctgagaggatgtgtggctttgtgctatgagatcccggtgtgggcagagtccacctctggaaggccattgaagccaccggttcatagtagcttctgtgcacgttttgtggtgccctaaggtagtgtttgtgctggcgctcggtggggcttcattgtgctaatcacaaggtttcctgtttgcagcgtgcctgccagtgtagagccggtggagcagctgggctcggcgctgaggtttcgccctggctacaacgaccccatgtcagggtaagtaaagcctgctggctgggtgcatcttcctggcaaaggtgacaagagggctcaggggggccagtgtgcatctgggggactgggatgattcggtcattggggtggagcccaagaaactgtcaccatatctgaccactaggacacttgctccttatgctgtgaaggtgtcttcattagtgtgctggggtggtggggacgtgggtgactgtggtcgggggttgacaattgaagggccaggggtccggggtacattgacctagat

SEQ ID NO: 105687 - DNA, 1030 bp, Homo sapiens
gaatgtgagcggagtgtggacaggttggagagctggagtgatcttcaggactctgcagtttagaccctgcttggaaactcgggccttgatcctgaagcagtgggaattaggggaggtttgagagcagggtgtggccccatcagactcacattgagaaagttcaccctcctatcaggaggccagtgcactggtgagggagagagggagcccagttagggcagctctgttgtggcccgtgggatagggcaaggctgagggggagcagtggccaggggtcagaaggtggcctgtggctagggtggctcagagacggtgcagcatgtgtgtgtgtgtgtggtctggtggctgtgccagggagggcgctgtgtctgctggggcctggcccgtgggcacaggtgaacagatgtgtttctcctctccagcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccaggtgggtgcaccagtgggtcacagggtgggtggcttgagcctgtgccccacaggagagtatgtggaagagagatagctctgcccctctggcctctcagccctctcaagatggtggccagagcattggagcagagggtttagggatcccctgttctgggctggaccccctagacctgctcagttagtcccctgtccatctcctccctaccctgagggctccagcttgctgagccttgggctgagcaggtttcttagaggtccttggcctcagctggtcctgtgactcaccccgggtgtgtacctgtgccaagatgtcctcagggtgggtacttgggcttgactataccccacagtatgcgcatgcccctgaggggtatcctttgttcagaacccgcttgtggagcctgtagggtgcagtgcgtaagcatgtgccccagtgtgagctctatctg

SEQ ID NO: 105688 - DNA, 1049 bp, Homo sapiens
tgaacctgggaggcagaggttgcagtgagccaagatcgcaccactgccctccagcctgggcaacagagtgagactccgtctcaaaaaaaaaaaaaaaaaaagaaaagtgagctaggtcccataagatgaagctggcagttctgctgccttggtatctgttctagccagctgggaatatagggggctgtattcagatccttccgtgcctctagcctggcatcttctctggctggcacactgacctgtggcacatggatggtggtgggtgggctatcagagggactgtccttgtgggcatcagtctgggtctctggtctcaaccccttgtggtccttaccctgagagacttctagatgcctccctccctgatcctgcccacagttcctgagcaccagcgctgtgccaggccccagggccctaaagggctcagataccacagggcttcttctgctgtaagtgatcagtctagagagaagagtgtcattagtgaggtgaccaggattgagggtgaggggtgttcccggtggccatggagatgccttggggaaaggactcattgaggaagtgactttttagctgggctttgtatgatgaaaagaagttcaccacagggagggcatgcagtggggctatgtgttctgggagcactgagtgatggatggggtgggagagatgtaaaaaggttagggtatggattcctggatgacagaggcagggtgttgattaccctgctgggttttggtcctgtccttcatgcggtggggacccccctagccatgtttagccagtggcaagttcggttgactttatgcctggtggtgcacatcaggatgaaaagggctggagagatcccactgtgtctgccagagcccaggcgggcctggggaagggggacatgccaacggtggcttgaaaccagcatctggggccactccaggagctgtgtggggatgctaggaagccaagaagatacgtctgatgccagtcccatgccctgaggctgagagaccacaggctgagagggaggggtgcgctgggagggtcccagc

SEQ ID NO: 105689 - DNA, 1925 bp, Homo sapiens
ccgggaggtggagcttgcagttagctgagattgcaccactgtgctccagcctgggcaacagagcgagactccgtctcaaaaaaaaaaaaaaaggccaatgcaactggtggcaccacagagccctcctcttgtggaggtgaggaggcaagatccaaggagtcctagggtatacgtttgtaacattatttgcaaatgtccccagctctcaggggacccaagagctaatcacagccctgtaatagctcctctttctgccccctcacttgccaccccctgcagggccagcagccagaaatacttgagggagagctagagggaaaaggcaggccaggtggctttgtgcccaggagtaccagtcttgtccttgatgtaggtggaatgcatcttctcaagtgagaacccacacttggatcacatggcagcccattttgaaactctgaacgcttttgctctcctgggactgaggccatgggagctatttggccctgaggtgcctgtcctgtccacaaggcagggtctgtctgaggaggaccttctttcctcaccctgttctaatgtcacatactcctggtttctcccactaagacaggacatgggggtcctctgcctgtctgtgaatcgccccaccctgtgccttgggccctggctggtcagtaatgccactgtctgtctcagcaggagtggagcaccagcaactgttagacctcgcccagaagcacctcggtggcatcccatggacatatgcagaggacgctgtgcccactcttactccatgccgcttcactggcagtgaggtatgctgccttttgggcaggagtagtgctcagctgggggcctgtgggaggacccccatgtgcatggttatcctggtgactccagagatacctcagcagttgggaaggggttctgtggctgctgcatcacaggcacacatgttcacacacatacaccctctacccacacctgccaccttttctgttcccctggcagtctggctgttcctcagccttgtcatgtactgtttcagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtggtgagtgccagcgcgagcatgggacctcgccttcagggaagagagggtgctggggctgtgtgctcctgtgcgtgggggtcacagtgtgcgttgaagacaagagggtgggtgctgaccacctatccccctggcagcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggtaagtggcagcctggtattcctaggtgggatggcggctttaaccagcacagtgggaggctgagagatgacacactggctcagaatgaataccacccacccccccactttaggatgcgcctgtgtaccagtgccacggagagtgaggtggcccggggcaaaaacatcctcagaaatgccctggtatctcatctagatggtgagtcctacagctcagcggggaggggtagagtacatcttgccagcgacagcaccaaggtggccactgctcctaactaaccaaggttagaaaggaaaactttgaagaccacgccatgccccatcaccccacccttggagatgcaggcaggtgtgagacaggtccacagcccatcactgccataataggtgaccatagaagagagggctgtgatctgagtcagcatgaggtcagggaggtccttgtcaacctgaggctgga

SEQ ID NO: 105690 - DNA, 2528 bp, Homo sapiens
caaaaaagatattataggaacaatatttagtgtgataaaatatacagtctaaaccaatagtcccttccttaatgatgaaaggataaaatcattgccagaacaaaggcagcgtgtaatttttagaaaggaaaaaataagttgttatttgcaaatgatatgttgtatgcttagacaaaaacaaataattaactgaaaattgagagtgaatttaaggatttgtatgctggtgagaccaggtaaatgtgcacagttagaagtgtccctgtgggtccttgatagccaatcaggagagcaatgatgtggtgtgacgagtcattcggctgcccctgttttccaagcatgactgtgtccccaagcacaggggtcctgctggggcagctctccctgactccaggattcataagtccctgcctggggcttgtactgagtcactcaggtggggtgtgagtagggggctggggagtggtttgtttgtaaccttttctggtggcttcttgaccaggtgggagtgtggattgatgttggcagccgttttgagactgagaagaataatggggcaggctactttttggagcatctggctttcaaggtgaggctcttaaagtctgtctcctctgggcttagggctgcctgttgtccctcctgaggatgaaggtcagaaaaattagcctgattatgggcctcagttgcggggctgatgtctggctggctttcctaaaaggagccacatgagcttaacctctcctgagtgggcacgtatctgatgagcccctgcctgaggccctcagagccaagaggacccaaggaaccataggagccccacttttcaccagagaagccaggcctgtggaacacacgtagatatgcacatgcattttaacaaacccacagacatgggcatgcatgcttgcttatgaaatgttcttctctggtggaatatctaggcatcccttggttgtaaagacccatgttttttaaaggaatgaaaaacatggagaaggattatggggtgggcagggccatggagccatagtaggcaacctagccagctgcaatgtcacaggtatgtgtgcagaattaacgtgtgtgtgcacaccaagagatagcaccactgttctccacacacaggactaggattgggtcccacagaggccactagcatgtattcacaaacatacagtcatgggaatggcatgggaggagtgggttctatcacttgaacacaggtgtgggcttacctgaccatggctgtcaataaggaggggggaggtgtactggtaatgatccccacagcttgttggtaagctgttacaggagctttaggcaacacttgctctggccatgcccttcagtcctggccctggctatctctgttctgttggcgcatgatgccatggttttggtcacctcaaggcctgcttagtgcttggtaaacagactctgggatctgtgtccccagagtctatgctgagggaggtacctgtggaccagtggtcctgctgggtgtttagcctctgaggacagggttcttgggttcctgtgtagctcctgattgttctggttgatatctggttccagggaacaaagaatcggcctggcagtgccctggagaaggaggtggagagcatgggggcccatcttaatgcctacagcacccgggagcacacagcttactacatcaaggcgctgtccaaggatctgccgaaaggtaacacctggaggaagaggcggggacagagggcagggaagcagaggacagctacctaggagcccctggctgaccacagaatcatattacccttagcgtatggctttgcagctgggcaactaggggtgggcagcaggagatgccaggcctggggattttgtgctgtcgttggtctgcagtggtccacctggcacctaaacatgtcctccttgcatctagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggtgagagttggctggccttgtggggggatgcttgctccattctggcctggccagaccctttccaggtcacatttttagttggctagctgtcggggttattttcctgagttatgcaactggagacagtttctgtatccatgtggtccagtgagtcttttttaatggctttgtgggcttcacttgaattttgggctttgttttaaggtatgttttggtgcatgtcctgacagtccaagggcgaagtgtctgggtgtcccctccatgtggtctcttgtctcctttgtggatggctccgggagctttgatgctgcccttttgagagtcccacagtgttggctcacgccttctcagagaagactatgagcctgtcctgaagtcaggcatgaggcaagggcagacaag

SEQ ID NO: 105691 - DNA, 1037 bp, Homo sapiens
gtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcggtgaggtggtggcgagagcgcggggcttcgggacagggcttcgggaagcggacaggtgtgggctgttagcagtggcaggtcgaggtggggaggacgcggggtcagggccgtgggaaggtcacggcggagggcggggaaaggtatctcgccgcttgcctaggggcggggttcgggggtcctcctgaggacctgggaggtggggagcgatcccctgaccgagtcctcactcgcggctgttcccttccacagccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgagttggggacgcttttggggagagggcctccaggttgggcctgccgtcttttccctggttggggtgtgaccttgggctcgagtcttcccgtttgtggtttgggttcggacccaggaccactcaccccgagaatggccccattccctaccctagccacgccttggcttcacgggacaatcttcactataagccaacattatttagcatataatgcccgttaagtaggcggccaaattcttttccagccttttgttaaggagcccatataagggaagtgatcatgtctcctcttataatgcggaaaatgggattcagacaccttaggtgacttgcaggggtccaggtctgtcagcctcactgcccaaggtcataatctccaggctagaccagaaatacattttaggaagcaaatgcattttaacagtacaatgaaatgtgtgattttccaaaaaatacaaattctctaaattgacacaagaaatcttgagtcacagata

SEQ ID NO: 105692 - DNA, 1067 bp, Homo sapiens
cacatgtctcatgaggaatgccatggacccagcagctgtgggctcgagggtgttgcgccgatggcaggaggagtggggaggctgggtcagatattcttcagggagcgtcgtgatatgccacagaatctaggcttagattctcaggcctagatgaagaccttgaatttgtagatcccacaagacttcccccagagtctgctcatgggtagaggaaagggatggggtatatgggagaaaatcaaggggtcaaaggcaggcgtggtggtacgcgcctgtagtcccagctcttcgggaggctaaggcgggaaaatcatttgagcccaggagctcggggctgcagtgcgctctaatggtgcctgtgaataaccactgcattcagcctgggcaatgaagcgagaccccgtctctaaaaaaaaaattgaggggtcaaagaggatgccaaacttaattagagactgagacagggcagggtgccgaggtgtctgcatgcgtttcatgtggatgcccgtgtctattctggcctgctcctgggccccctccccactcagccctggctgatgagaatgggacagggactcccttctcgtgtccctgtgcagcgtcggcccaggaggtagcagagcagtatatgcacatctgggtgtgccctcctgcatgtccccacacatctgtcattcctgtctttgcacacctatgtgactcccgcatgtttgtgtccttatgtgtcccatgcatgctccccatctgaccttgcgtgttctcgcgtgtctgtgtgcggccagtcctgccttcactctctcatgggtggccctggcagcatgtctggctccccagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatgtaaggacgggggcaggccaaggcccctcgagcttccacactgaccctgtaat

SEQ ID NO: 105693 - DNA, 1021 bp, Homo sapiens
gtggaacagtgaccagccacttctaggaagtcttctcacacccgtactgtcccccgtcaggagctggtggccctgggcctcagtaaccttatcggaggcatcttccagtgcttccccgtgagttgctctatgtctcggagcctggtacaggagagcaccgggggcaactcgcaggtgggctttgggtgtgggcatgggtgtgggcatgcacattgctttgcctggggaaggaggtctctcccctgctcactccctccccgaacaggttgctggagccatctcttcccttttcatcctcctcatcattgtcaaacttggggaactcttccatgacctgcccaaggtgagcccccacccagccaggtttcaggtcttggccaggccagggctctcaaatcagccagtctaggttcaggcgaggggtggggacacaaggttaggttctgtttttcaaggctgagatcttcaaggtgagatttggagacaagggtcaggggctgggtgggggtttgtgtctggggtactgcctgagtgcttgggcttagtctggctttgcctcggtgaggagggttgtcagcatcgggtgccctcaatggcccctggtggcactgtccccaccccaggcggtcctggcagccatcatcattgtgaacctgaagggcatgctgaggcagctcagcgacatgcgctccctctggaaggccaatcgggcggatctggtgagtgcactgggagcccagggcagggactgggcagccccatggctcctcgccgccctccaaccgctgccctctgttctcagcttatctggctggtgaccttcacggccaccatcttgctgaacctggaccttggcttggtggttgcggtcatcttctccctgctgctcgtggtggtccggacacagatgtgagtccgccatgttggtcccctcattccagctagtgagagagtaccacagggctccccgcagctttccccacatctctggggacttcaggctccttcggacccctctgtt

SEQ ID NO: 105694 - DNA, 1033 bp, Homo sapiens
acgcctcggtttacctctgctgattttctgcaggcggctgcccctctgcagcaaggggtgggggcgggagccggcgcgaccccagtcccttgggctgtgcggaaagccgctggtgtgacgcccgagggccatcccgggccacagggaggcagctgcgtgcggaggagcccggccaggagatgtgccggcgggggtgcgtggggcacgggagtccctggcagcggcccgtggactagctgctttcagctgagtcccgagtccacccagctccactgatcccggagtgagcgctccggcctttctggccccagttgccttcctacagggaggggccaatgatcaaggctccgccctccaaacgcgggtcccaagttgtcgggggagggagccctttaagaagacctgagtgactcacgtaggaaaggagagggggctctacgatctccttgagatagcggtcccaagagtctctgaggatcttccttgcacccactccacactcctccaacagtacagccaggttagaggcgcttcccaggtgagttcctgtccctcaaatgggatcctctccccaggtcagggcttttcctagatcagaactttcctgactggtgaaagcttccccaacaggctagagttttcccccaggtaagatccttctgtgagatctattcccaggtgacagcttttccccattccacgtgggagcctcgcccgaggtcagagctttctctatgggagagtaccccccaggtgagaaccctctccctctaggtcttttcttcccatgtgagatctttctctgacttcaagtaggtgcctctgggcagagggaagattccccctgtatcagaacttgccaggctgataaagattccctggtaggtcagagatccctctaggtgagattccccttgaaagcttctattcccaggtgagctctttcccccacttcaagtgggtacttccctttccatgtgggagcctctccctctaggtgagagattgccactccaagagcaagctccttctc

SEQ ID NO: 105695 - DNA, 1050 bp, Homo sapiens
gagacgggggactggagggagacttttatacgttttgtacctttgtaaccagagagatgcttatgttatttttcagcttttctgtctcctggggggtttgaggctgggctgggagggggagggagatagagggagagatgcagtttgaccccatttgggtcctgagcaaaccctatgctcatctctctctccttcctggggtggactcagatgggtgggacacatgccttcctccccctattccacccccaagttgatctgagtatcgtcaggggcccaaagtacagaattgttctttgctttttattgaatgctccaaaggccaaacttctggggctgggggttggtcttggaaacaggggtcctctgacttcctcatgggggcttgctcataccgcccctcctggtggatgtgtgtgtttattatgtggagtccctgccacttactgccttatgacctaggactgatgctgtggggtgctggtggagcagctgatgtcgtgtttacagagcaaggcttccctgtctcccacggggaggggctcgggcctctagtcagacattcctgcagagggtcggtggaggggtcattcacctgcccctgcagcaagcaaaagttgtctgtggtgccatttgattccctgacactgccccctgcttgaattgattccgaagggtagggtgggaaggtgagcaaagggagcagaaacaagggaattcaagacccagaatgtaggtgccactgcctcctatgtttacaggatcctccgtggccctaggcacctgggctgcaggaagtgactccgttccactcctcctttattcccttaaaaagggaaaaatgactgttacgaccctgttcacaaaactcttacttttgctattttgtctgctgtccagaactgaagactttaaaattttgttactgtttacaagtccagattcaaaaaatgtttttactttgtttacaactcaaaactttgagttttacactttgtttacagtagataattttttttcctttgtttccaagtgaaaggtagggaaagt

SEQ ID NO: 105696 - DNA, 1039 bp, Homo sapiens
atgacctcctgtcctactggccagccctgggggagtgcgaggcagccccctgtgctctgcagacttggggctctgaaaggcgcctggggctggacaccagcaaggatgcagctaacaacaaccagccagacccggccctgaccagtggggatgagacttctctgggccgggcccagcgccagaggaaaggtacagtccctgagccctggcccacaccgcagacacgctgggggctgctcatgccctgagccaagggattgcagcttcctcatcccaaactgagagctcttcttactctgacctagggcgcttctgcttctctagcctgcttcacggtcctcagggactgctcctgtcctgacctgggaattctctgtccccctctaccctggccagcaccacagggggaccacaggcgaccactcctgccccagcccatctgtttttcagagaccctaggagctgcttccccctgccccccacccagatcccagagcccgtgctctgatctggaagatttctgccccctactctgcttttatggggacccggagaagaggtttctgccctcacccttgcatcacagggacctggggactgctcctgtccaacccggggggttcctgcatttcagccaggcctgcattgtcaggacctgagggctgcccctcttctgacctcagggagtttgccccatcccctgcaccatgagacctgcccgccctccccctgccccgggaccacaactggaagatgactgcccttccactctgacccctgtcctgctgcctctctgggaccaccagggttgcctctgctgctccccaaggggttcctgctcccatccctgtgttggaaggatcccaagggctgccacacccctagactcagcaattcctgcctgccctccccctcccacacaaaccctgccccccattttcttcctctcacaggcatcctgaagaaccggttgcaatacccactggtgccacagacccgaggtgcccctgagctgtcctggtgccgtgcagccaccttg

SEQ ID NO: 105697 - DNA, 1045 bp, Homo sapiens
cacctgggctggtgagtcgggatgggggccctgagaagccagagttttaggctgcttcagggttagctcacactctgtccctaccacccccagggacctggggcctacaacaacacggctctctttgaggagagtggcctcatccgcatcactctgggcgcctccaccgtctcctctgtgagcagtgcccgctccggccggacccaggaccaggacagccagcggggccgcagctacctcaggtgagaggaagagcctccttgtgagggaacactcagcttagtccagccccaccttaccagggcttggctgaccaggtcctagggcgggtggctccacccatcttggccatctggggccctgcttctgcctctgccctaaatgcttcccaccacacacacccagggatgccattccacccgcagctggctgtgcactcaaagacactccagcctccaaggcaccccatcacatccctctttcatggtgggggggctcctgcttttccagggacaatgtcctggttcgacatggctcagccgctgaccacactgaccacagcctccaggctcatgctggccccactgacctggacgtggccatgttccatcgagatgctggtggagttggggcctggggcagggaggagggaggcagaggatctctccccatccccttttcttctaccccatactgggagcagtggctgactggggtgggacgatctcccccagggtccctgcctcaggaggcacctacctctccagccctggttctcccagtccactcctgattcgtccttccctctgataagtcccagcccttctgctgctacctccacttcaagccccggttcctgtccccaaccctaacccccttgccgtacccacctctagaccctcaactccaaattcccttatctccaagtcccttacctctgaaagtacttctgactttcccaactccaggcgcagactccgactctgacagtgacctgtccttggaggaggagaggagtctctccattccatcttcagaaagcgag

SEQ ID NO: 105698 - DNA, 1004 bp, Homo sapiens
ccctggatccccagctcaggctcctgctgttctcttgggaagtgaaggtcctgggctctccctctgtccttgtcctctccagccccgcccccttgcctgttggagcccctctgagcacctgtccagacctctcatgcctgccctatcccctcatacatcctcaccacctggctgaacccaattctatctctgtcttcccagaatctgctgtgggccggctctgcactgcttgccccagagacaggggacttgtgggcggcgctggggcagcgggcccctgggggctccccaggcagcgcgggactggtgaggcacctggaggagtatgcagccacactcgcaaggaatatggaactcacatacctgaatcccatggggctggtgacgcctaatatcagtgcgttgtgggtggggtagggcggggcacagcaggggggccatgaaagggcaggtacctgaaggtctgaggggctgtggctatcaatgccaatgttaatggcaggagactcagccaccgccctcagcgttttgtagggacaggctccgagctggtagcacagaaaacagattgtgggactcaggtgcgggatgcgagtaagagggagtagaacccttggcagggggaagaggtccatgatgggcctcccctttctttctcctgggtagtgctcagcattgaccgcatggagcaccccagttctccccggggggcccgtcgctaccctcgctaccatagcaacctctttcgaggccaggatgcctgggatcctcacacccatgtgctgctgccttcccagtccccacggccatccccatctgaaggtgagagcccctaggggacccctgggccaagtcctgtctctctgtccccccaaccagatactatgttgccctcctgccaattttcccctttctagacctccccagtgtcagaccctcccacatctcccctccaccctccctcccatatttcccctccaccctccctcccacatctcccctcc

SEQ ID NO: 105699 - DNA, 1012 bp, Homo sapiens
ctcttaccaaccccactcatcgaaagaaaatgggaaatggggctgagatcttggtctctttcagcccctctggacactaaagtcctgtccagcacttgtgccccccaacccttgttctcatgtccgccatgtgctttcctctcccaggctgccaagccaagctacacttttgtgactcaggcccctgcaagaacagtggcttctgctcggagcgctggggcagcttcagctgcgactgccctgtgggcttcggcggcaaagactgtcagcttagtaagtgggcagcatggggcagaggggcctgcagggtcagatctgttcctggggcaggggctgtaaccctgtttctcttatccactcagctatggcccatccccaccatttccgtggcaacggcacactgagctggaactttggaagtgacatggctgtgtctgtgccatggtacctggggctggcatttcggacacgggcaacgcagggggtcctgatgcaagtgcaggctgggccacacagcacgctcctttgccaggtgtgtccaccctgctcacccctataccctcagttctcagtctcttaggccgccactgacattcttgtgggttcaggttggtcacacagcatacttttctgccaggtgtcccaaccacacttgaccctgctctggaccctagcccttgattctctttccatcattatatcctctgcaggtgcagggctccagcatagctctctcttatgcaagctgcaccaacccacccacaacacctggtcctatcctctgccccctgaccccatatcagcaacatgatgtcccctggcacagtgccctttgtgccaggtataaccttgaccccactgttctgacctctgatattcctgacctctgagccctctgatctcacctccaagtcccagcccacatggggctctaaccccagggctatgcatctctgcccacagctagatcgggggttactgtctgtgacagtgaccaggggctcgggccgtg

SEQ ID NO: 105700 - DNA, 1080 bp, Homo sapiens
tgaatgaagatcggccaatgggtagcaccatagtggtcatcagtgcctctgatgatgacgtgggtgagaatgctcgtatcacctatctcctggaggacaacctgccccagttccgcattgatgcagactcaggagccattacattacaggccccattagactatgaggaccaggtgacctacaccctggctatcacagctcgggacaatggcatcccacagaaggcagacactacttatgtggaggtgatggtcaatgacgtgaatgacaatgctccacaatttgtggcctcccactatacagggctggtctctgaggatgccccacctttcaccagtgtcctgcagatctcagccactgaccgggatgctcatgccaatggccgggtccagtacactttccagaatggtgaagatggggatggagattttaccattgagcccacctctggaattgtccgtacagtaaggcggctagaccgggaggcagtatcagtgtatgagttgactgcctacgcagtggacagaggtgtgcccccactccggactccagtcagtatccaggtgatggtgcaggatgtgaacgacaatgcacctgtcttcccagctgaggagtttgaggtgcgggtgaaagagaatagcattgtgggctcagtggtggcccagatcactgcagtggaccctgacgaaggccccaatgcccatataatgtaccagatcgtggaggggaacatccctgagctgttccaaatggacatcttctctggagaactgacggcactcattgacctagactatgaggctcgccaagaatatgtgattgtggtgcaggccacatctgctcctttggtcagccgggccactgtgcacgtccgcctggttgaccagaatgacaacagccctgtgctcaacaacttccagatcctcttcaacaactatgtatccaaccgttcagacaccttcccgtcgggcattattgggcgcatcccagcttatgaccccgatgtctccgaccacctcttctactcctttgagcgtggcaatgagctgcagctgctggtagtcaaccagaccagtgggg

SEQ ID NO: 105701 - DNA, 1045 bp, Homo sapiens
cacgtcctcaataaagatggcggcaacatcttcggtcctcagagctgccatgcgcgatgggttgtaccaccgtgtttcgggcgccggggcagaggtggagcgaaccatcggggcggccgggagccatgttggagcggcgggaggcggcagcagcgtcggggatgctgtggtgggggcggaaaaagccagggccgcacgccggaggggctccggccgcggagtagatggtgcccagagggcggcgggggtgcggagagacaggcggaggggcgggggcccggggcggcggcaggggcccgggagggggcccgagcggcggggccagcccaaggcccggaccggggcggggggcggtggaggccgtgcagggaggcgggggatgatggcgaggcggccgccgtggcggggcctcgggggacggtcgacccccatactcctgctccttctcctctctttgttccccctcagccaggaggagctggggggcggtgggcaccagggctgggacccaggcttagctgccactacggggccaagggcgcatatcggtggcggagccttagctctttgtccggagtcttccggggtccgggaggatggggggcctggcctgggggtcagggagcctatcttcgtggggctccgagggagaaggcaaagcgcccggaatagtcgagggccccctgagcagccgaatgaggagctggggattgaacacggcgtccagccattgggcagccgcgaacgagagacaggacagggaccagggtctgtgttatactggcgcccagaggtctcctcttgcgggcggacaggacctttgcaaagaggtagtctgtcaccaggggctctgtcctcaggggtcccgggctcggggaacagctcgcccctcccttcagactttttgattcggcaccacggtcccaagccggtgtcctcccagcggaacgctgggacaggctcccgcaaaagagtgggcaccgcgcgctgctgtggggaattatgggcaacagggagcaagggtcagggcgagagagccacgaca

SEQ ID NO: 105702 - DNA, 1047 bp, Homo sapiens
gtcacccaggctggagtgcagtggtgtgatcttggctcactgcaacccttaacctcctgggttcaagcaattcttcctgcctcagcctccccagtagctggtattacaggcgcctgccaccacacccggctaattcctgtattttcagtacagatgggatttcgccatgttggcccggctggtcttgaactcctgacctcaggtgacccactcacctccgcctcccaaaatgctgggattacacgcataagccaccacgcctggcctggttactacttttaaccctggagacattctgcctccttttcatatccaaagtcaatgacactgacttccagtcacaactcctttctcactggggtgcggaaggcagggaagtattcttatgagatagtgtatttcagtaaaaagcacaggtcctcaggaagctgaggcagggacatcggacagcctttgtgacttgctgtgtttcctgtcatgatgcacacacaaaccctgtgggaacggcaggactgtgctgtgccatctgtcccagtgctggcacctaggtcaaacaaggtatggccccatggcagaagcctctgctcacttctgcaggagtgcccaaggtgggccctggcacctgtttgtaagagaagcagaagccccagctgatgaagttacatacatgctgactcctggtagcaagcgtgctctgaggggactccaggacctcttcagcaaacacccttgtggtggcctcacaacacaaaattacaaccaaaggcagattatgattagtcagagaagtcctcttggggagggaactgtctttgatagaacacgtctatggctgcgtggaaggttggtagatgtgatatgtgggtaggcagtaggaagggcaatgagacagagcattaagccaccccaagaaaggggagtgtttgggtagagttgagaagaactcaaattttgggggacagtgagggggtttgggctgacttcctgggtcagaagtttctgaagctgcagctaggaatgggtgtgtaagtgtgcaggtggctcaca

SEQ ID NO: 105703 - DNA, 1087 bp, Homo sapiens
aggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaatgtgtcttgtaattctttggctcttgcctcgttgagtacatcagagaggaagactctcagccatgtttgctccctaattgcttgtcttgtatggtgtcatcttttctagctgttttgatatttgttaagtttgcagatgagtttggggcctctggcaacatagagactaaggaactgggtaagaaaaaaacaaatgttacaatcatgttacttacaacgcttcttcctgctaaattaaaagttctttctgctcctcacccccttccaggtgtggtatctgtgcgctttgaagaagatgaagacaggaacttgtgtctaatagcatatccattgaaaggggaccatggaattgtggacattgtagataattcagactgtgaaccaaaaagtaagctcctaaggtggacaacaaacaaaaaacatcatgtcttagaaacagaaaagacccctaaggactgggtgcgtcagcaccgtaaagaggagaaaatgaagaggtgagtgtagacagagggcaactctgggct

SEQ ID NO: 105704 - DNA, 1105 bp, Homo sapiens
ggggtttcaccgtgttagccaggttggtcttgatctcctgacctcgtgatccacccgcctgggcctcccaaagtgctgggattacaggcgtgagccaccgtgcctggccgagataattattttttagtgacgatttagcaacctgaaaaccttgggtctttgggatatgacctcagtatcaacacagaatatttgaatgctggttaatatatttgttttaaactgtgatagaattgaaatcttgtagccacattttgaaagtttattcttcattaactagtcttttctcacctgattttctacaagagagaattttccaaaaggttagttgtcgttacattaagaacttgggttttgtttgacatgaaatgtttctacaccagcaggtctcagatgaatgttcaggcgtgggtccttaatttatactccccagttaatgcagacttataaggtggaaaataataaatgcaaagtaaactaatattagccagtgcttggaatgcattttgtaaagtgtgcagcaggccacattttaataattgtactcaccatatgattggtgtggatttggatgatgattgcagtgggtgccttatgagttctctgctgatctgtatgcgttaggtattcatgacacagtagtgatttgaggcacattttgtggagtgcctactttatgctggtgctcttgtagatcctggagattcagcagtgaatactgcagtcaaaaatctgaccttatggaacttgttttcaagtggaaattgggtgggaggagacaattaacaagacaagtaagaaacgtagagtatgtcagacggtgataagtgctgaggagaaaataaagcaggggtgccccagggagtggcactcacttttagatagagtggctgaagatcccattaaagagatgacatttgcttagctagctgtggtggtgcacgcctgtagtcagagctgctcaggaggctgaggtgagaggatcacttgagcccaggagtttgaggctgcagtgagccgtgattacgccactgcacttttagcctgggcaacagagcaagactctatctcaaaaaaaaaaagggggggtgacatttgcacaaag

SEQ ID NO: 105705 - DNA, 1055 bp, Homo sapiens
ccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaaaaaaaaaaaaaaaaaaaaggacaagaactgtcactaacctcatggaggggtttgcgtaaaaccatttagcccaccttgagcaaagggtagattccgtgttgtttttttaagctcactgtaataaaataaatctaattcagcattattgtgctacctca

SEQ ID NO: 105706 - DNA, 1013 bp, Homo sapiens
cctcacctctttttaacaatgcagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctgg

SEQ ID NO: 105707 - DNA, 1048 bp, Homo sapiens
aaaaaaaaaaaaaggaggagggaaccactaacttaaggtacaaatagtacttaaaaagaaatttgttggccaggagcagtgaatcactcctgtaatccgagcactttgggaggccaagatgggaggattgcttgaggccaacagttgaaggctgcatgagctgtgatcattcctctgaactccagccttggtgacagagtgagaccctgtctcttaaaaaaaaatgtggggggcatgggggattttgtcactgtaaaatgttgttcaaggcgcagtctcaaatcagagaaatagcccaagtttgtggctcattacctaagagaagcattgtccttatttagacaagattgggcatgttcagaatggtatggctgtagattaccttgaaaatgttaggactccgagctctaggtaaaaagcagacttttctgatcaaaccagaccactgagattagtccatggagtttacatggtacagttagtgaattttctgcaaagtgaattcctcagtaattgtgtagagtatgctgagaacagtgtatgtgtgtgcaactggacatgcccagctgtgatcctggagtcagcctaggtcatgttctttgcctgctgtagactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttaggtaagaaaagttctttatgcattaatattctttttctaacatgtaatatttttttcccatcagcaagccttgacatattctgccatcttttactgctgtctaggcctaggcagtttatgtgaccaaccagagatggatgaatggatgctttcagcaaacatttctgagtactgatgacagcctgtgagcaagacaggcatgcaggttctttagccgtatgaaaagaactgatgtccagggctgtgggagaatggggagaacaggagctgctggactctgtaaagtctctaacct

SEQ ID NO: 105708 - DNA, 1304 bp, Homo sapiens
attgttttggattttttaagtttttttaaatcctggattctaaggattaaatgattgttttattctctcttttggtgaggtgtctcttttttttttttttttttttttttgaaatgagggtctcactctgtcacccaggctggagtgcagtgacatgatctcggctcactagaggtgtcttttttgatattgaacagtgacagtgagctcataaatgtttaggtgttttctgttttgggttctatttatgacccataggtggcacctattgagtgctagatagcaagcaacagcatgtgggcatctggctggctcaggctataggtcctttacttccagtgatgactcaagattgaagtatcattaaacacttaattaacacagtaacttacatattcctctaatatttgctttggccagttaattaaaccatagatgttcctgtatataggcatttactagaattttcatattctttcttgtaggaccgggtgacttttagaagaatcatagtgaaaaataatgcaaagaagaggaagatgtttgaatcatttattgagtctgtgcccctccttaaatcactagaggtaaagtggcttgaataagaatctgttcatggggatcaggaaaagcttttaaaactattctgttgttaggttttcaaatcatactattctaatcctatttctgtgctgcatagctattgtgactttcaattaaggtcttttccttttatttgtgaatttgttgtttcaggtgtcagaacgaatgaagattgtggatgtaataggagagaagatctataaggatggagaacgcataatcactcaggtgagtgagggctttacgcagctcctttcctggaagtcacccctgaagaactagtacatcatttatctcaaaaacttcttgccggacgcagtggctcacgcctgtaatcccaacacttcgggaggctgaggcaggtggatcacttgaggccaggagttcaagaccagcctggccaacatggtaaaactccatctctactaaaaatacaaaaattagctgggtgtggtggcccatgcctgtaatcccagctacttgggaggctgaggcgggagaattgctggaacccaggaggcaaaggtttcagtgagtcgagattgcgccactgcctccagcctgggcaacagagcaagactccatttcaaaaaaaaaccaaaaaaccttctatgttctcccactgttgggagctcttattaccaggtaatagatcatacttcagaggactattatgtagtcctctgaagcttattgacgtc

SEQ ID NO: 105709 - DNA, 1084 bp, Homo sapiens
gccaggtgaacaagcttcccaaagccttgtgagagtccacagcttgtccctctctaccagtgctgtcctgagtcctcagcacaactcatatttgaagagcaatcatttagagtagaaagtctcctttaggccaggcgcagtggctcatgcctgtaattgcagcactttgggaggccaaggccggtggatcgcttgaggtgaggggtttgagaccagcctggccagtatggtgaaaccccgtatctactaaaaatacaaaaattagccggatgtggcagtgcatgcctgtaatcccagctgcttgggaggctgaggctggagaatcacttgaacctaggaggctcacgcctgtaatcctagcaaaggttgttgcagtgagctgagaccccgccactgcactccagcctggacaacagagcaagactccatctcaaaaaaaaaaaaagaaagtctcctttacagttagtaaggagtgcagggtgtgctttataaacatgttatttgccagtgtcaagtgaattgattccttgaagaattagccatggtactatagtcatttgaatgtttgtatttgagcctgattttactcatgaatacactgccctgaccttaacccctctggctcagatctaagtattaggaaaagattaaatatttgggcttgacctgctcaccctactgtgtcctaacctcttgagtttagtatcctctggctggtggcagtgaggtgggtgtccttctgatctccttagtcctgaaagaaacactctcactagagtttaacaccaataagatattgcttcacctgatatcttccattaatttaaaataaaatggtttttggagctagataataaaaaggaaacaaaaatagtttttttatcttaaagtaatttcagagttacagaaaagttaaatagtgcaaaaaattaatcataggcctggtgcggtggctcatgcctgtaatcctagcactttgagaggccgaggcaggtggatctcttgaggtccggagttcgaaaccagcctggccaacgtggtgaaactccctctacttaaaaaatacaaaaattggccagtcgca

SEQ ID NO: 105710 - DNA, 1009 bp, Homo sapiens
tctgatattttcacctagccttatttcatagtacctgccccaagatcacacattccagatacttatcaatttgacagtgaagtcttttattgctgtaacacataatggccatacttactttgtagtctcctgtaacctgctgggtctgtgactctgatgtttctgacttaatgatcctctcctccctcccagattcaggcttcttcaggagaaagcaagtacactggtaccttggactgtgcaaagaagctgtaccaggagtttgggatccgaggcatctacaaagggactgtgcttacccttatgcgaggtaacctttcaggcctccacttgaggtcacctggggaggtcacctgaggtgggtctgctgcagaaggtcttgcctggattgccagattagccttggcaccatgcatgtcacatctctgacaatactggcagtaagcatctccccctggccagcatggacgtagattaggatgaggggaccttccatctttcccaggtgtctgcaggggtagaagtcatggcatcacagttggaggggagtggcaagtagatagaaatcatctctggagggaggagtgggaagaaagtgtgacttggggacagtggtgatctccctggttttgagaagtatgtcctgttatagtggcagtaggaaaggcagagacagtctcactcttgtcctgagctggcagcttagaggaaggccagatacaacaactgtgcttataactgtgggcatgtcacttgcccacatggactttcacactgagagaaaaccttatttatttttttacttatttttattttattttttgagatggagtttcactcctgttgcccaggctggagtgcaatggcacagtcttggcttactgcaacctctgcctcccaggttcaagcaattctcctccctcagcctcccaagtagctgggattacaagcacatgccaccatgtctggctatttttttgtatttttagtagagatggggtttcaccat

SEQ ID NO: 105711 - DNA, 1023 bp, Homo sapiens
caccctctaactctcttcctggatttttctccgtagtacttattactacttgatacactatgcattttttagttatttatctttgttatggtctgtaaattccaggaggacagggacctgtgtgttgtactaccaggggtgcctccagcacctagaaggacgcctggcatatggcagggcgcaattgatctctctggagtgagtggatgaatgggagctcagaggaaacatggaagtctgggaaggcttcctggaggaataggcccgctggcccacactcccaaaccccgcccatgcggctttgcgctctgccacgcccatcgaagcggggccgaggccggaagcagccccgggcggaagccctaccgtgccaactgggccctcctcccgacctgccccgggctcgtgccccgcccacccaaaagtgggtgaaaggtcggcggcgccggcactgcagctggggctgagaagccaggacggcccgagaactgacagacggagtgacagacggactgaccatggccgaccagccaaaacccatcagcccgctcaagaacctgctggccggcggctttggcggcgtgtgcctggtgttcgtcggtcaccctctggacacggtcaaggtgcgggaggctgggtcgcaggctttggggaggaggcccgggcggggcgcggaaagcatggtcccccgcgaggcgcggacgctgggcagaagaggggcatgtgtgagcttccgtgagaagtctagggaatctctctttcaggggtgggcaggaagctgtaccttgcgccccaaagagccaggcggcggcgcaaagtgagcagcctctaactgcctgtcaagagctctgatgtaaagttccctgtcccgcagtctcttctgaccctgcgccacttctttagggatgggaaggaataaacgtctctccatagttttggtttcagccaacactaatattatcgttaaggttgaaacaggtcccctgtaaagcctgccccaggaagacaactaaagacagagcg

SEQ ID NO: 105712 - DNA, 1007 bp, Homo sapiens
acttttagtacagacggggtttcaccgtgttagccaggatggtctcgatctcctgacctcgtgatccactcgcctcggcctcccaaagtgctgggattacaggcttgagccaccgcgcccggcctgcacaggtgtcttgaatatgtatatacgcgactccagtatggttggaaatgatttgatttgttgtctatggaattgcacaacctggagccttcctaacatcagcggcttcatactggcatttccattgtggtgcagcaacaatctgagtgagcctccgtctctagccacatcatttgacaaccggtcccagaaggtaactggaagtcatgatgacaactcctatactgtgaaaagaaactgcaagcaaggcagttaagatgcaatcttgcacggtgaccgtaagtcggagaactgcgcggcgaacgaggcctcggcaggggaagcgaaagcctggtgtggttgcggctctggggccaccctgcgaccgcctcggggtgtaggcagaatttcccggcccagctcccctctgaccagatagcggccgagaaacaatggttatctgctccactgacgccaggatgtcttctccgtgcccgatcccggagtacaaacagtgaaatgagaagccggtgagaaacgcgctggttaaaaacatctcgacgggagacgctggtaggcgaatagtggctccagacgcggtcggcgcctgccgtaccctggtcagactctgggtcagagcgctaagtttcaaggaggcggcgctaaacaggccctctagccgggagcctgtcgcgacccgagcgaccgtgggtcgaccccgatccggaagtgacgcaacggcgccaagcacttccggagctgtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggcc

SEQ ID NO: 105713 - DNA, 1525 bp, Homo sapiens
atgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtgagcagtgttgtaaactccagtgtaatcccccccagttaaatctaaggatgagctgttgttaattaatgtctcctccagactaattgaatggccttgtagcttgaaaccaaatttaagtgtatgtcaacatcatttggacattttgttacatttactttgttttctaatatatgcatgtctaaggtcctcagattcccaaattagtaagaattagaaagtaggggtgggacagattcaagaaagatgtaccataccagaaatgtgtagtagcagaattgcacaactttgcacgtttcaggaagtgagttttcagaattttatgaggttgatacaataagcatcagaatcaccatcttctgtacgactgtgagtgactgataaatgtcttgagagtatacagatccctctggtttgccctgaatagtcattgcctttgggctaatgagctcatttgtttcatgtactgattttaataataattctttcttatgcttgtatttcattgatttagggggtgttagtatggaaattgtaaagaatgaacaaagttgattaccccatcagcaagcattttatttaacacataagctaaaacatacctttggatgtcttgtaccttaggccagttattatcctatttacattttttatgatcattttgacagtttcccaacaagcatgtttccttctctaacactggccattatgggaaattggaaatatttctctttagtgttttcactaatcttttttcatgaattgttacttggattttgtttctgattaaattggaggtcaaaagggcaccttggcatgatgtcaaccaaataaattttattggaacttaaacagaaataactaaggtgtgccttgtatgatttctataaaatttgctttatctactagtttagggatttttttttttttccccagatggttggcaaaggctaataccttgaatttagatactcaggtctttattagcaactggctggaagctgaaagctaagttgtttttttttttgtgtgactaatttctagaagtgattgtagacttcctgtcttgtgctgagcagaaaactctgaagaatgaggacctatggatcctctgggtttgggatttctgcactatggctataacaaagctgctggacccctgcctccagagggcatttccctggtagaaaacaataatcgggtttctcttcctcaccatgcacacctctcccttgttgatcaatagttttcttttgctttagtcatactgtcaggttatatacaatgttggtatttaaaataagaaa

SEQ ID NO: 105714 - DNA, 1058 bp, Homo sapiens
ttatgcattctgcttttttcatgtatatttcaaacatttccccatttttactttgtcctcataaatactttaaatggctgtgtagcatgccatcttgtttttgaactgtaatttgcttaagctttctgcattgggcatttaagtgagtacctatgtattacagttgttgggggactggttacattgttgtgaatgtctttatggatatgacttttatgtctgttgggccttgtccagagtctgggctagtggtcagatgattgggttccagtcccattttttccatttaatataatatgacctcagataagtctgtcagcatctctatgcttgagtttcctcatctgtaaaataatgataacacctccttcacaacattaaatgtgatgataatgcagataaagtgcctggaacatgaatgttcaaatcgattttgcttggtcatggtagaagcggggcaaaagtggaaggatgggagtgttatttgtcttggttccttaaaacacattctcagggttgtgtgtcttgaatcatagggtaggagcctacacattgaggatggttctgggcaatgtattgctgactggtgcgtctgagtgtgcgtatgatattgggtcatatactttggattattttaccttcccctagagcctctggttctcttctcctgggacccaccaaaagaaaagtaaaaacaacacaaaatgaactttgaattggagccgggaaaaagatacagggaaataatagcttgtttgtacctgtatttgtggttgactgcaatgtttggtcttatgcctatgttaatagcactacttagtgtttacttgttttgggggttcttgttattgagacacctccgtactttaattttgccttgctccaatctaattatctttttttttttctttgcccttgctgctctaggaaaaatttgaaggattagatttgtcttccccaaagagggaagaattgtaggaaagatttgaaaaaggtgcagaatgaggagtattttgctcctcctgaaatgtatctgccctctaactttatttcttaaa

SEQ ID NO: 105715 - DNA, 1039 bp, Homo sapiens
aaaagatatgctggctgggatttacttcacaataatctgaagggaggaggggagggctggaatggagacatagtgggtctggccaccagctggttaatgggtttcattatactcttcactttggtagatgtttgaaatttttcataattaaaaaaaaatacccttatggtcaaggaatgattacgttagtatttttacattattatattttgtataaataaccttatattgagtgaggtctttggtttttttggtattgattttaatgattggagtccatagcaattagaactgaatcaaggttaggctggtgagaagtcttcaaatgtgtgtttattaatcagacttaaaaacatatataacatttgggtacctcagttacaagtcaaccctccttccatgtccctgtaaagaaaagtggaatgggcaaagttatgatcaggtgccagagagtgggccttttagaggctgagaatatttaggtgtgaagtatgggagaaatgaaatcctaccacttaaattagattcaggggtgagcctggtttagggtcagaagccctatgagaccccactaccaccaccactactgatgctaattttgccccatcgtaggctggtgtttacttactcctttgtctctgtgctttaaccttctttcttcctcttgtccctttagtactttcttgcctccctccacatcatcccttgtcccccggacccaaatccatctgtcttgatctctttaggctgattttcctatatcatgtcccattctagccattctagcccaggcccagaagctggcccacagttcactacctttcttcatttctgctttttagtgagtgaccactagtgtttgttaacaaaagtgattggaccacgaagtggcaggctgaggcatgaagacccattcatgtagccttaaaagatttcaggcagttggcaagtaagaattctaaataaaaattgaaactaccacctgtattttttcaggccgttgatgctcactgccatcagctgcatcctccctatggca

SEQ ID NO: 105716 - DNA, 1455 bp, Homo sapiens
tgatagaagacttgcttgaatgcggtggaggggaagggacttggtagaaatcagaaaataagtttgtggctgttattaacaaacttcaggtggacttgcaatttgtgatctgaaaaatgatatcacaatctgcttacactgaataaagctgaaacagaagtagggcagcaagtcacagaattgctagtctaaacccacaagcaaattgctattggaattgccttacttaagatcctgaaccctgcagccgtctccttgtagcaagcgggtcagaggacacagagattcaaagttttatcttataaggtagtctccattctaagctgacagtttgatttcagttctctagtctctaacacccttagactgtggaagaaagtgcctccagaacaaaatgctgagattgtagatttgcatgctgctaaccacgtcagtaacagcgactaaagcattcatattcacttcattacatctctgtgagaaaatcttagcattattggcccacagcctgaatttccccctggtcttcatcctccattcctcagtcctgcttgtgaagcaggcatagaactgtgtgacacatttactatgttattcatttaaaaaacagaaaggagaacttgactcccaagcagccatctactctaggtttctaggccagtgtaaccaagtggtaactactgaacatgttttgagggcctgtgtcagatagtattttccaaaggtcatgagcaaacaccttctgtcatccactatagtctgtgcattttagagtttcagtcaaaaacagactatagaggatgacagaaggtgtttgctcatgacctttggaaaatacaaatgaccataaacaaagtcctttttgacatgcatgtagcacatgcttcctgaaataaagatctggaaaccatctgagagtattgacattgtaaatgcaatggcaaaacaaagccatattggattgagggctacgggtaatgcagagcaatgtgtagggtaaatgagaacagaggagagagagctcatttcaagctggaaagaaagctccccagtagcgtctaacccattgtggtgcaggtttggaggactcagggaaagtgggagcatgggctgcgcttggtctctgctcagaccccatctttgactctgtgaaagccttctctggactacccagaaacttgagggtacccttcactcttcacaataaactttatgcttgcccccacttttctaccttgctcatacactttccttccctagctcccggtaaaatgagagagttcttatctttggggcttatgttcatactaaggggcaggcacaaatgtgattgcccaaagacagtccagggagtgagaaggcaggcctaaaagctgtgcctgtggaaaagtgatgttggtaaggagctggctgaatgggagcagaacatccggtgaaatactcagaagccttggt

SEQ ID NO: 105717 - DNA, 1043 bp, Homo sapiens
tgcaccttctgaggttctttagtagctataactatgtgctttaaatgtcccctgagagcatatagaggccagaaaggctgcccacaaatttcgaaactgtccttgcaactaggactgattggctgctgggaattcagtgattttaaactgagttttgggtttttatattttgtttgttgttttctggtgtttctgtagggtttatgcaaacccaggcctggggattttctacaagtaacaggcctaactagagatgtgcttccggcgtacaacctcctacagcagcttgagggaacatatatgacatgaaggaaactccagccctgttgcttatattattaatagatgctaggttgttatttactgtaaaatgagtgtctttaagtttcagataaaattaattttcttgaaagatttattaatgaaaacaaagattgaaaatcaagagattcatgaaatcactaagattgtaagagtctaaacttaaaagacaaagcagagaaccaagaggaggaatttggtaatccagcctgggcttggcataatagacatgaatgtatacagttctcaaaatgcgaaacactttaaaagaaaatgcagttataattcgattttttttctttcttctttctaggtatctcattcagttgctaaacttatattagttaatttccactggcaagtttcagagatattggacaggtaaggtatttgggggaggagagagaacattgcccatagctcccctctccgtggtgattattgtttacattttggaccatattcgactatattccaatgtgcatagtatatttttaaaacattggattctattttacatcctcttctcttaatatgttgtgaactttccccatgtcttcagtatattcttctaccccagttttaatactagcacagtattctatcatagatattccatactttttccaaacctctgttgttggacagtgaattcagattttctttcccattgttaatttttaatcagtgcctttctaggtaacacgcgccaacatctttta

SEQ ID NO: 105718 - DNA, 1106 bp, Homo sapiens
tgtttgtttgtttgtttgttttttgagacagtttcgctcttgttgcccaggctggagtacaattgcatgatctcagctcaccacaaccactgcctcccgggttcaagcgattctcctgcctcagcctcctgagtagttgggattacaggcatgtgccaccacacctggctaattttttttttttttttttttttttgagacggagtctcgctctgtcgcccaggctggagtgcagtggcgggatctcggctcactgcaagctccgcctcccgggttcacgccattctcctgccccagcctcccaagtagctgggactacaggcgcccgccactacgcccggctaattttttgtgtttttagtagagactgggtttctccatattggtcagactggtctcgaactcccgacctcaggtgatctgcctgccttggcctcccaaagtgctgggattacaggcatgagctatcgcacctggccccatcaggttgtttttgttcaacaggagtctcttgcatggctcaggactgtccactccgtacaccagaggactttgtgtttccattgcttcccaatgaagaattgagagagaaatacaggcgctacctcttcagggactatgtggaggtatggccagcctttgttctgccctctgtcttcccgggcctaccttccatcagagggtcaccacagttacttactttgtagactaggctgacattaagtgatagtgttcaaagaaagcgctccatggctttaaaaaaagtttgaaaaccactggagtgatagtgaagagtacaggccttagaatcagacacaccattgtgtgaaacttggatacttcctttctttgtgaccactcttttttttgcgtgtgtgactgccttgctgtgttgcctggctggagtgcagtggcgcaatcttggctcactgcaacctccgcctcccaggtttaagcgattctcctgcctcagcctcccgagtagctgggactacaggcatgcaccaccactcgcagctaatttttgtatttttagtagagacggggtttcaccaggatgatcttgatctcttgacctcatgatctgcccccctcggcctcccaaa

SEQ ID NO: 105719 - DNA, 1882 bp, Homo sapiens
agctcactgcagcctgaaatttcaggcctcaagcagtcttcccacctcagcctcctgagtagctaggactataggcaggagccactatgcctggtgcaattctatataaacttagatcattccagtgagttgctacctggtttaagctaaacgttctaaattcctctttaatatctggcttacgtttggtcttcacatcctttctgaatttatatagccccttcgtataagtcatcagctgggagaacagaaagtgtttgaatattcagggggttctgatttttagacagcaactaagagatgtcctcattgtttcctcttggtgtgttcacagagtcattaccagctccagctgtgccctggtgcagactgccccatggttattcgggtacaggagcctagagctcgccgagtacagtgcaatcggtgcaacgaggtcttctggtaagagtgagtgtgagtgctgagcagccctgggctcatgccccatcctccaaagcaccactgctgttgctccatgtgagggcggcactggaagaggcagggtctctgagccaacagaacagctgtgctccaagtgggtaggtttatgtccagcatctcatattccactaggtcttcaatacatgctcagtctggaggcaaggaagtgacacaggttcttggaaaatgtgttgtggcttatgctactaggtctcatggcccagagattgtgtgggatgtatctgcctgcatagctaatcacatattactgtgtttgaaagatataaacttgaacattttaatctttctctgtcttggccttacttggctaatttttgttaaactaagtcataaatatattctacatctactcaaggttcacttcattcagtagataccatgggaataactaaagtttaccgaaggcttaccaggtgacaggcactatcctgatcacttaccctgcattatcacaactgtatatgacccttatattctctctttttttgttgttttcttgagacggagtctttctctgtagcccaggctggagtgcagtggcacatacttggctcaccacaacctccgccttccaggttcaagtgattctcctgcctcagcctcctgagtagctgggactacaggcatgtgccaccatgcccagctaatttttgtatttttagtagagacagggtttcactgtgttggccaggctggtctcaaactcctgacctcgtgatctgcccgccttgggctcccaaagtgctgggattacaggattgagccaaccgcgcctagccatgacccttatattctatgaataaatcaaggtacaaggtaaacctagtaaatcgtagagccataatttaggcccagatctgtcctaatcatacctccctggaatattcatggtggggcttcagagaaactacatggaaaatgtgatgtgtgtgtgtacgcacatgcctgcatttcaagacattattgacaccaaaggttaagaatcactaatgcagtggttctttcattttaaatccggcagcccccaggatcacagcagattcagaagactccttgtaattgttctttatccttgtgtcccactttatgaaattctttccctgggtatttgcctgagggccttttctagccacaaagtactgttggcctccacaaaagaaaatttcaaaatatggaagcctagcccgacgaatattggagtgtcttttttttctgttttaagtttcagtgtcatcagatgtatcatgaccctacagattttgcacgttctggcatttgtgcattcttgtgtgcatatctgactgggagatccgatgagactcccggaagtgggtctcaatcctgccttaggtctgagctaaggagtccttctcagagc

SEQ ID NO: 105720 - DNA, 2380 bp, Homo sapiens
catctctactaaaaatacaaaaattagactgggcgcggtggctcacgcctgtaatcccagcactttgggaggccgaggtgggtggatcacgaggtcaggagatcgagaccatcctggctaacacggtgaaaccccgtctctactaaaaatacaaaaaattagccgggcatggtggcgggcacctgtagtcccaactactcgggaggttgagtcaggagaatggcatgaacccgggaggcagagcttgcagtgaaccgagatcacgccactacactccagcctggcgacagagcaagactctgtctcaaaaaaaaaaaaaaaaagaaaaaagctctaattcatgatttgttggcttggataaaaggaaaattttgaacatgggaccctgacttaatgaatatttgaatgtttttcttttccaattttaagtttcaagtgtcgtcagatgtatcacgcacccacagactgtgccacaatccggaaatggctcacgaagtgtgcagacgactctgaaacagccaactacattagtgctcacactaaagacgtaaggaccgtattttacctctcatggatttgccctccttagtgctgcccagggccttgccttggagatttgccatctgagagcagaatacccagagccccaggacccttcctgaggactgggggtttggggaccctcacacagagttggcagctcgtagcagtttattataggatgcattgggtgcatattttctttattatgatgaaatgccaaaatgccaggaaagggggacccaaagggggagctaattagaagagaactaattatgattgaacgcctaccagcctttaacagccctgaaagggaggtggttaatagccacacttgatacatataaggctgtaatgcaagcccagacctgcacgatactcattttgaagtctcccatgggaaagtatggcctgtgggctctaggggccactgtaccctttgtcagtcactcgccgagtcagtgcactcacaagcacagttacgataacgacattattaaacatagtcgacttcacggcagtgggagatcacagcatcagactggtgtcttcattgctgcctcaggttgctggcatctctcaaatgggagagatgagctttagatgtggtttccttgccctcttctcgaagcagaagttcaggcaagctgaccaggactgaatccattgtggcagctcctgtgcttctttggcagtcctctcaagaaggcaggctttctgctgattcaacttgtgcttaatctgagtagcttcatggcaggggcagatggtggaagacttagtggggttcagctggtgcttgaagcatttcaaagctaaatgtgctgacctcatttccttgaattgctgttccagcctcagcgacctgccacatttaagtgaggtgctcctccccagaagtgctcacaccatgagcaactgggcacaggtgccaggagctttgtgtaatttgtcttaaaaccaacctggtggtgtgtgagcctaatggcacccttctgtctcctcagtgtcccaagtgcaacatctgcattgagaagaatggaggctgcaatcacatggtgagcagaagcctctgcagtttgcatgtgtgacatggaagctttggtcagtgtgcccttaacgtgttttcttctgtttccctctgacagcaatgctccaaatgtaaacacggtgagttccaagcttggtgtgtaaggcccagtggcactttcttgtggttgggtctccgttactatttaagtgagtacttctgccatgaaatgacaaaacatagaagaacctcagtcacttaacagtcacagtaactggcataaagtagctttttatttttattttctgttttttggtccctcttataatcccactgctatcttgctaacacatatagtcagaagtcaagtttgggataaacctcatgatcctcagttatccaagaagatgatttcagggtgttgctttcatttttttgccaaggcaggtaagtagcttggggcttatctgtgctacgttgtagatacctttaccagaagtagtaaaataatggttttcccttgccgttttacaaagtttctagtgggggttttgatttagcctttcagacctccttcatccatcaggaataatttacatagctagaacccatgtatgccatccggccaggtcaactgaagaaacagaatcccttcaagtagaaaatatgtccaagtgggtcttctacgcagctgctttgatgctcaacaggagcccctgacagtttcttttttttttttttgggagaaggagtctcactctgtcacccaggctggagtgcagtggcgcagtcttggctcactgcaacctc

SEQ ID NO: 105721 - DNA, 1049 bp, Homo sapiens
tggacaggttagaaggatggactgaagaagacctgctcttgcactttggggaataagttagaggagtctgtggccatgtcctgccagcaaggtgtctatcctgaactcctgtgtagacctctgcaccttcatgggactcctgtggttttcttcttcttctgtgccctgtagtgggaaaaccacaataaaagcttgcagctagaggcacagacataccagcggattcacgagaagattcaggagagggtcatgaacaatctggggacatggatcgactggcagtacctacagaatgctgccaagctcttggccaaggtatctaccacttcactcatcttatccctggtccagtgcctggctccgtcaggcacagacctctgatagtgggaagctctgttgaaagagggtattttagcaccctgtgcagcctttcatgcttctgcttgtggatccacattttcatgtgctgtgcccattaaggacccagtcctctgatggatgtccaggggatttataagagtgttgcactgcctctgcctgcagggaaaactagagcacttttcttctccttttgtcctgtttatgtatcactcaaaggaaaataaaagattgtctgatcacttgaggtcaggagtttgagaccagcctggccaacatggtgaaatcctgtctctaataaaaatacaaaaattagctgggcatggtggtgcatgcctgtagttccagctacttgggaggctgaggcacgagaattgcttgaacctgggagtcagaggctgcagtgagccgagatcacaccattgcactccagcctgggtgacaaagcaagactgtcaaaaaaaaaaaaaaaaaaaaaaaaaagattgggcagggtgcagtgtctcacgcctatgatcccagcacttcggaaggccaaggcaggtgcattgcttgagcccaggagtttgagaccagcctgggcaacatgagaaaaccccgtctctacaaaaaaaatacaaacgttcgcctggtgtggtgatgcacacctgtagtcctggctacttggaagg

SEQ ID NO: 105722 - DNA, 2541 bp, Homo sapiens
aaaaaaaaggttgtctttggctaagcattgagatagatgtgttgactctgatgtcctactcaagagggaaaatccattgaggcagctgctgataatcagtttgtaaaagaaactgtgggtgttctgtgaccatcgttgtttgttttttccctcatgtcttttcccaattcatcctctatttggcctagtatcatttctttcaggcctatatctatagagctgggctaatttgcatgttgagggtaggaattgtaagagccacctgagatgcaggtagcttagaatcacagacacaggttccttctcttctctcctgttgcagtgtcgatacaccctgcaatacacctacccatatgcatattacatggagtccggacccaggaagaagctggtaaggcaaagcaatttttctactctgtcccgttagcctcaaaggtgcccttctctaccagcactttgcaggagagtgaggaccagaccttggtcattgggagggcaaagttaaaacaaaactctaattgcaaaattccacttctgctctgggcacctccaaaatagatctcaggtgctattattttgtgtcatataaggcacatgcacctaatcctctgaacaactgtatttaaagggcgattggctaaaaaggtctgtggccagtgggaggccagtagtgcccatgcttgggagggatatttagcatgcatgtccttaagatatatttgactgttttataccttgtttaattcttcatcttagagttgaatttgaatatgaatttattgttattaccaatagtgttaataaactagtaattaacatttttgtttaaatgctggaaaacagaaaagcatttacattgtccagagagaaattaccactgtcagcattttccagccttttaaaattaacattgtgtatatataatcaaggttatatataacattttattgttataacagtttattgttatagctgttatgatttacctgcctggtaaataccattttgttaatggttgcataaatgtgtcattacatgattgtaccatcacttgggacatttattctttctttctttcactgctataaataggacattgaggaatatttttgtgcataaagctgtatatcttcttagatgtatgattactaagtatttaagtttgaatatttttaaggctcttgatttgctggaggactgaaaaaaatgaagtgatagtgtctgagaatattcatttgacttattttttacagcatccattccctttcatgttgggagtgttctctttagtggcttaaattctttgcctgcctttgggagtgtggagggtggagtggaccttttgagggtcgagggtgaatgtggccttgctgtttggatagccttttgtttggattctggctctgggcacagggaataacactactttctgaggacagtatcaggattgtctgtagttcctgtgagcctgaggtgctgcatgtgcccacccccgtgtacaggccctgccccagccacagcccactcaccttttgaccctcctgctctgcctatacagtttgaataccagcaggctcagctggaggctgagatcgaaaacctctcatggaaagtggagcgtgcagacagctatgacagaggggtaagtgcctactgtcctcttggattctatattgcaggtagaggactggcatggtaataggtgacagcgttgttggcttgtgcactggtagctgctgctaagaatgggaagggcagtgtttttgactccttggaggtcctggagggtgtttgtggctttggctactccttgctcccaggcctgggccatgcaagcacacaccttgtttctctgatgcaggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagc

SEQ ID NO: 105723 - DNA, 1044 bp, Homo sapiens
taatggggcctggcctcctagggtaagtataaggattaaggagttgatgtgtatgaagtgcttaggacagtgccttgggcagagtctgtgctacctaagtattttctgctgtaattactattaaaaaccactccaggccaggtgtggtggcatatgcttataatcccagcacttttgagcccgaggtggaaggatagcttgaacccaggaaattgagaccagcctgggcaatatagggagactccatctctacaaaaaataaaaaaataaaaaaagctccaaccctggtgctgagtgaccattttccttcctcttggcaatgactggaactttgtgctggaagtgtaactgagagaagcggcaggccactccgcaggtagcagtgctgcccttcctccagtcagctcctctgcgtgcttcttgtcctccagtgaagaccgctctcccaggaacaagggaaggaagcagggcccatgctcctgctctggaagtgtctggggctaccagaatgtgggctccctagatgtgaggctcaggttctagctccaccaagccacctaccagctgtgcctggtgtgcaggcagccagccactgaagccaagccccaggcctgactgatctttactcaggggtgtagaggcatagagtaggcactaagtgaacatttgtaccagggaaggaatcaaggaagcaaaggacacctgggacatcttttcagagaccagtatctgcccaaaacctgagtaaccctcactgatcttccagcactgggcaactcagccctggtcagatggccagcacccatctttgcaggaaattggaggggaaggcccttggactggcctgaaacattggatgtcttgtgctgtttttatttgaataatgctgaaaagttaaaatgaaagcaagaagcagccaccatctccccactttaaatatttatacccagtaaaaagtagcaatcaagcctctgcccttcaggatcactctctagccttcagtcccaacccaaagatgggtcagcccatatccaggttagctct

SEQ ID NO: 105724 - DNA, 1051 bp, Homo sapiens
gaagcgcctaaaatggtagtgctgctacctgtgctaactgctggggaggggtgggcagggaagctgtcatgcaagtggtgccccctctggtaataactctcaggaggtttctgaggtgtggtcatcaccctcatgcccaaattctggaccaagagaggaagatacagcagttagaaaggacttggaacagtggctttgcggctggtgaaccagagtgaagaatctggccgtgacctgtggctggatggctgccacactgctataggccccagaacagaggtggtgacagtctcacagcccttgaatgtcccccaccctcagaggaatctgggccaaagagtggaaggtgatgtccttgggtcagccagaataacatggagcaaagataccaactactcttccagaaccccaagagggtagaacccctgcttaatggtttgagcagggacagtggagaatgttctcatgagagggggtggcctgactttcgttgctaaggtgggctggtaacgcagtaggcagggctggcgaagtaggttccacccaggatgaaacctggggtcatgaggaactccccgggggctggccctgcttgcaccctggcgtatgtatgtaaggccctggatgaggcccagcactgcctgctctctcctcaccctccacaggccggagagtggccaccactctatatagccaggctggaaggccagggtcctggccatatggctcaagcttcctttggagaaccttctctggccactctaatagggggtgggcctctttcttcttagggccaaattagggcttaaactgagaaaaggaactgctctgggtcttcctgtaaggcctgatgtgacagaaaccaggttcatctgacccaaaagtccaggtgggggacaagtgtacaaggcccctcagtgcctgaggtcaggggctgctgctgcctttggggtaggtagggaagtgcagcctgccactgttgcctcccaatatgggcttggtgggcattgatggtgggtgccctgtgcaggagtgctgagtctgcaggagt

SEQ ID NO: 105725 - DNA, 1048 bp, Homo sapiens
atcttgattccacttagagaagctgaagctgtgcctccctcccctgtcaagccagttctttcctcttcaggtggctgttctggcccagccccttcccatccccaaggagcccttcagcgcgccctgttgcttctgctagcctacctttccctgccaggcccttgctcagggccatggcatttaactaagtgcacctgtgatcttggccaaaaaaccattgcaactcacagtaagagactgggtttcggggaaggaggggctagggacattttggcactggcctgccctattgtctcccatcctagtctgtcctggtccctggcaacaggaacctgggcagcttatcctgcccacaggtaagcccctgggagcatccacaactggggacctgctcagtgccccccctgccttacagctacatgacagtgctgttttatttgaacaacgtcactggtgggggcgagactgttttccctgtagcagataacagaacctacgatgaaatggtaagggtcaactgggctattactcttgtgggctggcaggggcttagacaagtgaagtacacacctctccaggtctaaggatgtgggcccaaattattccttgggcatatctggttggtttccctttggtcacccttggctggcctggccatagagtggggacaggttgaacaccccaccaccctgctgcccacagagtctgattcaggatgacgtggacctccgtgacacacggaggcactgtgacaagggaaacctgcgtgtcaagccccaacagggcacagcagtcttctggtacaactacctgcctgatgggcaaggtgagggcctatggccaggcctggggggggtgccctgagtacagcttccctttacccagcccccgtctgccacaatggagggctgtttctggctgctttccaaatagttttctgctcctggtgcctcccaaaggccatccttagtgactttagcagactgccccaggacctgtactgcttattgggttatatccatccctatcattccctgatgccccagcc

SEQ ID NO: 105726 - DNA, 1057 bp, Homo sapiens
tagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgagccgccgggcccgacaaactccgggtcggcgaaacagagtccgcgataggtgcagcgggctggcagctgggagcgccccgcaagcgtcacgtgagggggcgaggggcgggatgcccctccgcgggccccgccaatgatgagctggattgcgtgggacgaagggtcgtcattggacaaccgccgcgggcgccctggtctctgctacctgtagctgagggcgctgttgatgggcagcgcggcgcgctgggaaggctcgttctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgaggcttggcttgaggcacgcctggtggaaagggggaaagaaacagcgcctcccaggggcggtgccacagggacaaaaggggtgccctgaggagaaggacgggcagcaggttgaggccgatcggaggtgggaagggagccccggagatggcggggacgagggccaacctgaagagggcggggcccgagagacaaagctgatgtggccgccgcggcgcttcataaa

SEQ ID NO: 105727 - DNA, 1313 bp, Homo sapiens
ggctcactgcaacctccacccgctgggttcaagcgattctcctgcctcagcctcctgagtagctgggattacaggcacgtgccaccacacctggctaattttttagtagagatggggttttcaccttgttggccaggctagtcctgaacccctgacctcaggtgattcatccgcctgggcttcccaaagtgctaggattacaggcgtgagccaccgtgcctggccgagaccaaggattttcttttttttttttttcttttgagacagagtctggctttggctttccaaagtgcccagattacaggcgtgagccaccgcacccggccgagaccaaggattttctaagattcaagctgcaggattgtgtgtcctgatgcattcataggctacatgccgagaagtttccctgatccccatctcttccctgtgggtcatcagagttaggtacctagctctgacatggctctttgcctctatctaggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggc

SEQ ID NO: 105728 - DNA, 1068 bp, Homo sapiens
ctgggcatggggcctgctcacagacagcatggagcagggatgggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccattttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctggggaatagaagcacagctgcagagagagaaggcagc

SEQ ID NO: 105729 - DNA, 2796 bp, Homo sapiens
cacgcggaaggggcgctgggggcggtaggtcgaaagcagccgacagggctaccactggcgcacctgtccacttacggggaccaccgccgcatccccgccccagctagtcggtcctttccggaagttccacctccctaaatttttttccggttccgcttactccttccggtcaccatggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggtgggcgtgagccgggcggggccgtgcggccgggagatgggccccgtgccgtggctcttttacacgcccgttctcccgcaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacgggtgagcggggccgcggggccggaatggagaaagtgggactgccgggtacctagaaagcgagcggcgccgcccgtggggactgcggctggaggtgggaagtcgtggcgagctggaccaggtgctcagactgaggcggccgccctcccttcgcagggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctgggtaggacctgaagcctagcagggccagaaaaggcaggagggggttaggggcacatctctgcttcttgtcagtctcagcacctgtctgttctcttttcagtgactgaggatctcctctctgtgctggctgagctgcaagaggctctatggcattggcccgaggacagccacccaggcctggttagtgactcccagccctgtaggttctcccaaaccaagtatactgtacttccacagttatgattgtcctcccttaggctggggcctcagatactggtacaggcggctgcctggttgtacatgttgttagctgtgaggaggagttccagcaacagaagttggacctgctttggcagaagttggttgacaaggctccactcagacaggtaggttaataatgatggtggagctccccaccacctaacccccaacctcagagggcccttgaaaacccaccgaggggcttgttagctgacagaaaccaacacttgaccttgggggagttgctggacttgagagggcatgtacagcaggtgcagaggctctggggaaggggggtctgtagacacatcccaagaacactgaagaccaggttgagaaggatgaaccatgcgtagcctgagtggctgggtagacggaggcactcaacctggcagttccaatttgagggagtctgggctgagtagaggcaccagatttgggctcctcaagggacttcctggagagtagcgccaactaggctgagcccctgacatctttctgacagaagcacctcatctgtggccctgtgaaagtagctggtgcacctggcactctgatgactgcccctgagtactacgagtgagtgaggctgggaggaacaccaacctaagccagggtaatgaggggggactctttacccaggaccctgcccactggccttcctctcttccaaacacaggttccggcatacccaggtgtgcaaggcctcagcactgaagcatggtggggatctggcacaaggtgtgcctgggaaaccctggctatgttctgggttaggggcaggttttttgcatccctgcccttgcctgcagactgactgaccaaccctatactccctcagacccagcctggacagagatctttggtgttctctctgtggccaccatcaagtttgagatgctgagcacagccccacagagtcaggtgagcctgggagcctgacagggccagtgttggggcacagggtgtggtggctgccttctctctctgcagctgtgcttctattccccagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgaggtgagtgtccctcctggtagctggcacaaggaggcctggacttcccctcccagcacctttctccccaacagggtgagtggttgttgctcttcaacagtatcctcccctttccggatctgctgagccggacagcagtgctggactgcacagccccggggctccacattgctgtacgcacagagatggtgaggcatagacaaccaggacactctaca

SEQ ID NO: 105730 - DNA, 1079 bp, Homo sapiens
tggagcatcaccttgtcctcgttcactctgctcgcgtcctgggagtcccccgtcccccgtcttgatccaagtcaagggcctactggcgcgagagtcgctggcccccgcgcggggtttgggcatctcggcacgccggctctgtcgtggcctcaggggaacattgtcgctttcgctacccgcggggccgggcgagcgggaagctcggcacagtgggagcctggtggtgggtctcctggggccggtcgcaatgggtttccgggggtcccgcggctgctctgtggaccccttcggcccctggtgctccgggcgctggcagcgtcaccggacaaaggccaccgagcgcgggggtgtccccgaggtggacgcgcgggtttacttcctctccggccccacgggcgcgcttccctcctgacggattccgaagcccgccccaccaccgtcaccgcaccagtggcccaggcttcgtgggaccaacagggctaatcctgccccacggatctaatccggatcgggacccggtcccaggggaggcccccacctccccttctattgttctgtggcccaggtgagcgtcttgttccctctagactccgtttcacaacctactcccgggtcttcctcctgggactggggatgggcgggttctgatgtggccccagggcgagtgacctgggggcaggagctcccccgccccccgccaacggctggacagcgggcaacggaatcccaaaagcagctgttgtctccagagcattccagctgcgcttggatttcgtcccctgctctcctgcctgagcagcgccctggcccagatggggtgcccctgacccccagacatactttactgagctgcttgggtctcagttcctctcagttgcgccctcaggctggaggtgatgggtgtagacgtgggagagccgaggctggtggccatctctggaaccctggggaggattggcgagggagggtggacccaggacctctgggtagggctgcaatggtagtgactcccccagggctgcctcagcccgcatctcgctaaagatagccctcttacttcctggggaaaaaccacccca

SEQ ID NO: 105731 - DNA, 1042 bp, Homo sapiens
cattgggctgcaaagaaaaggccagcatcagcctgtctagcgccaggcctgtgctccccgcagcatgccccagtcccgggactcaccgtgtcctgcacttccacagcaatgccccgctgcctcatggcttgaagcacctgggactgcagcctctcggtccggtctccagtccccaccaccacgatctctagggaagggtgggtgtggctagtctacagttctgttgagaggctgcagtgggggtcgccttctggggcccagaacacctctgttctccctccccttccccagtacctatccggggctccagcaaccagaagagggaaaagctgtcttcggtgatgtcctggtgggatcccacctgtgcagggaggaggcacatttaatacgacaaatccacgcagcctctccccatctccatccactgcaggaggagacagaggaaagccaagtttgcagggaccaagcagggtgagggcctgtgactctgggcctcagtttccacactgcgggccaggactcacgttccactgcaccaccgagtgcgggagcagagcgcaggggccgagcacgcggtttccgtttatcatgaagccgcggctgttgtagctgtcgatgtacattgcctgagcggcctcgcgttgcagcagagagatgcgcgtccgctgatacagctcgtcatccgccggcgagagccgatgccctcgccgcggggccctgcggagggaaagggtcaggggcgcggggccgggccgggcagcccgagaggccggaaggtgctgggctggcagtcgccggccctagggggctggatggtcgagggcgcggggtccaagctcaccagggaagctcaacgggcggacagcgcagcgagggtcgcgctcggtacaagctacgtagcgcgagagcggtggccatggctgaccaacgcgcggcgaagtcgtcaccggcgccgttagtccccgggttgggagggccctgcggagcctgacccagcgtggctgcagcgccccctgcgtcccggagggcaccgcacagctcg

SEQ ID NO: 105732 - DNA, 1036 bp, Homo sapiens
ccttttcagaaaagccgcttctcatacctgcaggcagaaggaccacctgtgaggtgagggcaggagaaaggaggcatgaggtatggcagaggccccaccaaggacagggtgacttacgaatggaggctatggacgccaccttccacctgggctgaggacgttctcttctcaaacttaagctccccagagtacatcatggctctgaagaagggcagaggtcaaatgtgggtagctggccctggaccagcccctctacccatgtcccagctccccaagctcaccggacttgggtcaagctcttggcaccaatgtcctggcatgagtgttggatgccagcaatcaggtaagggacaaatttgtggattgaccctttgtcctgcacagcaccagacactccctgggccactttgattttgtcagcttcactgcagggagaggcagagacacgggcaaggtcacagcagagatgagactgtcagtgcaggattagggtggggtaactggcttgcctgtcccacctgaaatatctgttctggctgctgaggtgcttgtccatggcatcgagagaacccataccgcgatatttctttagccggatcccatcggaaaagaagtattcaccaggggcctcagtggtggcagccaggagagagcccatcatgactgcggacagatggagtgcttgggttagagcctaagcagcactagggagggggtcccactggccttcacgggtactgggcctcacctgtggaggccccaagggccaaggctttcgcaatatgacccacattttggattcctccatcagcaatgaccggaacaccaaagcgccgtgcatactctgacaccttgtacactgctgttgcttggggccgcccacaggccagcactgttgagatggaggaacacatgggtggatagggttaatggggacgggcagtggaccctgtggccatatttaggacccaggagcttttggctacatctgcatcaggactgcagcttggctgaggaacagacgtgtctgggatgg

SEQ ID NO: 105733 - DNA, 1094 bp, Homo sapiens
gggtgggcaaggccaactgatacacagaccatggtttgggggtggtgctcaagaacatagctccctcttccttctggggtgctgatagggcaggaccttcttccctaggcaggaccttttctgcccacatcttctgcagtaggcatagttcagggaccaactcctttgtgtggtccttgctctcccacacaaccactgcctgctccacacaaccacagcctgctctcctacacaaccactgcccttatcttgcctgagctgcccaccattcagggaggaagggctgggcctgacctcagtgcctctggggactaactgcacggtgactcctgccccatctgataccagctggacgggggctttcccggctgctaagactgcatgtgcctgaggctgccctgggcactgcacacatgcacgtgcacatgtgggggtgagtagaggtcagcacagctgtttgtactatttaaggcagatgtggcagcagccatcccagacacgtctgttcctcagccaagctgcagtcctgatgcagatgtagccaaaagctcctgggtcctaaatatggccacagggtccactgcccgtccccattaaccctatccacccatgtgttcctccatctcaacagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacaggtgaggcccagtacccgtgaaggccagtgggaccccctccctagtgctgcttaggctctaacccaagcactccatctgtccgcagtcatgatgggctctctcctggctgccaccactgaggcccctggtgaatacttcttttccgatgggatccggctaaagaaatatcgcggtatgggttctctcgatgccatggacaagcacctcagcagccagaacagatatttcaggtgggacaggcaagccagttaccccaccctaatcctgcactgacagtctcatctctgctgtgaccttgcccgtgtctctgcctctccct

SEQ ID NO: 105734 - DNA, 1864 bp, Homo sapiens
ggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagaggtgggtgccactggcagagtagatccaagctctagcagcccaggttgaagacaaggggcttctgttgtctaagacatctctgatagcctcttctctctgggaaaggagtgtcaaaccaagtttctgactcctttattgggttcctgcatcctttccccaccagaggctttcaaactgcccaaatgcttgctagtattcatgctttgttcttttaaacccctaaggtaggggcagtgcttgaggtctgccctgattttcttgccattgttcctgtgttgtcctccttattccatagtgtaagagggtgctccctgtgccatgttgtcctttctactcatccctcactcaataccatactgctaagaattattgggatcccttgaggaagggtgttttgggtgtgaatgtatgaacgtggtggtccatagaacttcacccctgtaatctcagtactttgggagactgaggcaggcaaatcatgaggttaggagtttgagaccagcctggccaacatggtgaaaccccgtctctactaaaaatacaaaaaattagttgggtgtggtggcgcgtgcctctgagctcagctacttgggaaggaaagaaaagagttaactggtcatagtcgatgactggcccttcttcacatctcacctcccacgtagataatgacaaagagggaagacttggtggtagcccctgcaggcatcacactgaaggaggcaaatgaaattctgcagcgcagcaagaagggtaagtcctagagctgggaaagggcctggaactaatgcctagggtcctgattcatgtcctgccctgaccacaggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggtgagctgctacacaggtgggttggggcaataggggcagctgccacatcacagtctgagacttacttcttgtcctaggactcttcccagggaaattccatcttccagatcaatatgatcaagtacatcaaagacaaataccctaatctccaagtcattggaggcaatggtaaggcaagattgtgccctgaaggatgtgtggtgggagtgggtaagctgggctcccaccttaaccttcacatgagcattttcctttccttcaccatagtggtcactgctgcccaggccaagaacctcattgatgcaggtgtggatgccctgcgggtgggcatgggaagtggctccatctgcattacgcaggaaggtaagaatatactttgatagggcccacagagaccccagtttcaggccccacataccttggaaccaagcactcttatggggacaatagagccctccaataggggcaaccctggggccaaattggcctcttggatgggtgacatggctggaagcaagacaaggtcttgtcatccatcacctgccactcccttgcctagcctggccttcttgctcctgctctgcaccttctctaaactctggtctgtttgttttatttagtggctcccaagatccctccagacata

SEQ ID NO: 105735 - DNA, 2316 bp, Homo sapiens
ccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaagtgcgggcctatggggctcacctgggcgaagagaggggcggcaccctggggaaaaggccagatgggggcttccgagagccgccttgggcgtgggcgtgggggacaggtttcgggaattggccacccacctccggggctcactttgagacatctggagcggtgcttggggtacggagaagcatctcagtagtgcttggaatctcaggccggagattccatgctccagacacatggaattgtcagggtgccaggagcactgatgacagctcggtggcagaaaaggtcccctgtacccatttccaccttgtgctgtgcctgtgacacacagactctgtcagtgccactctctgctcacatgcgttacgggttgattggtacatggggatggagtctcatgctgccctaagctgagagctttactcccaattcactcccttccctcgcagtgactttctcattctccctgggtacatcgacttcactgcagaccaggtggtgagtatgatcaggaattgggtcctgaacatcaaggtgagctaaggtgctactatcacctggtctctgggctaactcaccagattgggcttgggggtggattttataggatcatgttgcttgttagcatgcaggtcatacaaaagtgcctttttgtgggggactcagtaacaccttgaggtgtaagggatgctttcccacactggttgacgtttgtctcctcaggacctgacttctgctctgaccaagaaaatcactcttaagaccccactggtttcctctcccatggacacagtcacagaggctgggatggccatagcaatggcggtgagccccatggggtgtgggggaaggagcaaggactccatcgcctttccccaaaggcattcagtcctgcttcttgtcacttagtagtagtctctttttatcctgtagcttacaggcggtattggcttcat

SEQ ID NO: 105736 - DNA, 1075 bp, Homo sapiens
taaaaacacttccagaaagctaaatttagaagcagccttgctctggctttccaaaggtgtgtgatgtgcctagcactgatagaaaaaggggtcccgggtccctacagtcacctttcatgaaaagggtatgaaggtacagagaatctaccttcatcacatattgagcatggccctgcttcctgaccttgaccttttgtcactgccatcattaatctaggtgagactcctctcagctttttctcccttttgccccttcaatggtttctcattacatagtaattcttttatggcagacaactcctttgatgcactcccccttgctaacctcatgtctgtggagctcttagttccctagccacactagctcctctccactcaaggacatcatattatgcctcttctcaacttaaacacagcttatcagggaagcatttccagattccccacctcttccctgtgactgtttcctcggtagcacttatcactgttttttattttgtatttgtttaactttaattgctacctgtgtcccctcctatctgtaagctccatgggtaggaaatacttttcctgcccatttttttaaatatcagcacctagtgctgacctggcactagtaacccttgaataaatcttgaatggatggatgaataactgttagaggatacagcatgccaagtacttaatagaggtacagcacagttcgggggaggggggtgaacccaagtttagggccccactgtaatggccatcattattgggtagaaaacacaacatgaggctgggcaccgtggctcacgcctgtaatccaagcactttgggaggccaaggtgggtggatcacctgaggtcaggagttcgagaccagcctggccaacatggaaaaaccccatctctactaaaaaatacaaaaattagctgggcttggtggctcgtgcctatggttccagctactccagaggctgaggcaggagaatcgcttcaaccaagggggcggaggttgcagtgagctgagatcacctcactgcactccagcctggagacaagacgccatctcaaaaaaaaaaaaaaaaaaa

SEQ ID NO: 105737 - DNA, 1544 bp, Homo sapiens
cggccttccaaagtgctgggattacaggcatcagccactgcgcctggccggccttgctttttagagacagttgagatgagagaagacttggtaagggcaaacgggcgtgcatgccagttctttgggtcctggaccacctttgaaaatatgcaaagctctgtacactctcagagaattatgcatatatgcagagtttggtttatagttttctgtacttcactgtctctgagggcagtctttttgccctgtgttagccttggattagagggtaacaacaatcatgtaaggctgtggttctcaagtgtggtgttagaagtgctcatcatcaggttccacctcagaaacagattgggacccagctatctgtgttttaagaagctttccagatgatttttgccacactttagggagagtcccctgatgaaatttatactcctgtgtggtccttatgcttcacacatcccatattgtacctttgagagaccacctgccatcctcttgttgtgacagtactctattcctcctaggctatgtcttgcccagccacgtgactgaggagatgctatgggagtgcaagcagcttggggctcactccccctccaccttgctgaccaccctcatgttctttaataccaagtaagtgttctagaggctccactgctggcatctgtccagtgaagagtgtggaagctatccaagaggccttctgaattcctctgacatatatttgagaaactgggctactgaaagccctaaccccacttggctgcattttatttggtaaccagtgaggcaaacacccttgccagacccctaccatccatcttgatgtggttcctgcactggacactgcttgggtacgggcctgcccagatcttgggaatgtgggcagtggctcctctgaagcaccagtgggcagaggatgagtcatggtatcctcccggcacccctccctctgccttgcattttacttgtgatccaggtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaaggtagggaaaggaggcagggatggcaaaaacaggtgctacttgtcctgccctgtcctgcccttgtgcctgtgaggctagtgataagtgtaaaggttgggatttgctggataaaattctccactcccttctccccagccaaaaattccaaactttcctcctagaagcagagaagccccagacagaatagctgcctcttcccttagtagtcactgcccatgcctcataccttccctcccccgaccctgtatttcctagttgggctggctgaaagcctaagtttcctgatctgggcctgaggtaaggcagtctgatgccaggtctgtggtggtggggatgtgtgttttatagttacagatgacatgtatgcagaacagacggaaaatccagagaatccattgagatgtcccatc

SEQ ID NO: 105738 - DNA, 1039 bp, Homo sapiens
aaaattagctgggtatggtaatgcatgcctgtagtcccagctacttgggaggctgaggtgggaggattgcttgagccccagaggttggggctgtagtgagtcatgattatgtcactacactccagcctgggtgacagagtgagaccctgtctgaaaaacgaaaagaaaaaaaattagctgggtgtggtggcacacacctgtagtcccagctatttgggaggctgaggcaggaggatcccttgagctcaggagtgcgaggctgcattcagctatgattgtgccatcacacttcaatctggtctacaaagcaagaccttgcctcttaaaaaataaatacataaaataaataataaaataggaaaacaaacattattcatcctactacctaaacttctattacattattggtaattaccttgactttttttttttttttttttttttgtaattcacaaagcatttatgtaacacttttctttttgttaaacctgattttcatgaaggtaatttattcaaaacagagtcttgtgccagcatagaggttttcttctcattgttccctgcactaactacttatttgaaggagtctagctagaataatataccaatgtagttaggttttcaggacatctgtggtgaagcataacagaaatttgcagactggcagttcaagggagcagaggtggatttcttagtgtttgaaggctcttgaggagaaacccacagtataatagaatagggcttactggttgggacttattctgttgcctagtcttgagaaatgtctgcctcctagttttttcctctcttggtggtcctaacctaagtactatgtgaattgctttacatgctttcattctttgctctcccagtcctggaaggcagataccatcatctccatttacaggcaaggaaactgagtctcagaaattaaaagacttgcacatgttgtttaacttatacaatatctaatggaaggctgaccccagagcctattcatgatttttgctaacacaaaataatgcctttcttgggtgaa

SEQ ID NO: 105739 - DNA, 1754 bp, Homo sapiens
taaacccaggtactcgggaggctgagacaggagactcacttgaacccgggaggcggagggtgcagtgagctgagattgcgccattgcactccagcctgagcaacaagaggaaaactccgtctcaaaaaaaaaaaaaaaaaaaaacatttaaaagtgcagccaaggctgagaagcactgcactagcccagttgcagtgctgcttttgctgtccctggggcaagaggtagaactccaaagcttcttaaaagtaggacagcaatgagtagagaaatattttcttaaataaatgaactatacataacatttttctggcaattttgcagaaggatctaatataaaacaatattgacacattttcatggtttctctcctataggctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggagtgagtgtcttggaagaagagtgggctgtgtctaaaatgcaatggtactaaagtaacaggaggacaaaatgccagaaaagtggtgtctcctgtcttggggacaagagagcaacatctgtaatagtatgttgaattcaagcctagtaacaagcagtactgaccttgtgtacataataagcaggatatgtggggtttgcccaaaaccaggcatttttagacatacgggtttcaggagttgaccctaccagacctaagcagagtggcttctgggaggaaatgggaaccagggataggcactcaagcccttctttcttggcattaggctcatatactcatgttataggccagttctgacattacaggcatgaaacattctagtagatacaagtgagcatttctatcccagcaccctgatgggcagtatctgttctgagccttccagatatggacccccaggaccttcattcatttttgaggcttccgttgcagggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaaggtaggaaacagatcttcacaagaacatgtttgagctgtgttcctattggatgtttgctagtttagttaataaattgataagcaagaagttaaaataaggaagttctctttcaggtatacagtgagttttaaaatacacatttgttgttttttttttttttttaagttttaaaaacctacacgttcactttagaaaataacagccggggccgggcgctggtggctcacgcctgtaatcccagcgctttgggaggccgaggcaggtggatcacttgaggtcaggagttgaagacgaccagcccagccaacatggtgaaaccccatccactaaaaatagaaaaatttgccaggtgtggtggtgcactgcctataatccctgctatttgggaggctgaggcatgagaatcgcttgaacccgggaggtagaggttgcaatgagctgagatcacagcattttactccagtctgggtgacagagcgagactctgtctcaaaaattaaaaaaaaaagaaaagaaaagaaaaaaaataagagccaggcaagatgtctcacacct

SEQ ID NO: 105740 - DNA, 1057 bp, Homo sapiens
agacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagtaagtgaagacttatcagtagggcaggcagcctggtccctcagggcccagtgcagcacagagcttgcctcgcaacctctggcttatttactgctgttactcttacagtgatgcagtatttagtatttgggagaagagggggagaaacatcacgtgaggctatgcaacagaaaaaagagtttatcctggtacctggaggtaaatgagatggccaggaattgctttggagttttggagacattttgggtttaagtaccatggacacttctttgtaatctcttctcaggaagagtaaagttacaggtgtagatgaatgggacacctcaagtgtgtcccagtgctgtttccttgtatcataagtaaatggttttagcaaaacacttgtagtttatcacatagattacaaactcatcactggagaggctgtgagattgttcattctgtttttcatctttgggcacacagtgtgggtgaattagaaaagctaaaataactcataaggagcctgttaaaagtgatcaccattgggaggcttgaatatgccgtctatgtggtgggacctcccaagagtttttgtgttacggg

SEQ ID NO: 105741 - DNA, 1017 bp, Homo sapiens
ggctggcttcaagaattgcttgagcctgagaggtggagattgcagtgagctgagatggcaccactgcattccagcctgggcgacacaatgagaatttggggaaaaaaaaaaagaaccaaagttttgatatttccttgttagactccagcatgtctgtaatcccagctactctaggaagctgaggcaggagaatcgcttgatcccagcaggcggaggttgcagtgagctgagattgcgccactgcattccagcctgggcgacagagcgagtccatcttaaaaaaaaaaaatttttttttttggtatttcctttttaggccccagttaattgtcttgcttgctctctggggtggatatatgtccctgttattgtaatgtgctgctggacaatcctggatctagtcttacgtattgtgtccttctcagaagccttgagtatgccagtgttttctcacattttgcaggtcccctgtctgggatctcttttctttctttccttgggtactggattttcagtgctgcctggttcactcactgatgaatcttgttgcttacaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtc

SEQ ID NO: 105742 - DNA, 1031 bp, Homo sapiens
gctgggtaggaagtgtgttttcagcctgtttcatccagtattgtgaagcatgtgtttgtttttttgttttcagtgtgatagttttatttaagaaatgttaatagaaataattttcaaacatccattaattgaaaaaataaggtggtataataaaactttattttttgattctatatgtatacagctgccctgaatatattccactcttgtgcaagggtaattgcttctgggcatttcctgctaaaaacagtaacataattttgacttctgtttatttctaggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtatatgggaaatgctgaggtgcagcctgtttaatgtactttatttgttgtcagtgttttagttagtgggctcatcacatctatgtggatgttataggttatttaacactaagattttcaaagttaatgtggactaaaagttttttctttcttctcctttttctttaagcttttttttttttttaaacaaaccccagtgtcaaggactgactttgaatagattgcagccagggatctgcttagctacctaggaaaccccaacccagaagcgggtcatctatgattggtttagcatcaggttcaacgtgacttgcgtgatgagtgagggggcgccacctttctggcagcaccttttcccaggatgaggggctctccacaccggaacccggtcccggcacgtgaccccgccggcggcgatgt

SEQ ID NO: 105743 - DNA, 1031 bp, Homo sapiens
atgctaagctccagtaggaggaaatacagaggagccaggcgcagtggctcacacctgtaatcccagttttgggaggctgaggatcacgaggtcaggagatcgagaccatcctggctaacacggcgaaaccccgtctctactaaaaatacaaaaaaattagccgggcgtggtggtgggtgcctgtagtcccagctacttgggaggctgaggcaggagaatggtgtgaatccaggaggtggagcttacagtgagccgagatcgcaccattgcactccagcctgggcgacagagtgagactccatctcaaaaaaaaaaaaagaaaaagaaaaagagggagatacagaggagataccagtgaacaatttgattttataccagcaaaaatgtccagggtctgtttaagggagggctggctttcctttattgttacttatttttttttttttacaatgcagctatatttaaaagcgtttagaagtaaatgcttgtttacagacctcatacaccccaagagcattagagtattttcttttttcattattagtctcatcagagtcccagaaattgggaacactcagatatcctcatggctgcatgtttttcagaaatactttaattaatttctttattgcttcttactaagtcttttacttggagctaattaagaatcttttgtctcttttagaagtttctccatttctctttattacgaaggctcaacttttgtgtcttatgtgcagcatcttgaagttaagtcttcattattttgtacaagtttttggtattttatggtttagtttctttttcttttttttttttttgagatggagttttgcccttgttgcccaggccggagtgcagtggcatggtcttggctcactgcaacctccacctcccaggttcaagcgattctcctgtctcagccttccgagtagctgggattacaggcacgtgtcaccacacctggctaattttttttgtatttttagtagaggcggggtttcatcatgttggtcaggctggtctcaaac

SEQ ID NO: 105744 - DNA, 1660 bp, Homo sapiens
ctgtggcccgtgggcaaccgcggctttctggagcgcgcgcccgtgacgacccccagttttggggcgcgcgctctgatatcgggtggcggtgctgcctcgagagcgcgcaggaggcttctgctgagcagagggccggccgcggctcgttgcgctgggaaggttgaggattgggtcctttctggtctggtgacgttcccgggcatccgtggcctcggcctggagagaaaccaaccagctttgctgtctggcttgcggttccgctcctctgtgaggggggcgagattgcccgttctcctcgaagaatgccgttacttgaggcccaagtacggtgcgggtgcttgggtagggtgtttctctgcttcggaaaccaagccctcttggtttgagagggcagtgagccccttcggatttcctcaccttgtactgggctttctgccgggcagggaaggttaatattagaaggcccttgagtggtacctgcttatctttcattagaaactaatacgtccataagcgtaattcatacacgtcacctctgtgcgctccggaagggaattcgcttatgtggcccatgtgaactccgagctctaaaatgccagtttaaatccttaaacgcagcttttcttttgcgtaagtgggaggggcttactttattatattaaaggcccacctttgcctcagccaaaaagttggccttaaacaaaatggaacaacctgagaatcagtgctttaccttttttgaaattgcagaaatcccagcagaaattactaaaatctgatagtgtatcactgtaaaagtcacttttggtgtaggatttcagtccttttcagctctttttttgaccctgccgctgtgttttggtgtcaaggaagttctaggtttgttctagagaaataggcacctcttttttctaatacaaaacatctgctagtttgatttacagtcttgctcaattaagcttaaggaataggaagctaagaggaagtaaaattagccatcaaatttgataatggtggggtagttctttctaatgtactgtattgtttttaagaacaaagttaaaattattaataaaaagaggctgaggatggaaggaacttttttgttctatcttcttcagaatattagaagtcttaagaactcaggacaagcagcagaaatacatgcaacatggtgactggtgagttaaaattgttcatatcctggaagtatctgtgcacagttttttttctggtaatactgaagcattacaaatcctgtcaattctgggtgctgtcttccagaaactattaggtgctgtaaaatgaagatgtgggagaacggcatctttgaattcagccacagttcgctacttgctcagttttctcctcttaggatataagtcagtggaacccgcagatttaagcgtttgcaggctcagcttttaaacggacctaaatggttcaaagaaaagctgtaaagtttttctaggatacacttaaaattttgactttttttttttttttgagacggagtctcactctgtcacccaggctggagtgcaggggtgtgatctcggctcactgcaacctccgcctccctggttgaagcgattctcctgcctcagtttcccaagtaactgggattacaggcatgcagcaccacacctggctaattttt

SEQ ID NO: 105745 - DNA, 1065 bp, Homo sapiens
cctcggcctcccagagtgctgggattacaggcgtgagccactgcgcctggcctaatttttgtatttttagtagagacggggttttgccatgttggccaggctggtcttgaactcctgacctcagattatctgcctgtctcagcctcccaaagtgctgagattacaggcgtgagccactgcaccagcccaccctgtctttcttactccttaaagtagggggcaaacatggtggttgttataatccatataaaactataccctggacccccacggtggttgttatggtccatataatactatagcctagagccccattcagtcccttacccaaagtcacaaagttattgaggacccgggcctcctgacccttagtccctcggcttctttggcttaagaaggatgttagggggaggtgtctgtggtgaaacctgcccaggcctccctggccttgttctgggttggtggtcatccttttccctctgccctccagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagagtctgtgtgttatctctgcacttctagcatctgaaggccctgaagacatgctggtggtggtggtatgattgggggatggagatgtgccttttgcacattttgtctgtgagaatggactttcccagaacagagtggtactgacagctttgaaagcaccggtgcactttttggtgcttaaaggcaggggcctgggtaggattcataccctccgcacctggtctgagagaatggagggccctggggtgtttgtccatggttaggacccctgtgccagagggatctaaaaggtttgtttctgctggtgtggagaggcctagctcccagtctgatcattcagcatataattttttttttttttttttgatacggagttccactctagcccaggctggagtgcagtggctcaatcttggctcactgcaacctc

SEQ ID NO: 105746 - DNA, 1248 bp, Homo sapiens
cgagccatggctgtgctggagtcactacgggtcatcatcaccaactttcctgctgccaaggtgggcctgcctcaacatgtgtgtcacatgtgtgtgtgtagctgggggtacacttggctctgggcatgggggtcctaatgctgagtatgactcatacctgtctcctgtctcctgctatagtccttggacatccaggtgcccaacttcccagctgatgagaccaaaggcttccatcaggttccctttgcacccattgtcttcattgagaggactgacttcaaggaggtaaattgtgggggtggagggtcccgtttgctgctgagtctggtactgggaacctttcatctcctcatctctgtcagtccatctacttcctgcttcagatgaaccaatctttgccagacacgggggtagggaagcttccccacttgtttgacccttgcagcctcatgtgtctaccccacttcctatctctaggagccagagccaggatttaagcgcctggcttggggccagcctgtgggcctgaggcatacaggctacgtcattgagctgcagcatgttgtcaaggtgagagccagctgcagccttcctactgcagtgcctgctggggccaagatgtgagtatagcctgcagtcctggttgtggttcccgggtctaattgctgctcccctccccccacttccagggccccagtggttgtgtagagagtctggaggtgacctgcagacgggcagatgctggagagaagccaaaggcctttattcactgggtgtcacagcctttgatgtgtgaggttcgcctctatgagcgactgtgagtgaacagagctggggtgggggcaggtacaagatgcacattgcctgctatggctgcccagctgggggtatgaccttcactttggctgcagattccagcacaagaaccctgaagatcctactgaggtgcctggtggatttttaagtgacctgaacctggtaggttcatgaggtttggggtgagggaggtaggcctccctggttggatggttgcctgagttccctgcctgcaggcatcactacacgtggtggatgcagcattagtggactgctctgtggccctggcaaaacccttcgacaagttccagtttgagcgtcttggatatttctccgtggatccagacagccatcagggaaaggtgcttgactttactcacctgccctcatctgcagcagtgacagtggctgccgttcattgtgccaagtgct

SEQ ID NO: 105747 - DNA, 1241 bp, Homo sapiens
caacatggtgaaaccccatctctactaaaaatacaaaagttagctggccatggtggcacacgcttgtagtttcagctactgggaagctgaggcaggagaaacccaggaggtggaggctgcagtgagccaagatggtgcaagataatcaagactccatctcaaaaaaaaagaaaattctgacatgagagtgctctgtgaatatcctagtttgataaacaggattgtggggctgatggatgatgtgggagttcacagatggtgcaactttcctaggccaacaatggcatctgttttctgcgttttgatgacaccaaccctgagaaggaggaagcaaagttcttcacggccatctgtgacatggtagcctggctaggtatggactaggcaaagcctagaagggctggtggttagtgggcctctccttgggccatggcctgcccactgggtgtttgtggctggctgctcatactttgtttcattttgccccaggctacacaccttacaaagtcacatatgcgtctgactattttgaccagctatatgcgtgggctgtggagctcatccgcaggtaaggccagggccatgacgtagagccaggcagactgactaggtcacagccatgctgggcactcacaccgcttccccacaggggtctggcttatgtgtgccaccagcgaggagaggagctcaaaggccataatactctgccttcaccctggagagaccgtcccatggaggagtcactgctgctctttgaggtggggtcctagaggagcatctgggtttgggtgggccaaggtgctgagaatgagatgctcctgtgcttagagacagcctgagtccttgttcccctcaggcaatgcgcaagggcaagttttcagagggcgaggccacactacggatgaagctggtgatggaggatggcaagatggaccctgtagcctatcgagtcaagtatacaccacaccaccgcacaggggacaaatggtgggtgtagaatggggtggggtggtggggctgccgagcagggcgatgggccatggggtagggcagagtagggctggatggtagggcccactgcctatgccccacaggtgcatctatcccacctacgactacacacactgcctctgtgactccatcgagcacatcactcactcactctgcaccaaggaattccaggcccggtgagggagctgggtccatggggtggtagggccagtggaattccagcagccctt

SEQ ID NO: 105748 - DNA, 1201 bp, Homo sapiens
tgggcatggtggctcacacctgtaatcccaacactattgggaggctgaggtgggcagatcacctgaggtcaggagtttgagaacagcctggccaacatggtgaaaccccatctctacaaaaagtacaaaaattagctgggtgtggtggcgggcacatgcagtcccaggtactcagaagggctgaggtaggaaaatcgcttgaatccaggaggcggaggttgcagtgagcggagactgtgccattgcattccagcctgggcaacatgagcaagactccagtctgggcaacaagagcaagagcattttaagctagcagacccacatgagaagagatgggatgggctaggtaggttttttcagtcagtgctggtagataggccaggaagccttgggttggtgggtaggatcagtcaggggctccttgaaagaggatactcctgcctctgcctgattctggtctctgctcaggtcctccaccttctgggccccaagttggaggctgatctggagaagaagttcaaggtagggatgggcatggccctgagtccctgagggtgaggtgaggtatggtgagacttcaggctggggaaggaagtgtctgaccacagggatcccaagaccctatccaagagaaaatttgatgccattttctgaagcacctggggcttctttcaggtggcaaaagctcggctagaagaaacagaccggaggacggcaaaggatgtggtggagaatggtgagaagcttgagactcctgtcacagcattcagctccctgacttctgaacctcctcagaagagtccttacaggctcctcaggcccttggcttactcagtaccctgacttctgtctcaagactgggattcctggtgtttcttttgttccctttgcccagagactggcatgagaggcctcagatgtctggctctagatatcttgtctctggaattgagggaataggggtctactcagttctgttctggctgtaggatatggtaaatgtatctagaggacaagttttccttgttttgttccccacaggcgagactgctgaccagaccctgtctctgatggagcagctccggggggaggcccttaagttccacaagcctggttagtgggcatgtcaaaaccctggggagggctggatcttggcagcagctcctatagtcaggcccctggggtcagaggctttggctgc

SEQ ID NO: 105749 - DNA, 2096 bp, Homo sapiens
ctctacgatggagtctggatgagggatttcctgggcttcatttgttcaactgtttccatgacaactccaaagctgtggcgtcaaaagcgtgacagggactcgcatttgcccccgaggacaattactatattgagatggagttaccagggctgaagtagaaaagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggtgcgagcccctctgcccccggcctggtttgcagaccatgctgcaacgcagcgcggggcggggtccagatcccgacctgccccgtttgtcccgccctttcctctcactgagcgcggggcttctctcttgacccctctgacctcaggctcagcagaccctgggttccaccattgacaaagctaccgggatcctgttatatggcttggcctcccgactcagggatacccggcgtctctccttccttgtaagctacatagccagtaagaagatccacactgagccccagctaagcggtgagacccctacctgtcctgccagttcgcaccaatgcctcccttcagccaagacccctgtcttccctttttgccaagtcctccagtttctttctagacacctagttctgcacaggcactgaggcatggaaggggtggcctatggtgagactgacacgggaactgtcagggtctgaggggggatccactctcgacacgtgcttctttcttccctgtgttctctagggtggtggtgccagggcttaacttttcaggaggccagactatccttggagtttcatgagattaggaccctgtctgtccacttcttggagcagagatgccacaaactcacgggctctttcttctcagctgcccttgagtatgtgcggagtcaccccttggaccccatcgacactgtggacttcgagcgggaatgtggcgtgggtgtcattgtgaccccagagcagattgaggaggctgtgagtctttccccaggcatcgtctgcctccccagtcctggccatggaaaggagtggctcagtttccctcctcaggaagacccagagtgagggtgtgggttcccagaatatctctaaaggtggctttcctgaaccacatggtttggctttctgcaggtggaggctgctattaacaggcaccggccccagctcctggtggaacgttaccatttcaacatggggctgctgatgggtgagcagggcctggaacggggctatattgttctctctggtcatgccttttcttctgggcacgagtgagaaggaggtgggggaaggaacaggagtgacttaaagtggtctggctgggctcaggctctggttctggtggtcagccaggacctttccttgggaaagaggtggggggagtactcttttttgcctttctgcagctccttgtgcctatgcttctaggagaggctcgggctgtgctgaagtgggcagatggcaaaatgatcaagaatgaagtggacatgcaggtgagcgtgcttcactaagctgaagctggcaaagactctggcatgaacagagcctggaatccactaagggataaaaggcaggaagagggctgggcatggtggctcacgcttctgatcccagcactttgggaggctgaggcaggaggattacttgagcccaggagttcaagaccagcctgagcaacatattgagaactcctctctacagaaaat

SEQ ID NO: 105750 - DNA, 1094 bp, Homo sapiens
atctagaatgcagggtgttagccccagtcaccccaggtgggactgtcatggctaagggtctcagggacactgggtcctccccacccccggggtgctgatggccgtttccacataccctaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggcccaatctcgtctctctgtctcaacgccgctgctgtctgcgcctgccttgggaccctcccttgggtgccagggctccaagccagcacccccgggatgccaggcggcatgctgggcagcccccaacccctgtcctcgtattctgttgcagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcaatgggaagctgaggggtatgatttgggtgtggagacctctcaggttgggacttcttgtcagcttggacccctgaccagtgggctttggcttctccag

SEQ ID NO: 105751 - DNA, 1097 bp, Homo sapiens
cgcctgccaaatgttctcatcgtgcagctcaagcgcttctcctttcgtagttttatctggcgtgacaagatcaatgacttggtggagttccctgttaggtaagcagtggaccttggtaactgtgggtggggtgtgaggaccaggatgggcatcctgagcgcctgttgcctgtctcacccctccctgactggacctgacctgcaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggtgagggcacacacagccagcaggataggtggtaggggtggtggtgcagactttgttcacactcttcccaccctgctgtaggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggtgaggcatgtgggaggctttacagaatactgggggacagttcacagactggggccgggttgggggatatagcttcctctcctccagccacaggcccattgagccttgggattcatgagaattgcagagttctcttaacatcaaagctttagccagaggcatccccatgccttggggacactaacaaacatacaagtacactaacatgctgccactggcaagcacattggcacctacttggcacaggtcaggcaactgctctgaacctcactgggcactatgctgtgaatgaactatacctgacactctcctagatttcctctgcacattccccacatgctggcccacacaccctcacttgtgatgtccctgagttctagtgtgcactcaagacaaggcctatttgggctggccatggcctctggtggctgttatactctttgaggtaagcatctgtctttgctgagccttc

SEQ ID NO: 105752 - DNA, 1008 bp, Homo sapiens
attggctaccccttcctggtcagtgtacctgcctcacgcctcacttatgcccgcctcgctcagttgctagagggctatgcccggtaagtgcccagtggttggactagagtggtgtaggtgggggcagaggtgctagatgggctggtcaggagtcttacttgcgttgttctctgttgccaggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaaggtaagatccagtgaaaggctctagaagctggggaggaggataagggaggatggagggggctgttgtttagggcctggtgggcctggtgaggccctgatgggcagggaagctttgattatcatgttctcacacagctgctgtgcctgggtaccagcatccaagtgaagctatgaatgcccacacaccccagttcttcatctataaaattgattcatccaaccgagagcagcggctagaggacaaaggtgtctgaggctgtgggtgggagccatggggtgggttgagctggctgttctccacagctgcatgacctctctccctgcgaatctccaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctctt

SEQ ID NO: 105753 - DNA, 1476 bp, Homo sapiens
cctctcattccccctttttaaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcggtgagaattctggggtgggaaggacgaagaatggaggctggagagtcttggggctgttctctcatgtcgtctttgctcctgcagcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatggtgagggcagggcctggagcctgggttatgggcagagagagtgcctttgttcctcacacctttgctcggctactattcctagaccgctcctttgaggctgagatcaactacaacaacccactagggactggtgggcgtctggccattggctttgccgtgctgcttcgggcgctgtggaagggcacccaccatgccttccagccttccaagttgaaggtgatctgtgaccactgtcacccttggctggagggggcggggagggccagccagctgggtgtgcagtgggtgctagggcttcatgttcacaccttggctcctgtatccaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtcagggttagggacagagggtgggcatgtctcatgagcatcccagcccctggtactctttggttctcaccactctgcctctcaggtggtagctgaggaagcatggcagcggcacaagatgaggaatgactctttcatcgtggacctatttcaggggcagtacaagtcgaagctggtgtgccctgtgtgtgccaaggtgtgatgggctcccctggaaagagaccccctagttcagctcagctattctggtcacattaggttcagaggcatgtgcatcttaaggtgctacagggcaaggtttgggcaaagaagctggcagggaggccttaggattctatttgggctgaagagcccactcagggtaggcttcctgactgagggaaaagtgatgttagagctcaaaggtgttgtagcagggttgtgggcacatggggtgcaagtgtgaggccaattcgtaaagtggctaag

SEQ ID NO: 105754 - DNA, 1039 bp, Homo sapiens
tgtatctttggcagaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggtgagagctgggcacctgtttgggtgttaggagatggggggaaagggtgtgcactggagtgggagccacctggcagacccagggctgattctttccacaatcttgccattaataggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatggtaaaggtgggggtgggcaggcagagccctaggttgggttgcaaagtttgtaggtggatagagagtagcaataggctggaacctgtcctggttggggctgagccatggtctcaatatagagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccaggtgggtgggtagatgatggggcaaacaatgcctcaggtgggacagtatgtctcatgctcttcctcttgtccttcctcctatcctgctgtgcctctgcagggatggaaacttcct

SEQ ID NO: 105755 - DNA, 1354 bp, Homo sapiens
gccttcctcctccaccttctatttctccagtggtgactaagcagccagtgagagtgaaggaaaagtgagcaccctgctcggagtgccagccctgtgggctggagccgtggctcctctccagattggtggagtagcctggtcccaggccatgacttccttgacctggtgccccctcagtgaggctttcacctgtgtgggactgttatggtgggtatctatgaggcttggccagaagtggttgctgctacttgcattatttattacctcttcagaatatcctgagagtgtccaggggtacttaagagatgagaagatacagctctgtagcattagtgtcctgtgttgctgagccctgggtgtagctaaagagcaagttgttgggtcttggcagtgatcactggcttctttccattaggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaaggtgggagtggcattcccagagtaattgtggccttctctgcctcccatcttattggtatacagattggggtttgggagatgactttcttgttcttctctctgtcctggtttgatgatgagagaagaaggacccatgataacctcagtagagcctcagctttgaagcctgagtacttggctaagatccagaagatggtgctgttggggggcttgccttctttcctttttaaacttttttcttttttttgaacctgttctttttttccttttttttttgagatggagtctcattctgtagcccaggctggagtgcagtggtgcaatattggctcactgcaacgtccacctcctggttcaggtgattgtcctgcctcagcctcccaagtagctgggattacaggtgcatgccaccacgcaaggctaattttttttttttttttgagacaatgtctcactctgtcatccaggctagagtgtagtggcgtcttggctcactgcgggctctgcctcccgggttcaagtgattctgctgcctcagcctcccaagtagcctcagcctcccaagtagctgggattacaggtatgcaccaccacactcagctaatttttgtatttttagtagagacggggtttcaccatgttggccagactggtcacaaactcctgacctcaggtgatcc

SEQ ID NO: 105756 - DNA, 1221 bp, Homo sapiens
tggcaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcaggtgggttgaggcagagccagctggagaaggtaggggtggaagatgggcctccactgagctaccacgctaacctaaccctctacatctgcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacagggtaagaaatggggcaccagagacacaagactgcgggaaaccccccctaaactgacacctgcccttcctagaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccactgtgttgtctggactctgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggtgagtggagcaggctgcaactcgctggcttggccgcagcggggaggccgcaacgcgcggccgcggcggcctgttcaaggtcacgggccgtgccagtccctacccctagt

SEQ ID NO: 105757 - DNA, 1020 bp, Homo sapiens
gccaatggcctggttgctgggagaaggatgggggaggcccagatgatttgtacagggcccctagatgacccactgcacctgtccccactcgcccccaggtacttgatatttcctaatcctgtctgccttgagcctggtatctcctacaagctgcatctgaagctggtacggacagggggaagtgcccagcctgagactccctactctggacctggcctgctcattgactcggtgaataatctcctcttgcccacaccaaccaagatggcagggcccgtggtgtgggacttgagggatagcaggggtctgtggcagaagaggcaggcccatggtggtgccagggtgggcaggcttgtggcagtgctaaggcaagtgctctggcaatgcctacgtggtcccaggtctgaactgcgatcttccttgctcactccttcagctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgcgtgagtgtctgtgatgtgggttgatggggcagaggtggggacccagcctgacttggcccaaccctcctccccacagcatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaaggtactcttctgccccttgttccctcctatgcttctctctccttcccattactgttctctctcctccttctggacctgctgctggtttcctcaaactaagtcttggaccctctactctcaacctgggtcagttgtagttctcttccatttcctgaccttcccacctagactc

SEQ ID NO: 105758 - DNA, 1678 bp, Homo sapiens
cttgtggccttcctgcagggcctgcgagatgatggcttccaacctaccatcctgcgcagtggtgatgtctatggctatagttcatgcacagctaatcccccaagccagacgaaactgcaagctcgtgcccctaacccaactgccacatcacctccagccagtgctccccgaactgccatgcggttgcctgcaggtcgggccacactgcttcccatgccgctatctggcagactggccaaagcatccacaccagcccttgccaagcatgctaccaccaacctgctgctgagctctctgaagcaatcaagtgccagccatgcccggggtgcagcagtgggcttccccacccacctttatccaggtgtctaccctgccatgcggctctctgttgtccttgaggccctggttccacttaagactcccatgccctgcttgggtgccaagcacaaggcacagtcactgcagctctcacttgcagactctcctctgaaactgcggaaaagttcagggaagggtccggggaaccctcggcccaaagctcccagaaaaaccacaagcaagggccccaagtgtctgactcgcaaaggccctggggctggaccccgacgaggctctgggcaccagagcaaaaccaacagagccactgggtcccccagtgtccggcgaatgaaagggggctctgccctgggcaccaaaacagcccaggccaaggtagctcgaacactggccaaagctgctcgtgcccaagccaaggtggctcgaacacaggccaaggctgctaaggcccgggccaaggccaaggcagcacaggtcaaggctaaggccaaagctaaggcagcacaggtcaaggccaaggccaaagtcatggcagcatgggccaaggccaaggctaaagccaaggcagtacgggccaaggccaaggtggctcggacccagcccaggggcagaggcaggccaaagggatctgctaaggccagaactacaaggaagggccagaaaaaccgccctgagactgttgggcagaagaggaaaagggctgaggaggcaaaagatcttcctcccaagaagagaacacggcttgggccccgatctcctaaggcatggctagggcctggaacagcaaagctgctgaagttccgtgccataaaggtagataggcggtcctcggatgatgaggtgcggcagcgggctcagcggatcctccgcgtgaacctgtcacctgtaatacggctccagccattgctgccatattcagcagtctgattccttcacacggcaatgtttggggaaactaagcccagctgtctgtgtggctagtggcacagtgtgctatgtccgtggactccacaatcttgaggactcccggtgcctctctagggccctggtgaccaccagcctcctttcagaaaccagagtgggtggggtacggtggggtgggtgggcgggaggggtgttttcatggcgcgatgcactgtgacttgttattcaagttgtatgtctactgttccatctatcacgttttatacctttccaccttccagtctccctgcccaccctccatggtcttctgtgtgtgtgtggctgctggcaggccagcttgaagatatagggaaagtggtcccagaaataggcctgcctatttccgggggttgtgggaggaggcagctcctgggcccct

SEQ ID NO: 105759 - DNA, 1242 bp, Homo sapiens
cccgggggcacgtgtgaagggaagtcggaggccgggcaggagcctctgtttccgaagcttctcgaaagcccagaaaacccctcccaagagcccagcctaacctgggtggaagagcccccaggtcaccccaaatatttgcgctggggcgcgtgtgagggtgggaaataggtccctctctcttctacagttcacagctctgggaactacatcccttcaaaaaacattaataaagaactaaagtcatgtgcaaggattgtgcttggagaacggtctctggggaggggaagtgcccaagacacctgaggatccaagaatgtttccaaacaaagagccctagggcatttcctccagggtattctgaagacttcatctgctgcattagagcggtgggaagaaactacacagacgggcctcatggcccgagggacctgcctgatcctggctgatcttttaatgctctggtgcagctggggagctgcctcttgcttctgggaaccctcagtgttgggttgggtattagatgttagttatgattgatgtccacagcttctttaaagaagtctgggagtagttaggtgttctcagtcacctccatctgggctgtactgaggtctgtggccctccaagtcttaggtaggacagtgcataccgctaatgtccccttgactcaccatcctacttgcagcctttggctcccattgtccttaaactttgggatcttggtctggcttcctggtccctggtctgcctggttgcctagagagatgtcattggcacctgctactcatcagctttttagtttctgttgaagaaaagtccgactcttgattaggtctccatgcctctggagctagaaaatgggttgctgagtaccctgtctagagactgaaaacagaacttctggtgggcagggagattcccccaccccactccagctccacacatgaacagcagcagctggagaaacagatgggcatggacagtgggtgtaagtctgggccctttggctaacattcagggttctttgttgctctatcctcgcctgttttttcacctagatcccagatcccacaccaagtatgccttaaccctttctcactttggagccattgcattagctattcccctttttgttccatttccatctaatcatttttcattcatcactcatatcctagctaggtgttgtctctcccaggaatcctttcctgacccattggcaaactgagctgaatgccagca

SEQ ID NO: 105760 - DNA, 1008 bp, Homo sapiens
agtccacatcaaacttaccaatatgagttcagttcactagcagctgagcaacagcaatttgagttaaaattatgattatgaaaactttaacacatcatgtcagaaatagcataaatggttctctgttcttgcctttaaatttatgcaattgattctaagctattttggttgacatttaaaatatctctgggctggtaaggcaaaaatctatattaataaaaacagttgctttattttaaatataattttctggtgtatacaaagataaaatggaaatactacttgctatgttacgttacagcaatatggtttgcacttaaatgtgactctgcattgtacagaaaatagtgaatgctataaatatttttatgtgtgaaatgctatatatttttttcatttaacagggtgaacctagcattttcacaaagtaccagacaaagccccagctgttcggaggagatataaaagatggaggtttatttcctcctcctttgtcagttggaaaatcaaaaggcctcttggaacagtttgaggagaaaaagaaaagggcaaaagacaaatgtgacaggtatgtaaacctttcaaatggatgaaagaactcaccttttctgagtaaaacaagacatagagtgtcagtaattaaataattcaattttagcataatagcatgtattagagttctccagagaaaccaaaccataggacttacacacacatacacacacacacacacacacacagacacacaaacagacacacagagaaagagggagaaagagaaagagggagagagagaattatagattgattttttttttttgacggagtcttgctctgtcgccaggctggagtgcagtggcacaatcttggctcactgcaacctctgcctcccaggttcaagcgattctcctgcctcagcctcctgagtagctgggactacaggcgcctgccaccatgcctggctaatttttgtatttttagtagagacagggttttaccatgttggcc

SEQ ID NO: 105761 - DNA, 1076 bp, Homo sapiens
aggtttttttgttttttttttttgttttttttttttttgagacagggcctcactctgttgcccaggctggtctcaaactcctgggcgcaagttattattctacctcagcctctcaagttgctgggattgcaggttacacaccaccgctcctggctgggcagcagtttattaccctaaagaccttgtttccttgtttttttttcacattgtgtcttgtcatccctgagagccaggacaaccatgtacatttctataccctcccacttatacctttcttggggactggcatatagttggaactcactaaatgcttgggcctgaaaggaaggtaccaaacccaccttaatttggcagtctggcagcctgcctgtcctggggcaggaatgcctgcttttacacaatccctgataaatgacaacccattcatggtttttaacttgcacctgaaatgtcttcagaaaccttccactggaattgtaaagctgaatgttcttatttttaagaccatacaagcatccgaactattgaagaattggctggaaaaatagaatttgaaaacgaattgaaccacatgtgtggtcattgccaagattcacccttcaaagaggaagcctgggccctgctcatggacaagagccctcagaaggccacagatgctgaccctggcagcctcaaacaggcttttgatgatcataatattgttgagactgttctggacttggaagaggactacaatgtgatgacgtcttttaaataccaaattgagtaaggacagttatctaagctttgattccttacagcaggaggctgcccttgagcctgagcagaagcagctacaatggccgtcaggggccacatttctcaaaaggttggcagaacctgaattaccagaccctttttaaatcccagttgtgtccctttttaagctgtgagaccagttttttgaattccattgctttgaaatgtttcctattactgatttttttttttaactttccttgacatcttgaatgtgtttttttgattgatgttcaatatacccagtacccatggtaggtgtgggtcatgggcctctg

SEQ ID NO: 105762 - DNA, 1026 bp, Homo sapiens
ccagcctgggggacaaagcgagacttcatctcaaaaaaataaataaaaaataaaaataaataaataagtaaacaaatgcaggctgggtgaggtggctcatgcccgtattcccagcactttgggaggctgaggcgagtggatcgcctgagcccaggagttcgagaccagcctgggcaacatggctaaaccctgtctctaaaaaagaaaaaaatttaatacagtctgcgatgctcgtgagtcattatggtaaagctgttagtcaatttctccactgatgtagcagtttccaattgtcctttaatcaaagcataaatgacaaggtcaccagtaagtttttgtctttgagattatctaaaactgagtttcccttcaatattttcttgaaagagaatctaattccccaccttttcttcccccccacctgggggctgcaggaaagatatggagagagatttgaaggctgactcaaacatgccactcaacaattctagccaagaggtcacaaaggatctgcttgatatgattggtgagtacagtgggcaagtccatcctgtccttgggaagataggtccttcacatgggtctgagtcagcaaatatctcagatataagaaatgctctcggccaggcacggtggttcatgcctgtaatcccagcactttggaaggccgaggagatcgaatcatgaggtcaggagttcaagaccagtctaaccaatatggtgaaaccccgtctctactaaaaatacaaaaattagccaggcgtggtggtgcacgccggtaatcccagctactcgggaggccgaggcaggagaattgcttgaacccgggaggcagaggttgcagtgagctgagatcttgccactgcactccagcctgggggacagagtgagactcccatctcaaaaaaaaacaaaaaacactctcttctagcttgggtaccatacatagcgagatctgtctcttaaaattttttttaattagctgggcacagtggtgtgtgcccataatcccagctactagggagg

SEQ ID NO: 105763 - DNA, 1044 bp, Homo sapiens
tgggtcctgctatagccagggccaagctccaggaaatcgtggccattcaggggtagtttgcagcctcatttgtaacattattgtgttgtcctgtgcatttccaatgcattacataaagacatggtcgcttttaggagaaatgtctgaaaaactaagaagatgcagaaaggaactgactgcagccattgaccgggcctttgaaggagttagttattcccaggagtgcacaggccagcagaggctggaactgagcgccgcgccgctctccttctcgctgcccgtgcacaggctcctctgcagaagacatcctctggcagcctgctcttctgctgctccttttgctgctgtcccatgtgctcctgagaatgagaaccctgcctttgcaacaaaccatgccccggtaaatgcaaaaccacatgctctgtgccccgagagaaaacctctaaccagcaaggaaaatgtattgatgcattcctccattttggcacctgaaagagagtcttggagaactgcaggagagggggaaaactggagaaaagaaaatttaaggtgattctaattttgatggtttaacagctacaattaaggggattcttgtttctgaaaaagttgttgaagatcctagatttagttcatgacagtgctcttgcctcctcttggcagctctgtgactgcatttggggagttgacagacattcttcagaatctggcctaggaaacagttatattttgtgtatatgttccagttgaggggctagttgtcaatcgttgatgtcaaaaaccagtcatggaaaccactttgcagtacccaaaggggtagtggatgtaaaataaccgggttttaaaaataaccttattttttaagttgcagaaacaaaagtcttaattccatcttaactcctgtgtttgaatctggacactggggcctttgataccctcctttgcccacattagggagaggcttaattgaaggctgggccctacttcctggcttcatctttgcctctgctccccgctcttaccccagatctttttggaccatca

SEQ ID NO: 105764 - DNA, 1267 bp, Homo sapiens
aggccatgatatgtggttcttcctcatgtcgttatggattaaagctgggaagagcctctatcaggctagttggttatttcatcatcctgatgtgatagtgggagctaggtgtgacagagctggctggcattccttcagggaccttcataaatgagaagctcagctctcctcagagttctctgcacaaggctccttccatttcctgctgcctggcaggggcagccatcctcaggtggaagggtctcctctgtgtggatatggcagatccttgagggttttggacagctagagaaaagctggggaaaatgggtgatttttccaagcactgaatggtctttccccctcttgtatttcagactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtccc

SEQ ID NO: 105765 - DNA, 1017 bp, Homo sapiens
tgcgatcactttcaccagttggacagcaatttagcaagttatatttaagactgagaaggaaaagcacttcaagattttgtcattttatattcagaggctctagaaagtgtactacattccaggtgggagagcctctgtaggccttcatgtcttaatgcagtaagatctctttctccagcagaactgagtgctttgattcccataggcctacgagaagcatgtgagcatgttgcagcctcagaagaagaagaagaccacagtggccctgagagactgcatcgagctcttcaccaccatggagacccttggggagcatgacccctggtacgcagctcctcactgtctgggcagaggccccatgcaccccaggactcagatctgctagggccatctgtgcacataaacccctttgtatttggatgtgtcacttctttatatagctaaccctacaacataatcctctgtgagttgaggtttccaaggaaagccgtcaccccattttggaagacaggtccctggccagaagcagtagtgttgagtgctgaccgagaggatggcagctatcaggggactgcagctgtgcctccatgcatgagtgcccaggtggcactggctgccggcttgccctgctaagtggaggtttctctttttaggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcaggtgggtcatggtgactacagtgttaggaacatttaaaaacaggcagaaaatcttggcactgattggctgagtggtttgccaccaaaaacttttctgagtaaggatgtgtgttgccggggtctaggaggtcagagtttagctgtagttaccccttctgtccctatcctcccatctttggggaagagactctccagtggaagcatttgcccagaca

SEQ ID NO: 105766 - DNA, 1003 bp, Homo sapiens
tttgatgacaaaagatgaacttggtggctggacccagctgtgtgcctttgtgttcagagtgatgatctgaatgatggctgttatctgtgttgggtcccagttgaaggaccacagagtttgaggccgtggttggaagaaggagtatcacggttagccctcagccccaggttgtataggttcacattgtgctgacaatggtccttctagggattcctgactcaacctctagaaacgtcttggcaatagttatagccaccttttctactcaaatatgctctgtcccagtaatcatagccctggccaccacatagcttcagctcagatctctgttgttcacaaggacctactgctaaaagtgccctcttgtgtgattgacgcaggtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcaggttggtggcaggaatgtgatttggttgttatctgagatgaagatatacccagtaatagtagtggcaactcctgccaagtggctgtgttgatcctacatgctcacctctgtaagaaatgcatttgccgggtgcagtggctcatgcctgtactcccagcactttggaaggccaaggcgggcagatcacctgaggtcaggagtttgagaccagcctggccaagatggtgaaatcccgtctctactaaaaatataaaattagccaggcatgctggtgggtgcctgtaatcccagctgctcgggatgctgaggcaggagaatcgcttgattcttgattctcctgggagctagaggctgcagtgagctgagatcgcgccactgcattccagcctgggtgacagagtgagactccatctcaaaaaaaaaaaaaaaaat

SEQ ID NO: 105767 - DNA, 1046 bp, Homo sapiens
gtagtcctggccttgtttgtcctggatcaagctcttggctgtacagattgccacctgattcatctccaggtttgctgtgagtcattctggatgcaggggcaaggggctgagaggtgttgagaatgtcctgtttatccctttgacgcaggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcaggtgacagaatccacacccttatggcacccctcactgcaagtggtctccagatcccagtgggactgctcctatctgctgcattggctgcctctgagtccccttggtacttgcctgggtatgggcccttggcctccatcagacctttgtctaatcccatatcatttaaggcctattgtgaaggtctttgcagcttctttgcttctctgtcactttttttttttttgagacagagtcgctctgttgcccatgctggagtgaagtggcatgatctcagctcactgtaacgtcttcctcccaggttcaagcgattctcctacctcagccactcagtagccgggattacaggcgtgtaccaccacgctcagctaatttttgtatttttagtagagacatagtagagacaggatgttaccttgttggccagaactcctgacctcaagtaatctgcccatcttggcctcccaaagtgttgggattacaggcgtgagccaccgcacccggcctctgtcacttttttggccacacttcattcacgcgactaaagtaacctgatctactaagtggttcttgaatctgaatgttggggaaccagaagcacggttcttttcgtactcagatataccctcacataacctaggacagcctgtacagaagattaggccagatgagaggt

SEQ ID NO: 105768 - DNA, 1050 bp, Homo sapiens
tgggttcaagtgattctcctgcctcagcctcctgcgtagctgggattacaggtgtgcaccaccatgcccagctaatttttgtatttttagtagagacggggtttcaccatgttggccaggctggtcttgaactcccaacctcaggtgatctgcctgcctcagccttccaaaattctgggatcataggcatgagccaccgtgcctggctggttctccataggatgcatcacaatctctgggagtgcttaatacaacacagactgctagacccatccccagagtttctgattgaataggtttggtgtggggcctgagaatgtgcttttctactaagctcccaggtgatactaatgctgcgactggggaccatactctcagaataactggtggagagtattactggacagacagtatttagggacctgagggctgttatgtacaggaggattcctccagctgatgaaagtattgtttgtaatgtccttatggagtttaagactctgaaccaaagaaggacatgttggagagggattcatgtcagtacttgggtgtggttactcagggtactccacccttcctccttaggacttagggcagtggcccaggttccaggttcatcctcctggctctctgatctaggccttctttctggtgggaaccactggcctcctgtaggctcttcaggagttaattggactactcaaccaagtgttctctctcactgccccagctaactcctcagagctatttttgatggcaattcttttttgatttaactagttctttacgtattatgccttctgatacagttgcttttgttgtagactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtatgccattaatgatgtctgaatgataatatgccaaagaagctgcctcctattgagagtgcaggga

SEQ ID NO: 105769 - DNA, 1052 bp, Homo sapiens
aaggaaatgtagatccaaagaagtttaaaaataacttatttaaaaatctcagcaaggtttacagtgagctacgatcccaccactgcactgcagcctgggcatcagagcaagatcctgtctcttaaaaaaaaaaacaaatcgcagccagaaaatggtggagctagcttttgaagccatatctgagttaactccaaagataagctttctcgctttctatgttgcttttgcgccataaatgagagacacacgttagcaaagaagcatagggatactttccaggcatatgagtgcaagaggccacccatgggagatgattgattttaagaggtatcagggggttgatccagagcacctgtgagcatctgacaagaaagaggatgagcattagtttgccatggctgtctttagccttgcatgtggacaaagccccaagtgatatttctgcctgttcctagcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtaggagggccctggccattccccagcaggtagctctgcccagggtgtgtggccagatactttttgcttctaagcatgttggaagtgcggtggtttgaactctcctcatttggtttcccctttcactcaggtgctagtaattgagcctcaaaatgaagatggcacatggcccaggcagaccttgcagtcaaagtaagtgaattttttctcccttgttgtaggctcacatgtgcaaaagagacagtctttcctaaggcagtacttgtactaagaaaaattgttctgattcagatgaacaatgcctattttgtatatccagagttcatgcttctggatgaagaccgtggcttttggtagcagggcagcatctaagggaagcctgtcaggatatctcagcaaggtggcgagcctctgctcgtggagaatgagaaaaggaggaagggatatgagg

SEQ ID NO: 105770 - DNA, 1716 bp, Homo sapiens
cggagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaactgtgtgtatgtcctgtgtcattgtcatttgggaattctttttcttttctttttttttttttttttttgagacggagttttttgctctattgcccaggctggagtgcagtggcgcaatctaggctcactgcaagctccgcctcccgggttcacgccattctcctgcctcaacctcctgagtagctgggactacaggtgcctgccaccacgcccggctaattttttgtatttttagtagagacagggtttcaccgtgttagccaggatggtatcgatctcctgacctcgt

SEQ ID NO: 105771 - DNA, 1131 bp, Homo sapiens
agaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaacttcctgtatcctgttgtttgtgttgctctctccagggctgggggtaggaggatgcaaggacttcctggcctagctcaccctggagaggtttgttgagtgcaaaggactagcttgtgccccacctcccacccacccagcagctaatctggtccctcccaacaacatggaaatgattaccctgtaccgcattctggttcagatttgggggtagggtgaatgcagcctgaggaggccagggagggaggactccggcagcgtttccttggcctcggcgagctactgggctccacttaaggaggctggggcagagcttccaggactctgcccggttagaaaacccgcacgagggcggtgccg

SEQ ID NO: 105772 - DNA, 1050 bp, Homo sapiens
gagagttgatgaacaagttagaaaaagaacatgtggaccctgggtcagctgctgccctagaatggggaccccttctgtaagctatgtcagaatcatctaccagcagtgacagatgtcctgtaaagtgcctgcctttgtggggcaggaagtgccccccgtgaaactaccttgtgttgtggatcttttgctcctccagagcccttactcgggccccacctacagagatgctcagcaccactcttggctggactgagaaaaagctgttggttctctgtttaaaggaaagggattatatttcctttttatggttttgaaactagtgagtttcattaaatgtctagcatttttctgaagccacaaagaaagtgtctctgcaatttcactgaggttcttggaaagtcttcaagatagaattgtatgtatccccaaattctctacatttttctttcagaaaacatcccagaaaagtggaccccagaagtcaagcatttctgtcccaacgtgcccatcatcctggttgggaataagaaggatcttcggaatgatgagcacacaaggcgggagctagccaagatgaagcaggcatgatctggggcaggactgtcttgtagtattcttgaactagggccccaagtttggaggtttggggagcccagcaggaaccttcacaggccaggttgttttagaggctcagaagcccctctgtggccctctgaccctcattaattgggatcttcacagaagatccctaagatagttcaccagtcctgtgagatggaatgtttttttatgaggtagtgctatgcccataaggactgctggcctgagaatgaaccatttcattagtagctagtaatcagtggctctagatgtaggaactttcttttttttgatatggagtctcattctgtcacccaggctggagtgcagtggcgcaatctcagctcactgcaacctccgcctccggggttcaagcgattcttctgcctcagactcccgagtagctgggactacaggcaccctccaccatgaccggctaatttttttttt

SEQ ID NO: 105773 - DNA, 1041 bp, Homo sapiens
tcccagctacttgggagtctgaggcaggagaattgcttgaacccgggaggctggaggttgcagtgaactgagattgggccagtgcactccagcctgggcgacagagtgagactccgtctcaaaaaaaaaaagaagtggcaagaacagacattcttgtcttgttcctgatcttagggggcagacctttttttcagtcttttaccattaagtataatgttagttacgagtttttaatgtataaccttttggtgccaggtggatcggcgtactagaagtttgaatttgagtatgctaatagaggtttatgccccatggttaccaaagcatgtgtcatcctgtaagctacctatgacttcttgtgcattgcaggtaatatctgtgttttgtgtttcagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtgagtatacttttcataacaactgatgccattttccatgttagaatatttatggagcatgtagagaattagagctttttgcctcttcagtataccatataacaaaaatgttggaaagaagaatccattctcatcctgccatcttagtccaagtttgttctttttttttttttggagacggagtctcattctgttgcccaggctagagtgcagtggctcggtcttggctcactgcaacctctgcctcccaggttcaagtgattctcctgcctcagcctcccaaatagcagggattacaggcatgttgccaccatgctgagctcatttttcgtttagtagagatggggtttcaccaggctggtctcaaacttctgacctcgggtgatccacccacctcagcctcccaaagtgctgggattacaggagtgagccactgtgcccagccttcccccaggtttaaaggattctcctgcctcagcctccccagta

SEQ ID NO: 105774 - DNA, 1143 bp, Homo sapiens
atcacgaggtctggagaccatcctggctaacacggtgaaaccccgtctctactaaaaatacaaaaaaaattagctgggtgtggtggcgggcgcctgtagtcccagctgctctggaggctgaggcaggggaatggcgtgaacccgagaggcggagcttgccgtgagctgagatcgcgccactgtgctccagccagggcaacagagcgagactccgtctcaaaaaaaaaaaaaaaggatcttaagtattttgtctgactctgccatttagtttattcctttgtttacctgcccaatggaactgtttgcttgtaactacacattaatataactaaattttgaacttaatgttacatgccttgctatacatggggctctttggggacatgctcatttgtgggattaaaatttccaagacggtttgaagtttgtaattactataaaatccctcatctttaatctgtggagctgtagtattaagtgaaggccttggtatgttcataattacgatagtcatgtgactgaaaatcaggcactgaagctgctcgttctgggtgttggtctcagtttattgatgcttcatccaaatacatttttatagctaataataaagaaaaacatcaaatactcttgctaaattgcaatcagtatgcagtttatgccaaacttagcttgattttattttttgaagaggatgagtatgtatatttaagcatatgtgtgtgtgtgtatatgtatatatacttgtgtatacgtatatacgtgtatacgtatatatatgtgtacatatacgtgtatacgtatatatatgtgtacatatacgtgtgtgtatgtgtgtgtgtatatatatatatttttttttttttctcttttgagactgagtctcactctgtcgtccgggccagagtgcagtagcgccatctcggctcactgcaaccgccgcctcctagttcaagtgattcttgtgcctcggcctctggagtagttgggagtaccagcatgcgccactgtgctcagctaatttttgtatttttagtagagacggggtttcaccatgttggtcaggctgttctcgaactcctggccttgtgatctgccccccttggcctctgaaagtgttgagattgcaggtgagagccactatgt

SEQ ID NO: 105775 - DNA, 1603 bp, Homo sapiens
ctctttacaactccattttgctttttacgtttaacgagaaacgacaatcactgtttcatattgattaaagtccagttacactttgggtaggttttcttttaatgcagacttgttggagactgtgtaagtaagtaaaagattgtattgaacgcttaggggtatgatctacggccataccacctggaacgcgcccgaactcgtctgaaagctttggggtctgttttgagtggaaaaggggtattttccatttggaaaaaaaaaacaacacacaaaactgtaaatgatttaagcgatgttgcatgaaaatagatgcaatgttgcttagtcgaagtcgctgtattgattaggaatgatctaaatatctgtaccttagttactgattggatctacagttacgggtcgtcttcattgaatagcgctattcgcatccaagttgatttgttcacaaaccttgtttagtagtttacggtggaaaattggaatcctttttacctcaaagttggttccacttgtgttttttaatagttctgattttaaatttttacctctgttgttgacttgtttggttctgtcttgaagaaagtcttaaacgtttcttgcaggtgtgtaagtagatatttcactctgcctttctgaaggagaaaaattgaaaaaccaaaaaacttccataatttaaaatgttgtatgtggagagaatttttcaaccacttagtatcacccagatgtgtaatgtgtaccatgcggatgattgtcaccttagatgtggctagattggcggagatactgttttgagcatttggcacaagtgacattggactgaaaaactagtttttaattgtaaagaatgacttattgaaggatctctggataacttgtcttaattggttccatctacttttgtggagcactgatggctcttggggacattaaatatataaggtgcaccttggtttgagttaaagtctagtgctagatttatcctctctgttctcataaaaatctgtgttggagggaagaagagagtaggaatactgtgtagttcttgagttttagatctaagaggaatctttcaggactggttgtccaaccccatttgcagatgagcaaactgagtcccagagacttaagtaaatttcccaaggttacctatctagtcaggagcagaccagaactgtctgctctgttaaggtattctccatttactcccaagcagttggcctccagagtcagctaaaattcaggacttctagcttattccattgtttcttcttttaaaccttgttgatggtgaatagtttgggagaaactgttcatttgccaaaaaatttcggttcattagcttacacagcactctccccttgttaactggatggtcctgccttcaattgagggagatagatgaatgtacgagggtccctggttggcctaatcatggctttgtttggatttttttttaagggaccaacttctagagcaaggcctacactttactgcttcaaaaccaagatatttaggtcaggctaagatatttttagttaactgtgggcacttttgactgttgatttggggtactgcgtgtatcaagtaaacaattccctgtgca

SEQ ID NO: 105776 - DNA, 1048 bp, Homo sapiens
cagggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtaggtggaccagggaagctgggaaacccttgtctcttcccaggagggtgggggcactggcagggtggtgctgatgcgtggcttatgcttgcttgacaggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagac

SEQ ID NO: 105777 - DNA, 1049 bp, Homo sapiens
caggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcaggtgagccaggggagcacactggccatctgatcaggccttcctccctgtttacagtggtccactccttggctttgtttgctgtgaactggattccaaggacagccttctcagaagagctagaggtcatgggggtgtcatggataggtcaatggccccaaggaaatgagctcagagggtctcatcatctcatccttctagcttgcccccattaaatggtgtgccttaatgtcccgggttttccagggctgacacccactctcatgtattgggctggatgttggtttgaaaaggggttatttcaggaaggtgctaggtcctgtccagttccctggcagtccccccacacagagtgactgggggaggtcaggaaatcagaaggtggtcctttgccacgtgtagaaccaaaagactggttagtcactttgggtgggctggactgcactgtggatggcagggaggatgcatccttgcttagtagccttttggattgtagctgttgcaatggcctgaggctttcaatctcttccccagaccaagatacttggtagtgaccgggtgaagctgatggagagtctagtggttggagacattgcagagctaagaccaaaccaggtgggcccttttatttctgctctatgagttttcttagtcatgagccagcaaatgggctgagtccctacctcaggcttaggggcacagagatgagtcaaacacagcttctcagggcttgcagtcttggacagaatccctgagtcatttccagagacacagacatttgtagggaggggaatatcccagtcttactacatcaggctaggaggccagaaaccaaggttaatatgctgctctctggccatcccttctgcttaacccctctc

SEQ ID NO: 105778 - DNA, 1057 bp, Homo sapiens
agggcactgctggggagagacccatggccactgacccctccttctggagcagggtctcccagaccccagcagggtatcctccgaggtgcagcagatgtgggcactgacagagatgatccgggccagtcacacctccgcaaggatcggccgctttgatgtaagtaatcgcttccttctgcttggcttgctttgccctgagcagatcagacctgatggtcttttgtatttcaggtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctcctgaatatatgttcaagtgggtgtgcccatagggcctgggcacgtgtctctagcaaaaccagggcctgagcataagaactgggacccttctaggcagggtgcagtggctcacgcctgtaatcccagcactttgggaggcccaggcaggcggatcacctgaggtcaggagttcaagaccagcctgaccaacctgg

SEQ ID NO: 105779 - DNA, 1012 bp, Homo sapiens
gttctcatggcttagaaataccccttgatttgcattcgaaggaaataaggagggctgaacgcagtcgacgggtggccagttgctgggccagttcgcagtcctgactgtcccttgattagtcttagaggcccaaaggcctgaagttgggcggggagcccctcccccacactactggttctgaaggctccgagtgaccgggaccgaccgccggggtgtgtcccgggacggacttccctggccgtgggggcgaggcttccataatggggcgtgacttttagggcgggggagtggctagccaatgagcagagaggtgctggccggggcggggcttgcgcgcgggtgcggcgcgctgcggagcggccgacgcaggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggtgagtgcaccgcccgccctatccgctgtgcctggctgcttgggcccccatccctgctgccggctgagccttccgcggaacacctgctgctgctcgctgttcggcccggggcggggacacggccgcggacgtccttgtgggtgaggaggcggtgccgcccgggcggagccgcccctttgctctgggtcccgcaggcaaaggctcggagcgttcggctgcaaggcccgggccgcgcgccgcggcgatgggccaggccttagctcggcccgcgctcccgggaacgtggagcctgcgccttggccgcggtcgtgagccgcctgcgggccgcctccctggcttccaa

SEQ ID NO: 105780 - DNA, 1063 bp, Homo sapiens
tctgcccgctaagcgtgctcacatagtagcctgaggagagagggaattcctgagctgtggttttcagggccagcaggaattagtgggggacatcaaggcctggacacagggaaccacatgtacatgagcacctaaaatagtgcttgggagtcctccagcttggcaggtgcgagctctgggcctgccttgtgctcaggagttccaactttgtatgcggggtgcaggagtctggggagccttttaatcagtagagtggtgtgacccagacctgtgtttagaaagatattgctggtggagtggcaggaagagggagggggtcaggacctctggcagttaagtcagctaacagaggagaggtggggagggagaaggagccatcagaaaagagagactgaaaaggtagtacagaggggatgtcctgccatgatgggggaggagctacattctggaatgcatgggccagaagaccaagcataaccaaggatttaaattccttgttgactacctggtatagtgacctacagagttgcttgtgtctggttagtgttgaggatggtgggatttggagggaccacttagggaccacttagactgccgtcgatgcataggaaaggaggcctggcatttgattattaaaaactttatcgccgggcatggtggctcccacctgtaatcccagcagtttgggaggccgaggcgggcggatcacgaggtcaggagatcgagatcatcctggctaacacggtgaaaccccctctctactaaaaatacaaaaaattagccgggcgtggtggtgggcacctgtagtcccagctactcaggaggctgaggcaggagaatggcgtgaacccgggaggcggagcttgcagtgagttgagatagagccactgcactccagcctgggccacagatcgagactccgtctcaaaaacaaaacaaaaaacaactttatctccaggcagggcgtggtggctcacgcctgtaatcccagcactttgggattctgaggcaggtggattacctgaggtcaggagttcaggaccagcctggccgacatggtgaa

SEQ ID NO: 105781 - DNA, 1777 bp, Homo sapiens
acttaatttagccttaaggaatagggttctctgttttccaatttcttaggtttgatagctaagcattttctttttcttttttttttttttgagacggagtctgctctgtcacccaggctggagtgtggagtgcagtggtgcgatcctggctcactgtaagctccgcctcctgggttcatgacattctcctgcctcggcctcccgagtagctgggactacaggtgcccgccaccacacctggctaatatatgtatatatatattttttgtatttttagtagagacggggtttcactgtgttaggatggtcttgatctcctgacctcatgatctgcccaccttggcctcccaaggtgctgggattacaggcatgagccactgcacccggccatagctaagcattttcttagttttactcagggtccagggtagaaagatggatgagatgcattagtagaagatcataaactgagggtgtcaaagttggtgaagctggtctgtgttctgtgttgaagtggttaaatctgaacgaactttagcagtatgttgacttaatttatatttatgttttaaaagcaggattctactggaacaatcagctgcatatttaaaaaattacttttatgaccaaatgtcttttatcttgcttgtcatgagatacatttaatggtgttgaggttttgggctgggcgcagtggctcacacctgtaatcccagtactttgggaggccgagccgtgtggatcacctgagctcaggagttcgagaccagcccgtccaacatggtgaaaccccttctttactaaaaaatacaaaaattagctgggcgtggtggcgcacacctgtaatccaagctgcttggtaggctgaggcaggaaaattgcctgaacctgggaggtggaggttgcagtgagccaagtttgaggttttgcagtgttgaggtttttcttctcagttatacctttttgagctaatcgttttaaaaaataccactgtctaaaatacactgaaattaattttactatttataatttttggttctggattgactgtacagaaaatgtttcattttcttactgtgacctttgacaaagaagggtgagtaatttgtggtgtgggcaggagactcagtggcattccccacttcctctggagttggtcagtgtggtataattctatttcagttgtgggcattcaccaatattgtttcctccttttcctgcagggccactgctctccaggaagataaggcttttaaagcagcctagcactagaaggtgaggtaaggtacttgaaaagagacatttctgcaaaagaaagttgaggaataatcacatactggccaaaatgataaccacagaattatatttatttatttttatttatttttttgagacaaagtcttgctctgtcacccaggctggagtgcaatggtgtgatcttggctcactgcaacctttgcctcccgggttcaagcaattctcctgcctcagcctcccaagtagctgggattacaggcatgtgcccccgcgcccagctaattttgtatttttagtagagacggggtttctccatgttggtcgggctggtctcgaactcccgacgtcaggtgatctgcccgcctcggcctcccaaagtgctgggattacaggggtgagccaccgctgcccagcttattcgtttttgagacaggatctctgtctgtcacccatgctggagtgcagtggcatgattacagctcactgcagaccttgacctcctaggctcaagccatcctcc

SEQ ID NO: 105782 - DNA, 1024 bp, Homo sapiens
gggaggctgaggcgggcggatcacaaggtcaggagatggagaccgtcctggctaacatggtgaaaccccgtctctactaaaaatacaaaaaaaaaaaaaattagccgggcgtagtgttaggcgcctgtagtcccagctactctggaggccgaggcaggagaatggcgtgaacctggaaggcagagcttgcagtgagctgagatagtgccattgcactccagcctgggcgacagagtgagactctgcctcaaaaaaaaaaaaaaaaaaaagtgaattgtgatttacagttttgtagaagcacatttatcaatgtcaagtaaggcagatttgtactgatttttatttttaagtattgtgcacgttttctgtagtcccttttctgtgacttgcatggatttgtgatttttatagccatgtggagacctagtctcagtgttccctgcccttggggacatgaggagccacagattcattcttgctgaggcagtcatggcccttggataccctaagtataggggagtgtgccagttgtggggagctcaaggatgaatgaagcacttggaaggatatgtcgtattcagggaaacagtagccagtgcccagcttgattccctgttttggcatttactcttcatttctatagatgttgtttttgtatatgaggtatgagaatctacaaacaagcacctcttatagagttctttctcctaatcggtacacagttttctgtatctataggttccacatctgtggattcctccaactatggattgaaaatatttgggaaaaaaggatggttgcgtccgtatgaaacatgaataaacttttatcatcgtcatcatttcctaaatgttagaacaactattttcataccatttacattgtattatgtgttataagtaatccagggatgtttaaagtatacaggaagatgtttaagggatccagggctgtgcaggacgtgccttgttaacaaaatgtttacaagcagtatacttggtaaaagtcatcgctattctctagt

SEQ ID NO: 105783 - DNA, 1041 bp, Homo sapiens
accaagcaggtactcagcagatgcccacagagtacaggaaaggaaattccactaaatcccctaaataattccccaagcagccaagcgccggtggctcacacctgtaatcccagcactttgggaggctgaggcgggtggatcacaaggtcaagagatcgagaccatcctggctaacatggtgaaaccccgtctctactaaaaatacaaaaattagctgggcgtggtggcaggcacctgtagtcccagctactcgggaagctgaggcaggagaatcgtttgaacctgtgaggcggaggttgcagtgagccaagatcacgccactgcactccagcctggatgacagtgcaagactctgtctccaaaaaaaaaaaaataataataataattcaccaagcataaaggcaatgatcacttgatttcacactttgaagttcaatgctgagctttctggtattttttccattacactacgaaagattaaaaataagtgccatagctcaaaattaatatgctaatctagcaatgatgaattaaatttagaaaaagtgtgctggctggtggcctttctgacctaattggccaattagactccaaaacagaggagtgaggcgaaatgtcagggaagctccaggcaacccagcccttgaccctgccagcagcccctgtaataaaggcctgggaccctaagcacaatgcctcaggagccaaacaggtatgtgggaattctggcatattcactgcagaatatttatctaggcaaatgcttcaatcttcagtgtttaaagtggtgacttgcttttagccacattcttgtttttggctacattcttaatgctcaaccatcaaaaatatttcacccatgccaggaactgccatatcaacacactgtgtttataaaagaacaagacaaaactaccacccactccctttgctcaggttttccttcctgctaacagaattccttccctcccacagatggttctaattggcccttttacctgcttcagccttgccacagctacaaattctaaaaaatcacaa

SEQ ID NO: 105784 - DNA, 1348 bp, Homo sapiens
gattttaccatgttggccaggctggtttcaaactccttacctcaagtcatccacccaccctagtctcccaagatgccaggatcataggcgtgagccacggtgcccgtcttgtttaatacatttctttattatttattctttgttaatacttattgtttacttaatatattttattgaatgtatctgactgtattcaaaatattactaatacatatcatttcagtttgcaatcaatattttaaaagtattaatgaggcattttacattcattttttatgaagttttcaaaatccagtgtatattttatatttaatggatcagctacatttccagtgctaaggagttgcacgaaactgttggtttctgtataagagaccatgggggtaagaggcttgatccaactcggggtagatgtttttgacagtaactcctggaggatagtatgtgactgaaccactggaattgctcaagtctaaacctgcttttctttttttttcaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtgagactggatataaagcataaatgaggaagagttctcattttccattttagttttggtggcttttccttttcaagtctaagcttcaccaattctgagctcagttcttccagtacccccttagaagagggacagccactgatgttcataagagaatccctatatactcagaatagcatcctaaactgtattcttgttcctattctgagggcatcaccatgtaatagcctttactctggaagttctactgaacactgatttagggatttgttggaaaggtctgtcacgtgtatagggaaaggttacctttaataaaacacagagttaaaccccaaaaaataggacttttatgctttgaacttactttttaaaataagatataaataaatataggagttctgctctgatttgctgatgtatgttggctaatgtaattgatcacttaaga

SEQ ID NO: 105785 - DNA, 1037 bp, Homo sapiens
gtctctggggcaaccgtatttctgaagatcttggcccatgtagcagctcacatgtagcagttcacagagctcttcctagtttgcagagtgtttgcataaagtttccttgtcatctttgtaatatcccagcaagctagatgctaatctgaccattagatacagagtggtggctctggaaggtacatttcttgctcagcttcagatttaatcctgaatatccataccctgcattggttgcctttgttccagtagccattggaatgttttacgtggattaatcttggccagaagtgccttgaactgatacagcaaactagatatttgttgtatttggcagagagatgtttaacaggcttatttaccaagggggtgaagagattttactgagaaaacaggattttatctgagcatatttatctgtggaaagcagaccatttagtagctgatgagcttgtagaaaaacagatgaagatgtgtgactcttcgttccagtcttaaccaccgggattatatgggttggggagtcagaaggtcagaaagcctgatcttgttcctagagctttggtttctgcatctgtaaagcaggatttagaaagtctttatattaaaggaatttttttcttattataataatgatgcataaatgtacattgtggaaaatatagaaagggaaaaaaaatctgtggtttctaccattcagagtgaagtcctctaccgttttctatgctcatcaagagatggtcatgccacatacacacacagacgtcttaacatattagacagacctaggatcatagtggatatattttttaaccttttttttttgagacagagtctcactttgttgcccaggctggagtgcagtggcacagtcccggctcactgcaacctccacctcccgggttcaaatgattctcctgcctccatctcccgagtagctgggactacaggcatgcgctaccacacctggctaatttttgtgtttttttggggggatggagtttcgctcttgtcgcccaggatggagtacaatggcg

SEQ ID NO: 105786 - DNA, 1856 bp, Homo sapiens
caggtaaataaactcagttgtgtctctctaggggggaggaatcagcttccccagcaggcattctgaattataccttaaacctgtcacacaattcaggttaactgttgtgatcatattcaggttatgcagtgacaatagtatttttaatttatgcttgtgtctcttctaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtgg

SEQ ID NO: 105787 - DNA, 3512 bp, Homo sapiens
gaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaacgccgttgcatctgggcatctgtttccctggcatctggagaggttcctggacatgaggggttgggggctcatgtgacggggaagaggagactcagccaggtccacttggggttggcccagtggcctccatgtaagccttaccatttctgtgctgggagggctgggtgtgcactccagaaactctgccaacatgtaatgcccccttcacccctcttctgcctgtgaatcagctaagacaagtctcctacatcctcagttcctcctctgtaaggggtgggggatagcagagaaaccagtgagactggctgggaaggaggatggtgggaaagtgtcacgggttttctgccccagagtgtgtcagcccctgtacctcctgggtagggt

SEQ ID NO: 105788 - DNA, 1007 bp, Homo sapiens
tgttctaagatgctgctgaacagattggcccattgatggggaaaaagccctgtgaatgtgcttctgggcattcaggaaagagcattagcacaaagacatatttgctttcagtaagattttgaatttcggggcagtcagaaacctcatagaggtgggtagaaggccaggtaaaagggagatgattctgggggagttaaatgctattgccatattaccttgtcatcccaggctgaattagtcttttcatcctcatactgagctgagttggactctgtgagggggtggctccagcatttgctgctgaagagcctgacttgaatcccatgagtagcagtgctgccacacccatagtggtgcctcttagcccgtcgggatgatgtggagctttgggcattggagagtccctcaaggaagggctctctgcttctggtgtcagggtggccatgtacaattatataatctgtgccttttccaaggagtgctggtttgggagaaagctgaactctaacccaggctccactctccaagctgtgtgccctggtgtaggctgcatcctcttagatgaaggggcatcattcactcgttaattcatttacttatttatggagatatgcctaatgtacagtggaacacacatattgatgggattttatttatacatacactcgtgacacactaccagatcaagacagaactttatcagtaccccagaaagtactttttaaaataattacacgaaggagccatgtagaccagtggcagcctgtctagtttacaccagctctgtggacttgcacctgtcagttttttttttttttttttttgagttggagtctcgctctgtcgcccaggctggagtgcagtggcacgatctccgctcactgcaagctccaccttctgggttcacgccattctcctgcctcagcctcccgagtagctgggactgcaggcgcccaccaccgcacccagctaattttttgtacttttagtagagatgggatttcacc

SEQ ID NO: 105789 - DNA, 1038 bp, Homo sapiens
ggcaacagagtgagactccatctcaaaataattaaataaataaataaaaataaaacaccctccgggtactctgtgtcaaatcacccagcttattttctccatagtgcttattctttcccaaagtgtctactgatttgttgtttacaaggtgtcttctgtgccccaaagcagcccatgagctctcgttgatagggtgttctcagggctgcacacaacatgtggtacagagcagggctcatcccagaggggcttgcttcattcatcctggcaatttggtcatgcaggtcatagctcaacaaggtggaagccccgagatttggtgcctcaatgaagagtctcctcctcatcaaccagagctgaggctggaggccaaggttgttctctgtctgtggttgcagccagaggttctaaatgcaccctattggccacccagtcatcaccaggggaaggtgccgtctcatctctggggcagaaggccccttttatttacccacacgtggctccagccctgctctctgccttgaggccccagggctactgctacaggttgacttgccagttgggggacctgggctcaggtgccttatcccagcaacccaagggcagcagccaagaagagggagaacactgcactttggcaagcacccccttgtgccaagcaccacatagggcatgttcacaggcattctctcattttgtcctcacaggagagaaaaccaagatctgagatgttttagcaatgtgttctcaatggttccctggctaggaagtgttgctgctggcaagatcagccctgacagctctgcgtagctcctaaaccacagcctggacagcctggagcctggtgccttctgtagtcctgcctcttccaaaggccaagtcaggctctagaagtcagcactgcaaaccctggcagagccccccaaaggccaatcccagttctagaaactctaagaacagtgatgccgaggcagtgaggtgagaagccatcccactagctgggaacaattaacccacccaaatgctttttaagaagca

SEQ ID NO: 105790 - DNA, 1084 bp, Homo sapiens
ttgtgcacaaagaagggacagacccgtggagcccccctcatagctcccacagccctgttagacctcctgggactccacctgaggccacagtcaaccatctgggccagtgggttgggaattttccccataggttggaaattttcctgaacatttctgagctgtagaaatctttcttctttctagattgggagttcagagcacacaatagaggagagagtagaattggatcctttttccttttgaactttcctctgaaaaaaaataaccatagtgctatttagtgagtcatttcataattaagagttgttgattccagttttttttacctatttgtcttttggaaggataatagtactctctggcttaatttttaattgacgttcagttcaaaatagagtttgtgaagaaattagttgaattggaattgtgacagtaacattaccagtctcttattatatcatcattgccaaaattccagctgtgcccttgagaagtcgggcctccctgggcaaagtcccttgcacctgtgatacatggggctgggcttgctcattggggtaggggttgcagcaggggcatcaggccagaggtcctgttgcctcccatgtagaatagggaccacaatactcccttttaggtttccgtgagaaccaggtgagatgctgtacctcagatgcttatgcaaggcctgacacagtcagcccttaagccaggattttggaacaggagtatcctaaaagagggtctctgtgtgagaaaggaagcgtccccatgagcccctatctgggtgtggatggaccctgtggctggtgtaagcttttggtatgagggatgccccacagggaacaaacacatttggtgctggggggtgagggggttacagcccagctacaaggatacacactggggacaccatggtgggtttattttatgggaggaagaggcccagaaagaaggagcttaggcatgtccagcaacagggaggctcagggtcgcagagtcaggagaggaatagcagcaccagtgatggccatccctgtggtccagtgtcctccaagatgacccctgggcatccttttctctg

SEQ ID NO: 105791 - DNA, 1010 bp, Homo sapiens
catagagggaagatctgtgattattttacagcccttctctttcccagagctttgggaagcaggagggtacgggcagattcccttcatgccaatgtcctgtactggcccagcacatggctttgagaacccctgcacatctccaatgggcctgccaccctctgcctcacattgaggtaagaagagtacagctgtggctctgggtttggggcctagcagctgacaggggttgagatcagtggagtatgaacaggaggcatggagtggagagggtcctgggcccgccaggctccctagaggatcatgggaagggacacatgtagattgtatgccaatcgtggcaggctctgagtcattctgcatcctgccctagtcctctctaaagtggaaggctcctcagctgcctgcccaccctcttcctctagtgccctgcactgccctctgccaaaccctctgggctgtgctcttggcctggtccccagctccctccatgtccctcggtcaacctgctgttctctggagccaccagtgcacccgtaagtcctatccagccctacctccagcagcatggcttcctggtcaaggttccctaacagtgcctaccatggggtcctccttgcctaccctagacactctgcattgcctgaaggtccacattgcctggtagttcactctgtcttctccctttttctctcgctcctagccttcccagaatgccccatgcccttgggtttcatggaccacccaaattccaatatatactgggaagtgactcctataggattcttactttttaccttgccaagtaactacctaaaaacctcccacctacatccaccatatgtcataataaaaattatagtgtgccctcaaaatttcagggtgggccttttatggaataaatttagccttttgaacccctcactctgttgtctcttttcttattttggccacgcatcatgagtgcctatcatggcctggtctcacatggccagcccatgggacctctgtgc

SEQ ID NO: 105792 - DNA, 1353 bp, Homo sapiens
tgatggctctctcctctttctttgtcacagctgtctctgcttttggcaaaaaattttcctcattctggtgaccatgcccagcatggtgagtacaagcagcctgtaccttgcctcttctgggaaaggcccgaggcactgggggtgggggtggggctctaagtccgaaggggtcctctgggaggagtccagtcttcggctggttcagtacccagagctgcaatgttcccttctctgaatgtgggaggagaaaaaggagggacactgtgcacagagcccctaccatggggccaacacagtaggggtccccagcaaaggaggggccaaagccagggccagtgccctggctttcaaaccatctgccatcccctgcagggctctcacagcactgggctggcactgggttgtaggtaggcctccagggatgcaactcctctccagccctcctctaaatgctccacaggctcttgaagaaatgaagagaggtatcattgctgtggaaaaatctctggagtcagaggcctgggcgcagctctggactctgcgtataacagtgagtgtcaggatcagggtgagatgggccggaggaggggtgaagggccaaggcctggctgatgacagctagccagttctgacaagtgtgaactgggaagggcctgttgggtttccttcagctgcgatgggcccagcagccctctaccccgcagaggcaggggccacagagctgcctgagatggtgccagacaagtcaggtggcacccttggagaagagcccagcacggctaactgcacctcacaacttgaagtctatgtgctgggcactgagttcaaagtcatcctgaaggacctggtagtctgtggcacctgtaggggaacatgcttcttccctgatgtctgctgctggtgcctttgctccagccacttggaagagattagagtccccaaaccccacagagtcacatctgcagctctgggaatgaagtcaaaacactcctggcttcacaggctgagcttgtggcccacaggatagaagagtggaaggagtagagaggcagacaggaagggacatagaggaaagggagtctcagccccagactaagtcagctcagggagagggcagaagggcctcaggatgggagccctcaccctgtctgggctgcagtggccaaggcaggttgggacaccacttcctggagcctgtcctggccctggccctggccctggccttggccctgcctctgtgggaggaggaggaagtgcatcatcctgggtgggaggagaatcacctggctgttggtacagctctgtgcacagccaggaccactgaccatcatcccatagccctcggaccctcct

SEQ ID NO: 105793 - DNA, 1015 bp, Homo sapiens
cttgagggaggaggacgactgcggtgggatgaaaaaaggggagggaacagcactgacggatgatcggatgctgggatgggaccagggacagggcaaaggccagtatagccagggccacagtggaggggagaggtggtcaggggtaaagtccaagggggtgggagccagctggggtgggttgtgcaggccaagtaaggagcctggaatttattctaattacagtagccatagtgcagcccttagcgttcttcctgccttcaccctcccacagcgggcttcctgcggcttcccgctcagctgatgtttccttggagttgccctggaacagatgtgaaatcacaagtggtgctgaaagtgggggaaggagggacagcccatggcctggattcatgacagtacctaccttgggtttggggccagggtatggctcctgagcagggaaaggaagcacagacacagctttgttctgcgtcctgccacatggtgtggttgggccactgagaccactgactttatagttaaagaaatctcccttgagttctagcattcggctaatgattgggtcaagtggacagtgctgccgtgagtatccctctcctgaaattctttacggcaatttcagagatgggcttggagaggtttgccatttcaaaccaaatcccttctccatcactcttaagccaaaaaaaaaaaaaaaaaaggaacttttgttacattaaaagaagtgtcccttcctggctgacctgattcttctttcttgctgtcctctctgtgacctccaacctgcccaagcacccatctccccaagcctgagtggcatggcaccccgtgggtgaggaggtggccgctagcacaggcagatggctgagaggaatgtgagggtgagaagcagctatctacaattcttgacagaatcctttcttttcttctttccttcctccctccctccttttctctttcaagcatctacaatctggcaaacccttggcccaaagactcaccaggtgggacgtgg

SEQ ID NO: 105794 - DNA, 1044 bp, Homo sapiens
tgtgtcccctgcgcaggtgctgctgagcgagcccgaggaggcggcggctctgtatcggggccttagccgccagcccgcgctgagcgccgcctgcctgggcccggaggtcaccacgcagtacggcggccaataccggacggtgcacactggtgtgtgtgcgaaggggaactggctggcgacggggtcgcgcactggggtgggaaggaagggggtgtggagggctcgctgcttgacagtgcgtaagggtatatagggagccggcctggacttggaggttacactcccacaggtccctgcacacaggtgtgtggagggggggagggggcgtgcggggcgttatcgaatggcggccatgagtgcacgagatgacggcgtaggggtagaagtcaaacctgggctcagggcgtggaccttgtagggctctccaccaacacgccatcccatacacatgccaggctgccctcaagattccagggtggatgctggggttactagggggttctctcaaagaggctgtcagctcaggctctggaggcctggactagggttgtggccaagtgttgtccagcctgcagccagggtgtcagtgtctggagacagattgagagattggggaagatagatctaggccttcctgggtcaggtggggctgggggcagtagccaggagtagccaagacaaggtgagcagtctcatgcctcccctcacagagtggacccagagggacctggaacgcatggagaacattcgattctgccgccaatacctggtgttccatgacggggactcagtggtgtttgcaggacctgcaggcaacagtgtggagacccggggggagtaagtttgagggaggaagcttgtgggcaaggccacagccgtccgcaatgcaagccttttatgaatgctcaccatgtgcctagaagggaggccagcagccaggttcttgcccccttgggagctcattcagtttctggtgacatggcctgataagcactggaagcttgctccaaactcagcctggactagagcccatggtggcctggg

SEQ ID NO: 105795 - DNA, 1536 bp, Homo sapiens
aagaaccggaagctcaagagcttcaacctgtcagcgctggagaaacatgggcctgtttatgaggatggtgaggcatctggctggtgagcaggcagggtggacaggaggggtagccgtagccctgggccccccctgattggccctccctgcacccagactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaaggtgctcgtggtcaatccacgaaggcccggcagggcagccctggggctcagtgtgctcccttcccatactgtgcctgtcagacctggggaggcactagcttttaggaagcagagcaggtcctatagacaggctgggcattgagtatcttgtgttctcagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggtcagcagcaacagcctgtgtcccccctggagtctgggacccttcttgagctaccaccccttgctcactcctgccctttgatcctgtttacaggcattttgggcccctggagatgctggtgtggtgtttgtgggctggtggcatgagcccttccggttgggcatccgcttttgcaccaatcgcaggtgagggagtggggcaaggcaaggggccttgcagcccagctggccttgagactgagtgtctgtctcgtggttccaggtcagccctgtattatgtggacctcatcggggggaagtgtggtaagtggctgatgcccacctgtgctttgctgacacatgttggccctgccagcctgcgtgatgctcatgtttccatctggcccagagctcctctcggatgactccctggctgtctcttctccccggctgagcccagaccaatgtcgcattgtctacctgcagtacccatctctgatcccccatcaccaatgcagccagctgtgcctggtgagctggaggtggcagggatgggagggtggtcagcaagaagatgggatggtggatgagagctgaagggccagtatcatctccccataggccctcagtaggtgcccttctgtcctcaatgcagcagcggtgtgagttctgcctgtcctctcaaggagggcctagaggttgagagtgctgccatggagagctttgcactgttggggcattccaccttgagagaatgctcgtctgcaagaatgctcctccccttggctctcaactgcatgtagccaggctctgcaaggggctgggatatagtggggagttacacaatcccagaccctccccaggaagagctctgggcccctggtaaaagtcagagggacatgcctatctgaggccccttgggcatctggtccaggtcaccag

SEQ ID NO: 105796 - DNA, 1021 bp, Homo sapiens
aagggagggaacagtgagaggcttagcctctgcctgtcctggcaaccaggactctgtaccagcctagcttccctgctgcagccccttccattagcaactactctgtaccacccttcccaagagtatgtctggaggactagtgtgaggccctgtctttccacggcacccatgggcaaaagtagtcccagggacattgccttggttggggaagcccctaggctggacagatcacctagcccagggtgtgctgggctcaagccacccgagccctagcaaggagtcactgacacatttcctggaagcaaaggctaagaagcatctgtacaggcataaagaggaaacatggctttatgtctgacaagaagttttgtcctccccaaggcatatggcatcaaggctgggcctaacccagtctcatgaccttgtgaatccagtccacaaacacagagacacgcgtgaagacagctggccagcgggaccttgcgcatactcggttggggattataattccttccaggacccagcagttgtgggtaaagcaggcaagtgggcccccgtagtcaccctggcaggtaggagaactgatgagggccccgggccacagcaatgactagcctgcttcatgataaaatagttcatttctagccccccatacccttccagggctggcccagggccctgccaccaacctcacaggcccccacaggggccaacagtccctcagtgcacatctcactctcccgcacacgtcctcggtgcttgatgttacactcctggttggagatgacattcagcaaggccacatttaggactgtgtcattacccgtacctgcagtgaggggaatggggagagggagagggtcctgcaggaagatccagggctgggcctcctggccaccagcagtcctgtgcactgtgctcttacctttggtctcaccccagcctgcaatctcacacttggtccctggaggcaccacataccattcagggggcaggcagatcagggccacacgctggttca

SEQ ID NO: 105797 - DNA, 1134 bp, Homo sapiens
tgcggtaggcggcggggaccaggcctgggagggtacctgggaaccttggggaggggcgtggcttggccggggaggtaagaggggctgggcgtgacctgagagcataccccgtggagtaccgtacacctgggaaaggcgggtttggtcccagccccagagggatctcagctctcgctcggggcccgacctatctcggtccatctaagggtccgaggcacagccccgccaagaggccacaactgtcagctgcttccgcgggaagggtgagggctaccggggcacagccaataccaccactgcgggcgtaccttgccagcgttgggacgcgcaaatcccgcatcagcaccgatttacgccagaaaaatacgcgtgcaagtgaggtggggggggggggcgggcgttgggacgtgctgctgcgggtgagacgggaggaaggtagtcacgggctcaaggctggaggctggcgggctagggctgagtggagcgcctgcttagagaccttcgggagaacttctgccggaaccccgacggctcagaggcgccctggtgcttcacactgcggcccggcatgcgcgcggccttttgctaccagatccggcgttgtacagacgacgtgcggccccagggtgaggcccaagcttgggggctacagagccgggctggaagcctggaaccggagggccggggcgaggtctcggcctgatggctgcccgcacccgccacagactgctaccacggcgcaggggagcagtaccgcggcacggtcagcaagacccgcaagggtgtccagtgccagcgctggtccgctgagacgccgcacaagccgcagtgagtccctggtgctcccggccccgccagggccctaaccctggggcggcatgctttggtgtctgggaccagagcctggaaatggttgagactaccctgccacgattttgctcccgcttccgcctaggttcacgtttacctccgaaccgcatgcacaactggaggagaacttctgccggaacccagatggggatagccatgggccctggtgctacacgatggacccaaggaccccattcgactactgtgccctgcgacgctgcggtgagcactagtgacgcttcccccatgaccctgcctcagccc

SEQ ID NO: 105798 - DNA, 1985 bp, Homo sapiens
agccacatgtggtcattgaactcttgaaatgtggctaaggcaactgagaaatcgaattgttaatttttaaaactttaaatttaagtaacctcatgtggatgacggctgctgtgttggacagcaccgctacacatcagtgaggccagcaccagggactcagtgcaggttctggagcagctgcagcagcaacatgatgtgagggatagatgcactaggaggaccaatggagtttgccatgagggctgggcaagggtggtgcttggatgaggtgggaggccacatgtgtgagtgggaatggtgaaactatcaggaccatggataaaagaagggaggaacccagggctgaggaaagaggctccagccttgtggggagtaagtgggacttatggctagagatgaccagaccagtggtggtctgcacttgggggaatgtgtaggattgtcgcttctggttgtgagctggactcagtatggcttacaactgagatggatacaggggctctgcccctaggacacctcactttggacattttggtctgatttccacagagctgagacattttgttatggttcggcaaaaatatatctagtacctgctctctgcccagccctgtgctgggcacagggacactggagaacaagaagtggtccctgttacatgggcctagaccctggctaccctccctgtgtaggaagctgggagcccctgcattcccctgccctatgtgttagtgtgcatgcccctggcctcacctgctcccaagccttcctgccatggcaggactgaggtcaggtgtgggggcccctggctggccctgagtagacaggctctgtgtctggctcagcccccaggaccactggctgcccatgagagatgaaggatggcatccaagggggccggcatgtctttctcccgcaagagctataggctgacctcagatgctgagaaatccagggtcacaggtaagagctggcagggaaggaaggaggctcctcttgttgggaggagaaggaagggacaaaggcctcaggccttgctgcacctgtggctggcctaggaccagaagtctctggggccagcaggggccaggagctgcactgatcatgtggcccttttctcccttctgacttgtggctcaggcattgtgcaggagaagctgctgaatgactacctgaaccgcatcttttcctcttctgaacatgcacccccagcagccaccagcaggtatggctgggtgggtggcccctcctcactctgctgggccagaccagaataaggaggctgcagttgtagggaaagggagcctgggctctggacagataggcttaggctctgttctcactgtgctcctggctgcgagatctctggccagagagtctgccttccgtactctgcttcttcctgtctccaggcagtgctagttccttctgagagtcagggagcagaggtcagggagcgggtgcacattcatgcccagctagcacctggcacctactccatacccagcatctgcccctgcatgtacctgccctcaccttggccccagcctggccccttgtagcttctgactgaccttgtaaagaacaaactcctccagggccttttctttacaagtttaatacttttaagtgtagtcagtataaaagttacaagtacattttagcagaaacttagagggccaggcacagtggttcacacctgtaatcccagcactttgggaggccaaggtgggtagattgcttgagtccaggagttcaagaccagcctgagcaacatggcaagaccccatctctacaataaaatacagaaattacctgggcatggtggtgtgcacctgtagtcccagctgttagggaggctgatgtgggaggatcacttgagcctaggaggttgaggctgcagtgagttggcctctgcatgccactgcactgtagcctgggtgacagagcaagaccctgtctctaaaaaaagaaggaaaagcacc

SEQ ID NO: 105799 - DNA, 1004 bp, Homo sapiens
cagggacattgccaaccaagggcatcaggggatgtcctggaaagaagactgaaggataataacatcccaggccaaggaaactgcgtgtgccaagccttagaggagccgtggggcaatggccttcttgtccctcagtcagaccccggaaggggtcatctatgtttggtgttgctcgagtggctcaaggctctgtgcctgaggcttgtgccttggccatgtgccagggcaggggtgccttgaccagagtggaaggccaccacctcaccagtgcctggccttggtgcagcgcaaggtgtatctggtggaggctgtgctcatgagcttcttgctgggcatcgtggagaagggcacacccacacaggcacagtccgtggtgcaccaggtcctggacctcttgtggctcttcatggaggtgaggctcctgacctcaggcctcaggcctggctgtcagtcttcactggggtcgggaagatacggggagaatcttggaaaaggccccagtcatggctgccttggcatctcttcccccaggactacgaggtacaagattgcctcaagcagttgatgatgtctctgcttcggctgtaccgattctcacccattgtcccagacctgggcctacaggtgggagcccctacccctgccctgagccccctgggactcgcctgtccactctgaacgccccctctccacagatccattacctgcggctcactatcgccatcctgaggcatgagaagtcccgcaagtttctgcttagcaatgtcctgtatcctttccttgctgcctggcaggccagacatggggtgccctctggactcagcagaggccaggaaggggagtgtcatcaggccaggggtcccctgggagcatcaggaggaccagagctgcccaacgtggcattttctctacagagcaaggacgagagagcaaaggactgagcctggccagccagcctagccagggggttctgaatgactgcagactcgggctacgcagaggtg

SEQ ID NO: 105800 - DNA, 1044 bp, Homo sapiens
agaacaacgggtggatgccccaggccagagagagcagggcctctggctggggcttaggccagaccaccaggaacctcttgaggagcctttcctgcctggtgcctgcccaccggactctgcgtgaagttgtgaagctttcaggaggttgggtgttggtggatggagggagtcccatttcaccagagggcgggcttgtttcctctttctgtcctggggtgtgggcgagatcttccttcagagccgccttcttttccctgtgggcccactccctcccacccccttgggaaggggaggtggccctgcgtcagctcttgagcaccactcctcgagagctgtctcagcccctgagggtggacgggaggctctgctacaggggttcttccacaggctgtagaagaacacagccacttccacagctgtgctgtgttgaaagccacaggggcctgggtctctcagcctcacagggcatttgggcactaggaagtccgcgggaaagcaggaactagcacaccttgcagggcctggggcctttgggtcctgtgcaggggcagagcagaaggcaggttggggaccacaacccctgtctctaccagtgagcgagaaggcccattgtgtttcgaggcccatacaggaagctggggggccaggcacagtgcttcccaccagtatctgccagttctctggaccgaagcagggagcagggcgagcagcaagagggtgggggcctgggtgggggagccctgggcagtctaggttgtcatgggaccctcggagcctatggagctggcggactcagagccagccttcagctgcaggcctccagggttgtagagatcgaattcctcagctactgccagctgcacgcggccattgaggcccctccggcctggctccagaaagactacgtgcttgtggacgctggccttgcggctgggtgcgtctggcggtgtggtgctgagtactgaggactgtgcgctcagctcttggagcgggctgggtgtttggggccagcggcggcagcggcaggcacggcggcagcagcgg

SEQ ID NO: 105801 - DNA, 1072 bp, Homo sapiens
ctgctaagctgcactggcctagggctgcaggacgtgccagccgagttacctgccgctactgcggacctcgacctgagccacaacgcgctccagcgcctgcgccccggctggttggcgcccctcttccagctgcgcgccctgcacctagaccacaacgaactagatgcgctgggtcgcggcgtcttcgtcaacgccagcggcctgaggctgctcgatctatcatctaacacgttgcgggcgcttggccgccacgacctcgacgggctgggggcgctggagaagctgcttctgttcaataaccgcttggtgcacttggacgagcatgccttccacggcctgcgcgcgctcagccatctctacctgggctgcaacgaactcgcctcgttctccttcgaccacctgcacggtctgagcgccacccacctgcttactctggacctctcctccaaccggctgggacacatctccgtacctgagctggccgcgctgccggccttcctcaagaacggcctctacttgcacaacaaccctttgccttgcgactgccgcctctaccacctgctacagcgctggcaccagcggggcctgagcgccgtgcgcgactttgcgcgcgagtacgtatgcttggccttcaaggtacccgcgtcccgcgtgcgcttcttccagcacagccgcgtctttgagaactgctcgtcggccccagctcttggcctagagcggccggaagagcacctgtacgcgctggtgggtcggtccctgaggctttactgcaacaccagcgtcccggccatgcgcattgcctgggtttcgccgcagcaggagcttctcagggcgccaggatcccgcgatggcagcatcgcggtgctggccgacggcagcttggccataggcaacgtacaggagcagcatgcgggactcttcgtgtgcctggccactgggccccgcctgcaccacaaccagacgcacgagtacaacgtgagcgtgcactttccgcgcccagagcccgaggctttcaacacaggcttcaccacactgctgggctgtgccgtgggccttgtgctcgtgctgctct

SEQ ID NO: 105802 - DNA, 1048 bp, Homo sapiens
aggggtcaggggctcccgtaccttctgactgagcccgcccgtcggcctgcgttctgacaggcaggcgtggaccacgtgatcctggccgtgagctacatgtcgcaggtgctggagaaggaaatgaaggcacaggagcagagggtgaggcacagactcttggcccttattctcggtccccgcccaacttcccatcctggtagaacctgactgggggggcctcttccttccagctgggaatccgaatctccatgtcccatgaagaggagcctttggggacaggtcagtagaggcagaaaggtcccttgggggagggtttaaggccaggaaaagggtaagacccagcctggagtgggcctgctgagcctgaatccagggactcagacctccagcaaggtggtgacctgtccccttcccccagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtaaggcgccaggtcttctctctcttgacactttcaccctccatgcccagcctcccatgccccctagccttcatctgccttcggatgttatggatacagagctgtgcagtatgtatctttaagcacttggggcagagtctcttgagatctggaacggcatgtgtatcaaggcttaggaacactggactaggtccgaggtccccttccttgcattcaggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcagcgcatccaggtgtgtaggagacagctgttggtgggctggggtggggcaggccatcaccgccatgaccctgctcacaagctgcccactcccacagctgcagcctacgtccattgagaagga

SEQ ID NO: 105803 - DNA, 1042 bp, Homo sapiens
acccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacggaggcgagtctgtctttgtgaaaatcccgtggcccgggagccttccctggtcaccctcggggcgaggccggggccgtggggcggggccggcggctgctggaccgcggcgaagcagggaacaaggcctcgcccttggcgccagttccgcctttggatccgccaatg

SEQ ID NO: 105804 - DNA, 1381 bp, Homo sapiens
tcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcatt

SEQ ID NO: 105805 - DNA, 1203 bp, Homo sapiens
atttgcagttacctcacatgagtagaatcatgcaatatttatccttttgtgtctggcttatttcacttagcaaaatgttttcaagttcatatatgttgtagcatgtataggaatttcattcctttttattgctgaataatattccattgtatgtatatcccacattctgcttatccattcatctgttgatggatgcttgtttcttccttttgtttattgtgagtagtgctgctgtgaatgttgacgtaaagtgtctgtttggatccttgtcatttcttttgggtgtatacctaggaatggaattgctgagttatatataaatctatgtttaactttttgagaaaccaccaaactgtttggtggctgcatcattttacattcccaccagcagtgtacgagagttctaatttcttcacatactggacacttgctccactttcttctttgattgtagccatcctaatggatgtgaagtggtattttcatcacataatttgacaaaaatgttatttttcagatagttttaagagacataagatagttttaagagacacaggaagaacactactcataacatttactcatttttattggctcatgggaccttaatgcaacccattagcagggtctgtgggtctgtcattgtggacagatctgtgccctgtgcagcgggaccccagaggatgacttgcctgagtttcttagtgatgtgtatgttcttccttcttagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacagtatcctcgttgcccctccttcaggagtgtctactgggtccataggtcgtgtgttggggcaccattctgcctatggctgaggtctttgtctagggtccctcttcggtttaatctccctttttcatggactcctcttccttcgtttactttcatcaacatgtttttttcctgccttttggatttggtaaggccgaagcttaaaacttggcagtctagaacagtgttgtctgatagaactgtctgtaattctgtgtgcttttcagtatggtagccactggccacactgagtgg

SEQ ID NO: 105806 - DNA, 1422 bp, Homo sapiens
aacacagatttttttggaccgtcttggagggagaagtgttgatgtccctttggctgacactgtcaggcagaaggaaactagatctaaaggaggacacacacaggaaatggcagcataaagcacttaagtaactagagggttaagtgatgccaggtgtgggtgtcacctagcgaacacagttcttttgaatggtacaaaaaatcagtaattgaaagtgagagggccagataagagaaggggaaatatagacttatccaggaacaaaggtaagcatcagatttagcttggggatggacggtcatccattttctggaagttactgtctgctggctgttgttctgatattgatctgtagttggttcagggcaggtgatgtcttcatgctgtgtgggaaagtgagtgccaacagtctgtgctgcatagactcggcctgtgttgacatttgtttaccaactgccctttttttaacaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagaggtaagaggtacatgtttcgtcctgctggtacaagcactcaagacgtctccatagtcctgacacatcatggggaagcagggctcacagtcaaggttggataagatgactggtgttcttgggatacccacacaggtgtagcctcttctctgtgtcacatcaccccagtggtgcctctttctgggtatagctgtagctggttgagagaggaagtgaagctctctcagccgtttggaagcagggacaccctgtgctggtgacaaaaggttctctggcttttcattatgtcttgccacccacaggacagaaggttgaaatacattagttcgtagcgaggctccaaatgctttctgacctgcaggatgtccaagcccaagggctatgagtccaaccaggagttccctaatggtttttgtgtcagacctctgagaatcatatcagtcattaacgctttccctgcaactaaaatttagtttccgttgtgttggaaattgatttttcttgtaagttcaaattatgtttttttgtttgttttgagatggagtcttgctgttaggctggaatgcagtggtgccatcttgcgtcactgcaacctctccctcctgggttcaagcaattctcctgcctctgcctcccaagtagctgggattacaggcgtgcaccaccacacccagctaatttttgtatttttagtggagatgttgtgtcaccatgttggctaggctggtctcgaactcctgacc

SEQ ID NO: 105807 - DNA, 1074 bp, Homo sapiens
ctgcctggtccttggcaccttcagtggagaatttgggaatctcatgtgacctaattcctcagacagaaacccttcctctgagtgaaggagagacccttaccagtactggatatcctaaggagtctgaacagaacaaattcccattgccttctgtttttttctgatctcatctttgggtgtgaagtaaaccgggataggtgctttcctgatggttgtaatgtgctgtagctctaaaataaaatcctttagataactcagaagggaggtgggaactaggaaaggcagagaatgtgggcttctgtgcacaagatagatggaagaggccaaggttgcatcattcagcaaaaatttaaccaactgcctttcatgtgccacgtagtattgtacgtgctagggatacacatagtagggaacaaaacaagagtccctgctctcactcatggagctccagggaaattgtgactcacccagtgttttgattccttcttcctctcttcttttctgtaggacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggtcagtcactggccagtttaatgaaagcagcagccttgggcttatagaccccttgccacagttttttcttggtttgtttgccatgatatatcattgtaggtcttttttctcaaagcacgaagtcactttgttagataaaattagaggctgaaagcatcagcaaggtctttagatcttgaaaattgaatttattaataggtaaagctgagaaaaagt

SEQ ID NO: 105808 - DNA, 1127 bp, Homo sapiens
taatttttaatgaaatgttgaggaaatctgcaaatatacctgtgaaatgtgaaggcactaaaggtgcttcactttattctataaaaacattgcaaatgtggctgggcatggtggctcatgcttgtaatcccagcactttgggaggccgagacaagtggatatcttgagctcgggagttcgagaccagcctgggcaacatggtgaaaccctgtctctacaaaaaaaaaaaaaaaaaaaaagccaggcttggtggcacacacctgtgttttcaactacttggaaggctgatgatatgggaggatcacttgagcccaggaggtcgaggctgtagtgatgtagtgaactgtgttgtgccactgcaatctagtctggacaacagtgtgagaccctgtctcaaaaaaaaaaaaaagattgcatatcaaacccaagtggttaatctgaggttgtaaaaatatgttggccaaataatttggaattctaactgaacttcttagagtatatacctgctgatctgcatttttagtgtgtgtctgtgcctgcccaactaaagaatctggtgaccaggtattgtcttgcaattgctgtagagacagtgccttcctagctcttaaagtagtcctgaccttgttcgccactatatctgattgcagtctctttttccctgccaaggttttttattcattgtcactttctaggcttgatgtgttgttgcattaaaataaacacacacaaaaaaaaactcatatgatttctcctaaatttggttcaacaagttctttagtctggttcttctccttactatcattattattgtcattgagacagcatcttgctatgttgcccagactggtcttgaactcctggcctcaagcagtccttccaccttggccttccaaagtgttaggatgacaggtgtgagccaccatacatggcctgattcatcttttttttttttcccctgagacaagatctgaatctgtcacccaggctggagtgctgtggcatgatttcagctgattgcaacctccacctcctgggctcaagccatcctcccacctcagtctcctgagtagctgggactataggtgtacaccaccacgcctggctaatttttgtaattttttttt

SEQ ID NO: 105809 - DNA, 1255 bp, Homo sapiens
gttattgaatactgagtcactgcacctagacaaaataaatggttaagttcctgtaggcctctggtcataatttctttttttttttgtttaataaactctcagccagtagaagatgatctagtcatattttcattaaccaattaatatacaaccttccagatctacatacatacaatataaaaccttttaggtatgtttctatttaaaaacaccttatttaatataaataactgattcattaacactgaactatagttaacagcattataactcatgcctgaacaaaacttccctacacattccttgtaaggtaatcaaagccttcttgtgtttaaaaacaccaggcagcacttcaatacgtttgggggccattttaagcatcaaaatcaccaacaaggccaggcgcagtggctaacaacctgtaagcagtctcgaaaaaataaaaaaataggcttctagcggccggcttcattgggaactatggctaaacatcatcctaatttgatcttttgctgcaagccagctggtgttgtcattggaagattgtgtgaaaaatgtgacagcaagtgtgtgatttgtgactttgtgcgtccctgcactctggtgtgctatgtgatgagtgtaactacgtatcttagcaggggtgccgtgtgatctgtggaggccctggggtctctggtgcctattactgtaaggagtgcaccatctaggagaaggatagagatggctgcccaaagattgtcaatttggggagctctaagacagacctcttctacgaacacaaaaaaatgcagcttcaagaagaggtgattggtgggtggccccttcctccccacaacatcaagctgctgcagcggctagaaaagatgcctgctactcccggcagaaagggagcagagcccagagcatcaccaggagtgcctgctagtgtcctggcagcttaccaaccctcccctcccttcacccagacatgtggtagggatggaaaaggattcttcacagagcactctggcacactgtattggagaaaaattgatagattagttaatggtttttcttgaatttgagaagcaaagatctgttctccatattgatatgttctccctcaaccaagatcttctaagaaataatattttagtcttctgcttgaggagttgactgtgaagctacacccagtgaaaaacatgatcttgcagcagctctggtggcagctgtccttgaagaacctttggtgtatggtgggaagctatcagaa

SEQ ID NO: 105810 - DNA, 1070 bp, Homo sapiens
acctcatacattgttggtgggaatgtcaagtgggccacttgggaaaacagtctttatgtggttaaacatagagttaccatatgacccagcaatctccctcctggctatctacccaagagaaatgaaaacaaatgttcacacaaaaacttgtacatgaatgtttatggcagcattattcataatagccaaaaggagaagcaacccaaatgtccatcaactgacagataaaatgtggtgtatacatacaagggaacattactctgcaataaaaaggaacgaagtgtgatacatgttacaacatggatgaaccttgaaaacatgttaaagtgaaagaagtcagatacaaaagttcacatttacatgattccatttatgtgaaatatccagaataggcaattctatagaaacagaaagtacattagtgattgcttagggcttggaggtggttgtaggggatagggaaaaagatagcttaagagtatggaatctctttttgagatgattaaaacattctaaaattgtgatggttgctcctatttctgaatattttatactttttttaaattttatacttaaaatcattgaattgtacaccttaatgggtgaaccgtatgatgtgtgaataatatatcaataaagctgttaattaaaaacgtattggctggacatggtggctcatccccgtaatcctagcactttggaggctgaggcagtaggatcacttgagcccaggggttcgagaccagctctggaaacatagcgagaccccatcgatacaaaaaataaaaaaattagccaggcgtggtggtgcgtgactgtaactccagctactggggagtctaagatgggaggatcgcttgtgtctgggattttgaggctgcagtgagctgtggttgggccactgcactccagcctgggtgacagagtgggaccctatcttttttttttcttgagatgaagtctcgctttgtcgcccaggctggattgcagaggcacgatctcggctcactacaacctctgcctcccaggttcaactgattttcctgcctcagcctcctgagtagctggga

SEQ ID NO: 105811 - DNA, 1049 bp, Homo sapiens
aaaagaaagaaggaaggaagggagggagggaggaagagagaaggaaagaaagagagaaaggaaggaaggagagagcgagaaggaaagaaagaaaggaaggaaggagagagaaggaaagaaaggaaagaaggaaggaaggaaaataaattgggtgtaggcaggtgcctgctgggttgctggagggttgctgctgggttgtcgatgggggtgctcagggcactgggggctgaatgtggttgccagcatctctgttctgtcagatgagcattatcagtgcccaggacctgccacacttccctggacctttctccatcaatgagcaaggttggctgcaggcaccatcccagggcctcctaggccaggctcaaaaggtgagcatgacctggaatctgagggtgtttatggattgggtagagtgcctaccttttagaaatttgtttattcttggcctccttggcctccttgactaatactgactctctcagacctggacctgctgctgcatgctgtctgtcctcccaccttagcttggttctgtgctgggctctggagttctagaaagaagaggaatccctctctctgggaattcacaagccctctaatagaaagaaaagtgtttagggcaatcacacagtaagagaaagtcctgggtaatggccaggcacagtggctcacccacataatcctagcactttgggaggccaaggtgggcgttgtcacctgagttcaggggttcaagaccagcctggccaacatggagaaaccccgtctctactaaaaatacaaaaattagctgagcatggtggcgcatgcctgtaatcccagctactcgggaggctgaggcaggagaattgcttgaacccagggggtggaggttgcagtgagccaagatcataccactgtgctccaacatgggcaaaaaaaaaaaaagttctgagtaaaatggtcagtgcagtctggaggtggctttcagcaattctaagatgataattcacattgtcaatgattcagatatcactctggggctgtttgtatcctaatggaataat

SEQ ID NO: 105812 - DNA, 1103 bp, Homo sapiens
ttgtctccctgggcagtgcctcacagggctggggctgcctcttagtgcctcaggggtatggagccaggacagtctagaaaaaaggcttttattgtcccaggctggagggcagggtcagaggtagctgacatcattgcagatgatgggctggcggctacgacagctcatgagagctgcaaagcgtgagacatccgcaggcagttcaggttctgggcgaggtgggcatgacagccgctttcctgccatagctgtccgccgagccctggccagccggcgccgaagctgctcagagaggccaagcaggaactgagggggccgagcacgggcacggtgcccacctccgtcacccccttcactccctgtctcaggcagctccatccagttgtgcaccaagtcagcaaagcaattgtcccctagtaccaggggctggcgactgcgacccctgttcagtagggctgctgtccagtcctctgcttccagtccctgccagtgctccaggcaggcgtctggggtggacttgggccgtggatggtggacaggtggtacactggctacaggggccctgctgggcatggggaggccactgactgagaggcactgcctacgaaggggctgtgctgagggtgctgggcgctgggatacaggcagttcttcctctcgccatgtgctgcctgacacctccgagaagccagagtcccagtccagggcatgctccctggggcctcccaaggctgcatccctgtcttctgtcaccactgcttcctcctcctcctcttcctcctcctccacacagcagactgagtcctcttccaaggcacccgaggccctaagctggtggctgggctgcacatctgggccagtttgggaggttggctgcaggggaccaggcattgagggtgagcctgtgtcccgaccacacaactgaggggaagagagggcagaagtcggagaggtatcacttgtcaccaggccagcccagagaacagagggtccaggaaggttagataggcctgctggcctgggcagcagggtgttagtgagcacagggcaggcataggggtgctggcactcgaagctggtgtggttctcatccaccgacctgg

SEQ ID NO: 105813 - DNA, 1040 bp, Homo sapiens
gtgggtagggtttgggggggatgtgcagactgctggcatcatgttgagtcttacctgaacccaggatgcagaaggctttactgttgggtccaataatattggctgccctaggtcattgtacatagtttgtttagtgtctttgagaaaagctcttctatttattggcccagggcagcagcctaactgcctagtgttctaccaatgcagattaggatggggtggagccaagctcacaatttcatcagtgttccagttttcaggcctgtttaatgcttttgcaaggccctccctttccttcatggaccccctccttgtgggttctggctgctgtgtcagtctcttgtcccctggccatgctttgtctcccagaattttttggaaatctctgggggctgatggtggttgccccttctacttgttgcagtaggattacccttcatacctgtcattttagggaggcatcagcatgtagccaccacccccaactacagagtcaatgttaggaagatctctctcatgggccccaagggcccctgaactccaggctagagacagccagggagacctttccttagggtagggtaaggccgccaggagccatgagttcatggaggagatgttgactaatcccatgccacgcaggcaatgggctgctcaaggccttagctctgttctggaaaggggagctttgagtgtcttgcctggctccctgaggcctctggcatgaagccctgtaacttgaccatgggtgggtgtcccaagggtgatagtgtcactcaggagggcctcaagccagcctcaaccagtgagggaaggactactaagccctaggttctttctccttgtaggacaaacagaaagtgggaaggaaagaaagtggacccctggcagaaagggaaataggcttcaagctcatgaaggaagaagaatatagaaacagtctaagacaaggccgggcgcggtggctcatgcctgtaataccagcactttgggaggccgaggtgggcagatcacgaggtcaggagagcgagaccatcctg

SEQ ID NO: 105814 - DNA, 1017 bp, Homo sapiens
gcacagctgcttttacttctggcatggtgcatccacaggctgcaggatgtaggaagcagcctttgcttctaggcagctccggatgtgcattgccagactgaggcctagcctcagagagctgggatctctgcccatatctctagtctcttctgggctaccttgatcactccctggggagcagcaggagggggcagggcacaaggctaccacttggcttgtctttcattccctacactttcttatagttgcagacagtctactctgaattggatcaggccaagttagaactgaagtcagcccagaaggacttacagagtgctgacaaggaaatcatggtgagggacatccctggcttgacaggaatgaggggtggtttgtgtgccctcccagagcagggctgggctatctctgcccaggacccttgcaccagtcagtggtggttctgggcccctgcatcctcctgggtcagggtgtgccccttggccctggtccggactggagcctgggcctcctcaacagagggcagacagaaccatgagtcttccctcatagtctgtcctgcacttacatccctgaggtcccttatcagaggaggggctctacctggggcttggcctcctgagcctaatgatgaggtatcaggccttgctctgttcccagtgggctggcctttcatgcatgctgctcatgtcctctgcattatctccggacttgatgcctcagcctttctctcacacacttttctttccctccccaagagcctgaaaaagaagctaacgatgctgcaggaaaccttgaacctgccaccagtggccagtgagactgtcgaccgcctggttttagagaggtttgttgagccttgggcggtacaggggtcacaaggtgggagagctttctggtaacagtctttactcctcctggctttggtggggtgggtgacctctgtggacctgatgtctgcagacagcctgccctgggagccagccaagatttagctggcaagcagccttgaagcaa

SEQ ID NO: 105815 - DNA, 1883 bp, Homo sapiens
gcaggatgagaccaaacaagcacaagaggaggcccgccggctcaggagcaagatgaagaccatggagcagtgagtttggagctgggtcctgcactgtgcctttgcccccagggcctgcaagtggtacagttcttaggactgcagcagggagtgggattgggtcatgtccgaggctcaaatctccataggccatggagggctcaggtcagctgggtgtgggcacagatcttagcctctatgaactcttcccccattccaaggaatgggagcccttgccacattcctccctgtctctgctgcctgtggccagatgacctggtgggtctttccttccagaaacctctctccaggaaatccctgaccttgagaccctctttcagcacctcttctttctcagcagcatccttggagctatgctcatctctgccacagggcctttccttgggcacacccacctactaaagcatcctggcagcctagcctgttaccttagcaacggcagcaaaggaaggcagagcggcactgggtacctacccatcagcctccagattgcaaatgccgtgggctgggtgtatttttcaggattgagcttctactccagagccagcgccctgaggtggaggagatgatccgagacatgggtgtgggacagtcagcggtggaacagctggctgtgtactgtgtgtctctcaagaagtgcgtactgtggcccctctcagcaaacacaggagataggccatggggccccagccgtgtcattgctccccatctcttgtaaagcagatggaactaaggggcaaactctggagccatgctgcctttgtttgaaccctgattccacctttcagcaactatgtggcctgctgccagtttcttggcctctttgaccctcaacttcctgaatggaaatagtagtagacctgcctcataggattgttgaggatttagtgtgaatcttaagtgctgtttctaagggagttgacctagctctctgggctataagccccattgtgattgatatgtagagcctgttccccattagcactatgatcctgcctggctgggatcaaactctactcatattcttcactctggtgggtgtaaggttggcaggaagggtggagggccacttagctgagaggcatagagggtccaagatgcctcctttaagaccaggtggtttagggagccccctagtgagactggggctttctgcatgccctctcaagtcaccagtgcctgcaggacaggcaggaggaaatagtcacttccttgcattctctgcaggaccctccacagtgccacctggtacttgttgggctcaggtgtcaaagtaggaatgagagtgagttgaggggttgggcagtgctttgtgttagattagtgctgtggctcagtctgacctgcaggtgttcttttctggcatctctttccatggccacattgcagagagtacgagaatctaaaagaggcacggaaggcctcaggggaggtggctgacaagctgaggaaggatttgttttcctccagaagcaaggtaacttagcagtgaacagaggttgaaggagaagtggctctccttttgtcatgttcactctggtctcctgagcaaggccatgggacctgatggcacagctgactccctggggcagctggaggacttacagaaatttgttaccagtccttactgggcattggcctgaatatgtggcttgtccactaggggtggacagatcacagaggtatcccccaacatgtggacactgatgctcccctctgctcttcctggctcctgggtacctctcagctggctggagagcacaggcctcaaatgtgacagcatcagaggcctatttttgtaccacatctggagtagaagggct

SEQ ID NO: 105816 - DNA, 1056 bp, Homo sapiens
aggtccctgtgccttgctcagccagctgcctggcgtaggcagctcacccaagtgctcctgccctacccctgattctgcccacgccaggctcaggggctggtgtccctcagggccacggggagggaggtgtttgactggatcctggaccagggctactactcggagcgagacacaagcaacgtggtacggcaagtcctggaggccgtggcctatttgcactcactcaagatcgtgcacaggaatctcaaggtgagggcagagccagagtcaaagggccagttggcagctgggctggtgctggggtgggcagcacctcagggccttggtctagcctccaaggtcctcatggtgtcttctgctcacccacatgctattctcacaccacagctggagaacctggtttactacaaccggctgaagaactcgaagattgtcatcagtgacttccatctggctaagctagaaaatggcctcatcaaggagccctgtgggacccccgagtatctgggcaagcagggggtggggcaggggcagggggataatggggggcagccttcagggagctgctctgggcagggggaaaatgtgctcatctcaggaagctggtgtggatggtactggacctggctaggcctgatactgaccagcagatgggcgctgtgtttgtagccccagaggtggtaggccggcagcggtatggacgccctgtggactgctgggccattggagtcatcatgtacatcctgtgagtggacagatggacaagcaggcttgcagtcagatggggtgggggcatgtgtctgtggcctttctgtgtgacccttcccccatgcaggctttcaggcaatccacctttctatgaggaggtggaagaagatgattatgagaaccatgataagaatctcttccgcaagatcctggctggtgactatgagtttgactctccatattgggatgatatttcgcaggcaggtgaggaggtgcctgcccagcacttggtagaacgcaagggagtggggagggtgtcctgctctcatcttcctctgtggtattctg

SEQ ID NO: 105817 - DNA, 1036 bp, Homo sapiens
agtggttttaccaaactgctttacaaaggggagtttgccctctcctagcagtgctcacgttcttcatatatccactaacacttgttagctctagaccttcagagatgactagcaggtgggtgggtggttatagcccccttcatctgtaaaatagctgaaatttaaataaactgtttgataagccttttttttgaatgtatagaatacaaaactattcccttatatatcagcttaatacattttttcatatgtaggctgttgcacttcaggcagccaagctgagtagctggatgtctagccagaaaagcaggggtaggatctaagcctgcctatcctctagcccctcctggtatggtctctgcccctagcttggcctgagccaggttggggtctcccaaaagcagcccctatgttgtggggaagtggagagtagtacagctaagccagaccccattgtgcccgcaggttagagcctggcaatgccgtttgggtgtgtgactctgggcgacaagaagaactataaccagccatcggaggtgactgacagatatgatttgggacaggtcatcaagacgtgagtgccgggcctgtcaggcaaggctgggtgggctggtgagcaggggctagggaagtggcagtggagtgcagctgatgctaaggccaggcctgagtgggtgcctgtcggctgcagtgaggagttttgtgaaatcttccgggccaaggacaagacgacaggcaagctgcacacctgcaagaagttccagaagcgggacggccgcaaggtgcggaaagctgccaagaacgagataggcatcctcaagatgtgagtttgaggcctgggattggggcggggtgggaggcagcagggaagggcttagagggcaagtggcctcaggcagtcccagcctctggccaattagtctgctgtggccactgtggtgaccacagcctctcccaggggttcatccagccctaactactggctcccctccctgtcgccagggtgaagcatcccaacatcctacagctggtggat

SEQ ID NO: 105818 - DNA, 1151 bp, Homo sapiens
aattcttgaagaagggacctgaccaacacatctcccctccccctccccttgttttaaaacttccatcaccatagcaaccctttactctagtgccttcctctgcatttcccctcctccacccacagggaagcagagcctccagtggattctccttcaggggttcagagatttggaccccaagtgcttgggaggagacagctggcctttggctttgcctgcatgttgacagctaaactttcgggatgtagcactggactgcatgcccacccccaaaactggagagacctccccacaatactccctcattagatgggcaaaattcagctgtaggaacttctaccatgatttagctcgagccggaggctcagtcagggcagccccttgaccggtcccctgaagcaattggatggtggtctagaagcttggcccttgttcttaacagaccttgagggaggtcttcagctcccctggtcctgtgggtgacacctcagctgtgagttaagcagggcttgggcttcagcatgttcattgcagcaggaaacccagccccagcccttgagagagtagagcagcagagaggagggggtgcctgcaggctggtgttcacagctgccactaaattaggaggtgttgcctacagttgttgggaggcagctggaggcctcttgggcccctcctggcctccctagatttactgcaagctctggagccccacgtggcaggggaccaaggtagcaggaaactctgtttatgtctatgaaaggtagggcctgaaccaggatgatctcagcggaggaggggacaggaccccaatgtggggcctccggacctcttggcctttgtcccgtttgggctttccctgggccagacttacctaaagatgcagcagagtccctgggggaccatttatcaccagggcaccaacagaggacccctcaggattgctggaggctcaattccctgagtccagtggtcaggccctgggagcaggccataactggggagtgcttggctctcaggctccatgagagccagctggagggcaatggccgcaccagggcctgcactccccacaagctccctctgggcagccggtagtgcatactgttcagttcctctgcagagagtggagggagccatgtctccaggga

SEQ ID NO: 105819 - DNA, 1036 bp, Homo sapiens
aggatggggaaagcgaagagctgcgctggaaggcggttttcggagggagctgccgctgaggctgacatccttctttcctgtcccgctctcagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccaggtgagggagggccttgagggcactgctgtagcgggacagggacatgtggagtcgggaggctgtttggtcctgagctctgagatgtagccctgaagctgtccctacctttggaagcagaccagtgtgctgggcctgttttactctggcaccagagacccagactctccatcaccccatg

SEQ ID NO: 105820 - DNA, 1090 bp, Homo sapiens
ctcactgcaacctccgcctccagggttcaagtcattctcctgcctcagcctcccaagtagctgggactacaggtgcccgccactacgcctggctaattttttgtatttttagtagagacggggtgtcaccatgttggccaggctggtctcgaactcctgacctcaagtgatccacacgcctcagcctcccaaagtgcagggattacagacatgagcccccacgcccggcctaggtcttgtatgatcatacattttgccttggcattcatatggctttctaaatttcaccatatacatgttgctttggaatgtcctaatttgccaaagagtttcacctcaacttctgtgggcatctatctgtaatctcttgccccaagtgcctgttagtctgtagtctgctttgcagctttcattagcaatacctgctgctttctctgcctgagttttgtattaggttgaaatagaaacatgcaccttatgtctgtccttcaaatacccccgcagacagggtagaacagatatgtacgataatttgcaaataaggtctgctttgctctttgagggagggagctgggaattgggcttctactgctttaagacaaaaaacactgccatgctggagagggggtagggcaaggttgagtaaaacaccacagaactttccttctgttttgaagatggctttttcttcattggatatttgcttgtaaacctttgactcttttctaaaactgtcaaatttggttcagacagttactacttgtttttctgatgtttctatgaaggaatgagaccttgaaacttcctagtctgccattttgatgacctatgggctgtctttgtactctcttgatagtgtcctttgatacacagaagtttttaattttggtgaagtccctttatctactttttcttttaaagttccttgtgctgtaggggtcatatttaagaaatcattgccaaatccaaggtcatgaagatttgcctctttttcagtagctataacaaaggtcctggaaataacttcttatcttgacttgagttacatgtctgtcttcaaagcaatgactgtggtgagggtaatagatta

SEQ ID NO: 105821 - DNA, 2877 bp, Homo sapiens
actttaagaaagggttggccgggcatggtggctcacgcctgtaaccctaaccttggggagacagagatgggtggctcacctgaggtcaagagttcaagaccagcctgggcagcatggtaaaaccccatctctgctaaaaataaaaaaattagctgggcatggtggcgcatgcctgtaatcccagctactctggaggctgaggcatgagaattgcttgaacccaggaggcagaggctgcagtgaaccgagatcatgccattgcactccagcctgggcaacagagcgagactccgtctcaaaaaaaaagaaaaagagaaagaaaaggtttggcattgcaactatttctcttgaactgagtgacccagaatcagttgtcctttgaattttagtatagtagcatagtctgagctcagaagggccttatgatagaccctgtatgttctgggaggcaagaattgagttggtattaatatcttaatgcttttgttttactgctgaataacagatgacccttcaggtcttttcatgttttcctttttcatgtctccctgcctaggatcctaggtgcctaattgcctacttaaactagtttagggaatcttggactgaagccaaaacatgtaaaatgccctgaaggttaggcaaagggaagaagttgggtagtatgaaagattaggtcacatcttgtttatctcttgagttctataaattgagaatgtaaatttaatactatgtctatttttaaaatgtattttattgccatgaaaaagtagcatgagacattggaatatggaatatcagcttcttcatttgggtcatggggatcatgcttgaagacctaatgctctctctaggtctatctcagcattgagcccctggatgctgttgcgtggcttagatgacttatacatgctttgtggcatgattcatactaccttctaccttctgtgatacccttgggtagttataataggacccaggttagagtgcttcttggtggagccactgtagaactgggatttagatgcagccagggctgatgctcagctggtgaacactggtgtgcttgttcctactggtgatttacaaccagtgtttcttctttttgggcctgcatccattttgattgggtggtgtccatgctgtatctgtaataaaatatttttgaatgttaccgctggatgcagcgtgagaaagatacctcctgaaacttactgtaagaaatttacagtgcattgatttttctgatatataggaatcgtcatgttgaccttggaattcttaagttccctggctgtaggaaatggaaatttttgtagtatgtcaccattgttagcttatttggtattgcggattttccctgttgcaggactgggtgaaagctttttctgcagcagtcatgttgaaaaccttgtgttgactttcctcgtgttctgaaatgggagcataaaagtttactccgccacttcgtcttaaaatagcaaaactttgctgttttctgcagatctaggaccttgttacagaactctgccaaaaaaaaaatgtttacagaagaatgtgctgtgattagagaagaatatgctggtgtgtagatttcaaactctctggacaatatgaataacactgtctttgtttctacagtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttt

SEQ ID NO: 105822 - DNA, 2069 bp, Homo sapiens
actttgaagactctttcagtgagacttggtcttagcacatttacattcttatgatttgaagtcacattctggcactcagaacaatagagaaaattgtaattttttatatcttcacgtgacatgtcattatcatttttgatcctgagtggctaaatttcatgttgatttgtgttttgtgcagtaaagtatatttgtgaaataatttttcattctcaatttaaggatcaagattataggaccggcccaagtgaggagaaacccagcaggcttattcgattaagtggggtacctgaagatgccacaaaagaagaggtaaggcatgtcttctctcctgtttctctgtgtcaattaaaaattaaaaaaaccttttaatttgaaaaattgtagattcacaagaaggtgcaaagaaatgcacagagaagtcttgtgtatttttttcccatcttccctcagtgttaatattttgcacaactgtggtatagtatctaaaccaggaaattgaccctggtataatacataaagtttattcagatttcaccatttatacatgcactcactgaggtgaggttaaaaaaaattatgacaaatgattgctctctttagacctgatcacatcctttagagcatattatttctggagtatgtacataaggatgcagtttatttacaatagtaaaaactagaaactgcctaactgccctgtatcaaaggattggctgactaaattaagtctgaacttatggcagtgctcgctctgtgccaggcattgtgtgatacttacaagcattagttcatttaattatcacatatttaatataatcactctaaatattaagcattactgtatgtaattgttctagatactgagtgacacagcagtgtatattatcaagtcactgcctccatggataatgaaaaagcaagcaaaaggattacacaattttagtcagcaaataaatactctgaagaaaactaaagtacaggcggggcatggtagctcggcctgtaactcggagacagagtcttgctttgtcgcccaggctggagtgtgtggcgcgaccttggtgcactgcaacctccacctccccagttcaagcagttctcctgccgcagcctcccgagtagctgggactacaggcacacaccaccacgcccagctaatttttgtacttttagtagagacggagtttcaccacattggtcaggctggtcttgaactcctgacctcaggttatctccctgcttctgcctcccaaagtactgccattacaggcatgagccaccaagcccagcccatttttgatttttttgaggcagcgtctcactttgttgcccaggctggagtgcagtggcacaatcacggctcactgcagcttctacctcttgggctcaatcgatcctaccacctcagcctcctgagtagctgggaccacgggcatgcatgctaatggggctgttttttgtattgtgtagttagggagacatcactgaggaagaggcattcgagcccaggcttgaatgccgtgagagaacagtttatatgaatatggggaaatgaactgcccaggcagttcatgctgaggaagtgctgtggccctggactgtaatgaacccagtacatcattttatatttaacacatgagaaactggacactaaaaggttacacagcaagtgagcagagagcttggaatgcacacagtatgatttcagagcttaagcctttgaaggttatgctcttctgcttttctttttttttttttttttttgagacagagtctcactctgtcacccaggctggagtgcagtggcgcgatctcggctcactgcaacctctgccgccagggttcaagagattctcctgcctcagcctcccaagtagctgggattacaagcacctgccactgcacccagctgatttttgtatttttagtagagatggggtttcaccatcttggtcaggctgatcttgaactcctgacctcaagtgatccacccgcctcggcctctcaaagtgctgagattacacgcatgagccaccgcgcccagcattttgtttgtttgtttgttt

SEQ ID NO: 105823 - DNA, 1527 bp, Homo sapiens
gcctcccgttggtgcctccaaataacaaccagctttagttttagctgtggttctttgtggatgtttgtccacacatgggtgatgaggatgcatgttccagttcttctgaatgcctgtgatatatagagtgttgcagcaattgccttgaatatattttatataattattaaacttgctatgcatgttcttcatggtggtggaatgtttatgcttgagcctaataggatttaataagcttgttgtatgtaaaattttacattcattgcttcagtaaaatttatgacttcccagagaaattgtacaaattagtggtttaattttcagttttgctttgagaatggagtcctgttacagttattttgttgaaatccatgaatagacccagaagagctttccctttgacatctgttctgtggtctgaatggtagattaaacttttcagaatatcctcctagttgtatttcacagtaccaatttcagtcatttcctttaaatcttactacagtaaaagtaggcaaaggtgaaatgccaagaactcaaggtttttgaccaatatttttagaactatgtataataataagtttatttatttaaaaataaaggtaatctttaggtgacctattttgcagaattttaaatggaagggaatagagcatgagtcttcacagaacttagaatttcagtaattcagttaaagacatcttcaagtaagaacatgtcatattttgaggatataatttactattagcagtttatcatgggataaaaattttgcattaactagataacttcttcagaatgcttctgcagaggaaaattatccacaaaataaattttggtgcttgaaagaatatggtgttaagttcagaaataatttgttctgtaatttgagaacaagctcagaagtattatttctcagagagccaattatttatttgttttaaaaacatcaaccctgaatttgtggaagcatgagtaagagtagatatattattattcttggtatctcacttatgttggttatatttattttttgcatatgccttatacatgctttctttgggaactcaaggtagaatttacaggctggagatgctttttaactctcaggataataacctcagtctggtttcatgaactgtgctttcattaagtattgatatgtttaggaaaggagatgtcttaatatttaaatagcagttcaaactccagtttctttagtattcattgactttctaattgtcaaatttgtcaggacagtaaaaattgtattaacatatagtgtctagagaggaagttcttaaatttgccgattgtggtagctgttagaattggcagactgaagacattgatacacatgggaaatcattcagggcagtgcttaaaaataaaacgaaaaatacctttcagcaaatacaatcttttcttggcattctgttaagttgtgttttttatttttgttttttagtgaaagaattggattgctagtttcatgttatttatattacatctctatgtgacaaatag

SEQ ID NO: 105824 - DNA, 1122 bp, Homo sapiens
ttcttaacaggggcatagatgtatgttttcaggcatatgggaccctttctgtaactaggcttctagagtttagaattaagattatttaaattggtctatgatcttattgaagagtgagaggctagagtgtagtggttaaaaacatcaacttgaatctggactgcttgcatttaaagctcagtattggtacttacttggttactttgatcagtttacctatcctttctttgccgccttctacatggctaaaatcaggttaataatatttacctcttaagatagtattgtgaatattaaatcagtatatacaaagtatttagaataaaatcttgaaccaacaagttttatgtaaatattacttactttcataggctagtttgctaattgctgaaaatccttatggcacaaccatgagtcttgaacacacagaataccttttttttttttaacgttttaggcagtatagttaaaccttaaatttctgttcttgtttgatagctaaagtttcagtcagaataaatttagtgttgggcttgtgaatataatattaaatctgaagtatgttgtcaacatatagtattgcagggttgatgtctagaaatgctatattagatgctcataatgttttctgtatctttttcttcccaatgtctacttgtcctttagcaaagtatgaacgttgtcatgaatcttttctctctgtccacagattctgtgtgctcctctgggccacagtagttacttctttaagcacagaaaggaaacttagggctttgccagttttagtattagttctctatgtttttcatccgggcagctatggagagggttgctttccacacacctgggtactccattgatatgttctgtagaggtaatcaacacactagagagtacacctgtttgttccatggctaaccctttctgattgtagacatgcatttgagtgtttgcagtggatatttggtgctaacaggtgtcttagttccttctgttattctgtaatgtttcccaagaatattcagagctgtttataaaatgcagagtgatttatgtattaggtgttcaatgagtttgatcaagaagattcacttgaaaggaattaactaacaaagcagtttc

SEQ ID NO: 105825 - DNA, 1034 bp, Homo sapiens
ccagatcaccagtgctaaagagggcaaaggatcttcttggttaatagaaaaggctgttttggaatgaatctcaaagtccagaaacatcgagacttttcttcaatacttttttctatttggggtagcaactttacctagtgtaggggagggaggggttagttgggagggcttgtgtttaaggggttcagaaacaggggatttaagtgtgtcttttgtgtttgcaaggcactaacaccactcccgtctgtatttaaatgctgtccccaggttacgactatggctatgtctgcgtggagttttcactcttggaagatgccatcggatgcatggaggccaaccaggttgctttatacttcggtcaaatgatgctggaaggatatatttttttatatatggggagggagggtttcaaatgattttactttggaaaggtacaagaagtctatctgtggagcatactgtattccaaccatcggttgtgaggaaaatctttaaaaaggctggaaagctttctctacaaaacttaatgggcacagagtgcattttaaaagctagagcccagttgcttttggactagattccaaagacaatagttggaaaaaaaaaaaaaagacacatctggagtgtttccttttggagtgtgactgagatggtaatcctgatgcaaagaatgatccttgattgtctgtgaccccaaggatctgcctagcacagaaattctaggtcaatagttacacccagacctagggtgaagacctctgatggtgacttctgtggcatcagatcctgcctgcaggggctacttccaaaagagagctatcagggaagagagaggagtggattgttggtgtctattgcattcatcattgttttttgccaattggagttgcatactcaagtccttggctgcgtatagtcagagctggtgaatcagaatctgtactcaccttacgtttgaactatctggagttactcagcttgccacctagatttttcatctatgtctttaatagaaccctacctggtagttttga

SEQ ID NO: 105826 - DNA, 1011 bp, Homo sapiens
aggattacttgagtctggattgagactgcagtgagctgtgatcactctgctgcactctagcctggggtgacagagtgagaccccgtctcaaaaaacaaaaaagtacagttaactatttatatagtctttattaggtattagatataagtaatctagagatggtttaaagtatgttggaggatgtgtgtaggttgtatgcaaataccatgtgattttatataagggacttgagcatcctgagatttttgtgtccttgtgggtcctggaaccaatcccctgtggacaccaagggacaactgtactaaccatgtgtcagaaactgctacatgccaattttggagagaagaaaaaagcttccaatctgtgtgctttcggtggatcctattctgacagtctgtccaattttgagaacactcattaattcataagcagtgaatgtgattaagtcgttcgcctctgtgctaaatactcaatgtaatagctgatagctgagtgctataaagaaaatgaagcagggtattgggagaatgcatcatggtggcaattttagaggggtggtcagggaaacttcttgaggagtgacatacatttaagttgtgactcttggcgaataatgtatccagaacacttactatagtacctagcacttggtagcatttgaattaatttgaaattcagtgtccttctttctctctcttaccctcctccacatgtcaagtaatttccaattataaattttgtgtgtgtgtgtgagacggagtccagccaggctggagtgcagtggcgtaatcttggctcactgcaacctccgccacccgggttccagagatcctcctgtctcagcctcccaggtagctgggactacagatatgcgccaccatgcttgggtaaattttttttctttttttttttttttgagatggagtctcgctctgttgcccaggctggagtgcggtggcacgatctcagctcattgcaacctctacctcctgggttcaagtgattctcctg

SEQ ID NO: 105827 - DNA, 2553 bp, Homo sapiens
ggcaggataattgcttgaacccaggaggtggaggttgcagtgagccaagattgcaccactgcactccagcctgctgacagagcaagactctgtctcaagaaaacaataaaattgaataaataaataaataaataaaataaatatttgtggaagataaaatgtgtttgtaggccgggcactatggctcaagcttataatcccaccactttgggagaccaaggctggaggatcacttgagcccaggagtttgaaatgagcatggggtaaatagtgagaccctgtctaaatttaaaaaaaaaaaaaaaaaaaaaaaagtctttgtctatcctttcccccagttttacttacagaccaaattggtatggattctgagtcaccacgatctgcttggcaactcttagtagagcctgagtgtgtgtgtgcctctgagaaggttactccgaagtactttgagtttttttgtaactctttgctattccgactcttgatgtgaaatgtcttttatttatcattggctggtacttgtaggcctaggggatggaaataaaggaattttctgctagcttgctttgtcaaatattgttgggtatgtgtgccttcgtgaagttgctcaagatgataaccaaggtccctctagccttttcctggtgcctagatcaagctgttaaacagtaggatgctctgcagcagtactgagctttgtggctgtggtgaccgatcagggtatcacttaggcagcagctgtctatctggagaaataatttccaacaggtatgaaggtatgaatctgttagtctgtaccatcaccatttctgtctaggagaagggggcagccagcaagcactgtcaggcagagcctttcgttccacccttcctgcaaagtgtatttctagccctgtcatatgcccttggctttctttgttgtcaagtctctgggagattgagggtacatattatttccttctgctttgtgtgcccttgcactgggacttggggaggggagtaagaagtattgtgttaaaatgttaatccctttcattggttgcccagttgtgagtactagccctctcagactgttggcatttggtatgcagggattagcattttatgttctcaagtatgctggtgtgatgcttattgtctattatttggccaaattagtcactaaagtgcccttatagaagataactctgggagaggtatttatttctctgaaatttttattctcctttcccctttcctttcctttcctttttctttttctttttttctttcctttttctcccctcccccccctcccctctcctcttattggagacaaggtctccctctgtcacctacgctggagtgtagtggtacaatcatggctcactgcggcctcgatctcttgtgccgaagtgatcctcccaactcagttctctttagtagctggaactaccaccaccacagctggctatttttttttttttttttttgtagaggcagggttttgcaacattccccaggctggtcttgaactcctggactcaagcaatttacctatctcggcctcccaaagcactgggattccaggtgtgagccactatgcctggcctatttttaaatttttatttttttgagacttagggttctgttctgttgctcaggctggagtacagtggtacgatgagagctcattgcagctttgaactcctgggcttaagcaatcctctcacctcagccttctgagtagctggactacaggcacctgccaccatgttcggctaattaaaaaaataacaaactctgttcgtaaagatggggtcttgctgtgttgctcaggctgctcttgaactccttgcctcaagtgagcctcccacctggacctgccaaattgctgggattataagcatgagccactgcgcccagccttactcacctttttgtatgacactatcagtctttctaaagtgcaaagaaaaagggttctgttatcatctgatgtgaaaattcctttaaacattgactttttctggtgtgaggaatgaaagctgtggaatacgtgaagttttatgaaatagtgtttttttgtgtgtgtgtcaacaaaattaagagagtttgggttattgaagatacaagagtgtttttgaaggtatatataggaaaccaaatctcaaatgtggtctgtccttgtgattaaaattagagcaatagggaagccaggtgtgatggctcacacctgtaattccagcacttttgcaggctgtgacaggaggatcacttgagcccaggagttgagtccagcctgggtaacatagcaagacctcatctctacaaaacattgttaaaaattagctgggtgtagtggcacatgcctattgtcccagctatttggaaggctaaagtgggaggattgcttgagcctgggaggtcaaagctacagtgagccgtgattgtgccactgcactgcaacctgggcgacagagagatcctgcctcaaaaaaaaaaaaaaaagcaacagagaaagcttatgtttttagtgatgagaatgctatttgtgaggccatgatggaa

SEQ ID NO: 105828 - DNA, 1027 bp, Homo sapiens
ataacatatccttgtaccataaagaatgagcctgactgctttacaaaggatttctataaaaagtaatcttttatactaagagaaatgacacatctgttttaaacctgttacttttcttccccgggctttgctctttctgcaggtccgtttgacatggttcttgaaactcctggtagcagccatttactagtagcactctttatcttagacacagcacctaaagcaattgtaggtgttttaagaacagaaagcccatcttaagcagaccagtttgagggattggcagtgctgtcaagaaacaagggctttgtggcagtctctctaaaaactccctatgagtccatttcttgcaaacttctttagactctactgtatcttttcatcagaagctacctctttgatgtgggaagtgtcatgaatggactgactctctggaatttaaaaacaaagacaatatggcaaaaagaaaacctgacttttagtactgtatgtgttgctaattagctctgtattcttgggcagactactccatgtatcccagccatccatatgccctatttgtaaggatctaatgagatgatattgtgaagaatgcctttgtaaactgtaaattgctttgtgaataaagatactatctctgataaacagtaccagttctcagccaccaataacctgatactcccatactgtgtttggaagaaacacaaaacaatgaagagtaattgtgacttttcaatgtgagttgtattcacaaagctcatatactttttccctgccttttgatactgtttatcgctttctgtgttgtaatgggaagatcacacagcaatcattttctcagtacaaagtataactacaactgagcttgcattgaagatctttaacaaagatgcaaagctgctgtccagaaatgttttctttccattttctcttgtacctcccagtattttaagaatccttgaggctgggcaccataactcacgcctgtaatctcaacactttgggaagctgaggcaggaggatcact

SEQ ID NO: 105829 - DNA, 2486 bp, Homo sapiens
ttgggaggccgaggtgggcggattacctaaggttgggaattcgagaccagcctgaccaacgtggagaaaccccgtctctactaaaaatacaaaattagccaagcgtggtggcatatatctataatcccagctactcgggaggctgaggcaggagactcgcttgaacctgggaggcggaggttgcagtgagccgagatcacgccatagcactccagcctgggcaacaagagcgaaactctgtctcagggaaaaaaaaaaaaaaaaaaggagggggcgcttcatcttgactaacttcctgcattggtggagcttgatagagtggtccttcccagatccttccctgcatacagagcctgtctcttttctgattggtccctaaggccagattacctgtccctaatactgagcagaagctggtgaatgaaacaggagatccctcagtcaaaacaaaaggaaaaagaaaaatgaaacaggagatcccttctctacagcccagatgtaagtccagctgtgcccttcaccacctgggtgaccccacctctgtgaacataggtcctcatctgtaaagtgtagataatgttatttcatcggatcatttaggggattaaataagataatgtacttcgtggtttctggctcttagtaagtgcttaataaatgttagcgatttttattatcattgtccttagccttgagaacaagccagggaatagtgtctcagaccagatgctaagacctaggtagatgggcaattttccttggttttgacaagacaataattttatcctgtgtatttctcttgacttttttgatgtgaaaagcagagaggtaaagcattatttgacagatgtatggattcaagcaagaaactgaggtccaattgcaaagaaatggcttgtataactcagagccctgtctgaggaaacacagaggaccctagagggcggagaatgaacacagcgcaggggctagttccagagtcgcattctcggttagttcactttcaagtgtgggtgagggtcccttgtcagtaggcagagaatttttttcccctgcaccaacacatacctgctgcctagtgtttattaaacaaaactttattttaatgtgaaatagaattcatgacttgtccaaaatggagaggcaagggagctctttaacaggcttgttgagccccttttcccacctgttcctgtgccagactttcccaaaggcttacttgccaatggttgctcctcagatctcagggctagctcactctataggctccaagccagagtgataccgccgccgccgctgttgctcccaccagccaatcagtttcctgctgtaaggatgtaacttgctgtgaagctttcaccttcctcctttcttcctgtcttcaatgttgtatgtctttgtcctggtgcttttgccatacagccagtgtttcaaagaaaattttcaggcactaaagttatagcccttactacctttccaaggagatgtgagatagctgtggaaaagaagagggctcctctgcctctgtgcagaaggaacagtttacttcttgatagtgtgctagctcctgagctaggtgggggacttgctgggattcaagagagtgcattacctgacctctggacaagtagactgggcatagcctgcccaaggacagcaccctaacctgcaggaaccaaggccgaagactgatttcaccttctcgtactcccctttcctaagctaaagcttgctctgtaacactgccccaggtctgtggcttaaaacagccatttcctttcaccagtgaattaagctcactctttataaaatgtttcagcttggggattggaaaggctctctgtgcctttctgtctctgtctgtttctccaagggttgatgttgatggcttctgtctttgtctttacagggaactctaatgatccaggacaaagaagttaccctggagtatgtatcaagcctggatttttggtactgcaaacgagtaagtaccaagaatccctttctttagaagtaagtatctggaataacagctcctccatatctctaggaaggctgcctgctaacatgcattcccaaggacaaagctcttcttcctcaggtcacttcagttgaacaggaggaggtcaagacaaggtcattcataatttctccttcccagctgctacatgtggccatagagagttctggacctgcaattggagacactttcccaaggacatgtgccattatttctatcagttataaaaataacagttccttgacatataatatcttctcacctctcctgggggtggtcataaaggaattcttggttggaaaagtaggtttggagagactagttctttgggagtcgtacattttttggatattcttgggtttccaagggtatagaacttcagacaccatggcattttacctctattaaactccatattctcttagagtgggatatttaaaattttaggctatactctttttttttg

SEQ ID NO: 105830 - DNA, 1206 bp, Homo sapiens
accaccacacccagctaatttttgtatttttactagagacggggtttcaccatgttggccaggctggagcacagtggcacaatcttggctcactgcaagctccgcctctcgggttcattctcctgcctcagcctccctactaactgggactacaggtgcccgccaccacgcccagctaattttttgtatttttagtagagatggagtttcactgcattagccagggtggtctcgatctcctgacgttgtgatccacctgccttgacctcccagagtgctgggattataggcgtgagccaccgcacccagcccagcctttatcagttattatgagtgaatatcatgtgagagttacctctggtttgatcagtttcaggaaaatgccagtgaagggaaggcccctgcagaagacgtctttaagaagcccctgcctcctactgtgaagaaggaagagagtccccctccagtaagaccaacattgatcccctggacctagggctggggctggggatggttccgagtagaagaggaagcgcaaaggctgatgccttcctctggtgttggtcttttacctcactatgtctcccgaataaggattcccatttcttttgagtacaagcatgagataaagttttctgtctgctaatgggggtattactggagaaccagaggcagttatctggactctttctctctgccctgtgccattcttaccagacgagatgcctagccctttttatcatcttgttcttgtcagttctctaaatcaccaaggaaacccgttttctcagcctcaatctttcctgccttttggcatcacacaagaatctcttagatatggagtgcatgcgtggtcatttttttatagtttctgcctgttcagagtgaatgatgctaatattggtgcccattttttagatgccttcaagcagtagtctcaacctaatcaccagtgattctgattgaatgcaggtatataacaatagtgaccatgcattatttatttattttgagtgatcatagaccaatgattatgcatcattatttaacagttcttataaggtacccttttcctgctccgcattattaattcagctcattgtggcatctgtcttaaccatgctttgcctttaccttacatgtgagctggatctgtctacccaagtgcctattaatgcagttgcttttagtttacttcctaaatcc

SEQ ID NO: 105831 - DNA, 1113 bp, Homo sapiens
aatgaaagtcatcttttcttccctccatgagttacagtaatttggaggtatttatctcttcctctttgtaatttgtaaccttttactattttctatgtttattttcctttctcttccttctcctcacattctgttgctagagtcacttctaaaggaatctttcttgtttattcttaatgaacaaggagcaaagccaagctctggccatgttgctttcatctgggaaatgagcagcatggctagtgagtttattttgaacccaattcaatgaaatgagatgcccatatcagaatatcaaaaaaaatggaccccaaaatataggttgaatttggtattgatccctggccttctccttccagcctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaaggtattaggggaaggagctatgccctttcaaactgttgactcttggccgggctttgtggctcatgcctgtaatcctagcactttgggaggccgaggcgggtggattgcctgggctcagaagtacaagaccagtctgggcaacatggtgaaaccccctttgtactaaaatacaaaaaattagccaggtgtggtgttgtgtgcctgtagtcccagccactcgggaggctgaggcaggagaattgctagaacctgggaggcagaggttgcagtgagccgagatcgtgccactgcactccagcctgggtaacagagcaagactccatctcttaaaaaacaaaacaaaacaaaactgttgactcatattattgatggggattatggggaataaaaaagattatttaggccgggcctagtggtttacacctgtaatcccagcactttgggaggccaaggcacctaggtagatcacttgagatcaggagtttgagaccagc

SEQ ID NO: 105832 - DNA, 1645 bp, Homo sapiens
agaatcgcttgaacctgggaggcaaaggttgcagtgaaccgagatcacaccactgcactccagcctgggtgacagaccaagactctatctcaaaaaaaaaaaaaaaaaaaaaaaaaagccgcagcagcttatacaatccttcctcagtgtatatcagccccagttcctatcattaaaacagtccaattcaagaatgaattgctctggattaaggttatgcctaccctcaaagaacttccatgtataggccgaagccaagcattatgactgtggctagggtgccaaatatggaggatgggtaggaagagaaagggttgtggaataggacattacttgctgggtttctcatcttagctgtgtcattaacgttacagttggacctcagataagccccttttcttctttggtccttgtaacttcatctgattctatccagctctgacagtgtgcagttttcaccataggtgagtcaaattctgccatttcttcatgtagtgaatattgttatgagccacagcacaacatctatacttgggatgttaaaccgacatacattggtcttcccctgtagtattcccatttatatgaactgaccaaggatccaaattatggacaaataaagtccctaaatggactcacattctcagagcaatttgtttcacaccccttctctagtagatgttgcaagagcaggtgatggaactagattcagactttctctgaatacagagctcaaagttttatttagctaaaagctgagaagttctgcttttggtaataggtacactacttttcccagccatctctgtggaggctttgcaaagataggactctgaaaagctcctgataatccctggaacagactacctcccatgtcctttgacctgaagttgtgagttgtcagactgacacattgaaatttcacccatctgatgtaaatactaataaatggctaaagagataaaaagtaatcgtcaggaaagaggagccacaggtctggtgaattcacaaactgaactggtcataggacagtggaaagtagactgtagtacttttcctttccttaaggtcgtctgctacaaagaaccaccacttcatgtaagagctgctttggactccttaagtttcatacatatgtctgagggcttgtgtagtagagccatgcgtgaggaatttgcaactctcagagcagtctcttggaaccctggggctcctttccatgtttctctgggggctgaaagagtgactcatgtctgggaatggtatgtatggcagagtatgtgggcatttggttttcttcactggtgtgcccacatcctctgtcccatgattttcaacttagataaagagatagatatttgtttcccacatcttggagataagtaaaatgatattcctcttatgccataccacataactaatctgcatgacaagaccagttagggattgttggttgcaggatacagtgatcatttagtagatctgatcaatcaaaagagctacaatccaaaagcaactattgggaaaggcctagaagcatctctaggaccattgtttcttagacctatactcatagaattgcctctcttctcagcaaaacctggaaatccaccggaagataaaacagtctgagcaggagctagcc

SEQ ID NO: 105833 - DNA, 1188 bp, Homo sapiens
gagtgttctcttaaggggtgctagttttgggtaactatccagttgtatctgacagacaactaagttgcctgatggggaaaaaaaagactaacttagttcatccaggtttttggtccattttccagtaggcatgatacccttgagagtagatgagccagggatgtacttaatttcaccctttaaaattgggtgaaattcgagtaactgctttcttcctgtttttggtcactaagatctgaatcagggatgaagggataatatgtagactctaggcttgacaaaatgcaaaaataaacttggacaacatgactctttcttagaaatattcaacccaaatgtttatttcagatttagcatacattcctgagaattatcattacatttagggatgtaggtattttcccagtggttatcttagtaaactggaatttggtaatactttttaacactttaaactatttggattatcttataaactgatctgtgggccgtgtgtatttttaactatgtcttttaaaggtacaaaatgtgactgactttagaatgaaaattattttccctggcagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagaggtgagtgaccagcggctgtataaccccccaaaacactctgagccttatagtaatagaaataacagccaggcagccaggtccagtggccccttcccataatcctatcactttgggaggccaaggcggccagatcacttgaggtcaggagtttaagaccagtctggccaacatagtaaaacccgtctctactaaaaatacaaaaattagctgagtggggtggtgggcgcctgtaatcccagctacttgggagactgaggtaagagaatcacttgaaacctgggaggcggaggttgcagtgagctgagattgtatcagtgctctccagcatgggtgacaaagcaagactccatctcaaaaaaaaaaaaaaaagaaaagaaataatggccagggtttacatagggatcaccatgtacttttgagcacttgacttcatgaattcatttaggtctcagtaca

SEQ ID NO: 105834 - DNA, 1029 bp, Homo sapiens
tggctaacatggtgaaaccctgtctctactaaaaatacaaaaaattagctgggcgtggtggcaagtgcctatagtcccaactactcgggaggctgaaggaggagaattgcttgaacccaggaggcagaggttgcagtgagcagagatcatcgcaccactgcactccagtctgggcaataagagtgaaactgtctcaaaaaaaaaaaaaaagaaaacacagcaggctgggtgtgcctataatcccagcactttgggaggccatagcaggagggtcatttgaggccaggagttcagaccagcctgggtaacatagtgagacccctgtctcaaaaaaaaaaaattgcagtgaacattaccatggagtgcttgtgtaatctctgtacacttcctgctaaggataatttctaggagtggagggtctgtttcaaagagtacagggtgatgttaattgtgattttgtttattgtaactcagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatgtaaggggaaatgacagttataaccagcagtcagtaggcacaatgaactttgagcttctaccattattttctcatgctattgttttatcttaagccaatagaggttgagtatcccttatccaaaatgcttgggaccagaactgttttgatatttttttttaatatttgcatttacataagtttaaacatttgcatttacataagtctaaacatgaaattcatttgtattttgtatatgtcttatacatgccaaaggtaattttatacaacactttaaataattttttttttttttttttaagacagagtcttgctctgtcacccaggctggagtgcagtggtacaacctcggctcactgcaagctctgcctcccgggttcacgccattctcctgcctca

SEQ ID NO: 105835 - DNA, 1347 bp, Homo sapiens
ggcatggtgggtcatgcatgtaatgatatgggaggctggcatatcacttgaggccaggagttcgagactagcctgtccaacacagtgaaaccccgtctctactaaaaatacaaaaattagctggatgtggtggtggatgcctgtaatcccagctacctgggaggctgaggcagaagaatcgcttgaatccaggaggtggaggttgaagtgagccgagatcacgtcactgtactccagcctgggtgacagagcgagactccgtctcaaaaaaaaaaaaaaatcagtcacgcatggtggtgcacacctataatcccagctactcgggaggctgaggcaggagaattgcttgaacccaggaggtggtggttgcagtgagctgagatcatgccactgcactccagcctgggcaatcaagtgagtgagagacagagactcccatcttaaaaaaaaaaaaaacttggctaattaaacagttgatgtaattcctattccatggggaatagtgtgtggcaaaagctttaactgtaaataatgtaaaaccctgtgcagattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcatta

SEQ ID NO: 105836 - DNA, 1041 bp, Homo sapiens
gctggaggattggaatctgatgcatcatctgcatcaggtagtaaacttcatctcccttttaccttttgtttaagcacttacagttgaagaaatatgattaaatgtcctaactggaccaaaagctacaagtccatttctctgtaagattgtagggggcatggccgggcacggtggctcacgcctgtaatcccagcactttgggaggccaaggcaggtggatcacgaggtcaggagttcaagaccagcctggccaacatggtgaaaccccatctcagctaaaactacagaaattagccaggtgcggtggcaggcgcctgtaatcccagctactcaggaggctgaggcaggagaattgcttgaacccgagcggcagagattgcagtgagctgagattgcgccactgcactccagcctgggcgacagagtgagattctgtctcagaaagaaaaaaaaaagaatgtagggggcatattcagggctgtcatcatgtacccaaggttctggggaagaatacggttatttgtgtacaccaggagttaatacaaggtcttagagaccatgttgtgatgagtttaattcttggaattcaactctgtatttcccctctctgtgtttggagtcgtgagtgcccacgtaagttcaggtgagcagagaggatgtggccctggagactggtgctcagacatcaatcagaagagctactctaagaagccttggctttaatttttgtttcaggctttaaaaagccttgtgagttaaatctttctcaaccccagagcaaatatagatcctttcttctcttccttttctcttcttttttttttgagacggagtctcgctctgttgcccaggctggagtgcggtggcgttatctcggttcactgtgagctctgcctcccaggttcacgccattctcctgccttagcctcacaagtagctggaactacaggtgcctgccaccactcccggctaattttttgtatttttagtagagacggggtttcaccgtgttagccaggatggtctcaatctcctgacctc

SEQ ID NO: 105837 - DNA, 1033 bp, Homo sapiens
tgttttgctatacaagtattaccctttcctgttgtatgagccaggattgagtaatacacacttcaaccttatttctttctgttgttttaaaatattaattttatgatatatatgtgcatgtatattttaaatataaaatttcaactgtgtatttacactttatgcatgcttgacctttagaaagttgtcgccggggccgggtgtggtggctcgcgcctgtaatcccagcactttgggaggccgaggcgggtggatcacgaggttaggagatcaagaccatcctggctaacacggtgaaaccccgtctctactaaaaatacaaaaattagccgggcgtggtggcacatgcctgtaatcccagctactcgggaggctgaggcaggagaattgcttgaaccccggagacggaggttgcagtgagccaagattgcgccactgcagtccagtttgggcaacagagcaagactcctcttgaaaaagaaagcaaaaaagttgtcaacatgtgttttgctgagggattgccttagattattgctacagtgtgtctgtcaggggagcccttcctcctggatgattgcagtgatttagctctcttaaaaggctttacagttgaaattatattgaagctgctgttctttccagactgaggaagcacagcctagcactagcacaagtacacaggccccagccgcttcccctactggtgtagttcctggtaccaaatatggtaagccaaacctcatggggctgttgacagttggaaggtcttagttgttgtctttgtttaatgagagttcttctccctttgcgggtgtcagagggacacttggggatgtgagacagagaagaaacattaggcctgctgcatctcactggcttagaatttgaaataaagccaatttcttacctggaatgactgtatgctggattttgtttttgcagcagtacctgacacgtccacttaccagtatgatgaatcttcaggatattactatgatccgacaacagggctctattatgaccccaactcgca

SEQ ID NO: 105838 - DNA, 1050 bp, Homo sapiens
atcatttgaggtcaggagttcgagatcagcctgaccaatgtggtgaaaccccatctctactaaaaatgcaaaagattagccaggggtggtgacaagcgcctgtaatcccagctacttgggaggctgagacacttgaatcacttgaacctgggaggtggaggttgcagtgagctgagattacgccactgcactccagcctgggcaacagagcgagactccttctccaaagaaatagaaaaaggtagtcacccaggaatccatttcttaggctccaagaaggttggtaccaggaggctgtcaggcctagcactcaaggacctgactgctccacgcagttgacaaaatgtgattcattactaaagtgtgacatgcagtaatggggatttgttaacatttcggatgaggcattactttatccaggtacatagccaccgccatcttcctattgtacatttccagtgacctgtcctccttttgtctccagaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaaggtggccatgcttctgagctgatctgagggggcgaggggaggcagtgagacaatttgagtgccctaacagtcctgacggttccaaaaatacctgccatctaatgatggccttacagaaagctgttcccgatgacagtggacggagtctggcagctccacacacatcaaactatagtttttatgtgattgtgtattgtttgggctttggctcttaaagtacagtagatgttactaatgttaggacatttcaaattaagatggtctgagtccttactgtgtctttcaaatcttttgtgtagcaaaacatggacatctatcgacgatccaggctgagcgagcaggagctggaagccttggagctaagggagagagaggtgaatgggaaac

SEQ ID NO: 105839 - DNA, 1055 bp, Homo sapiens
tttattcctccagtccttatacttgctcctggtctcttctggagaaatccttgtcttcatatacagttttctctcttctgtctcctggtgggtggtcctgctgggtaaggagtgggcatggtgagaggtggagcagcccataccctacctcccagctgacagtctctgtgctttcccaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaatgggtgtcctgtgtctctttattcttgggtgggtaggtgggtcaagcatgtctgagccagtcaagcctggtgatgaaatcagtttatttcttgcccccatcaccacgttctgattgattgattgattgattttgaggcagggttggccaggcgtggtggctcacacctgtaatcccaacactttgggaggccgaggcaggtggattgcctgaggtcaggagtttgagaccagtctggccaacatgg

SEQ ID NO: 105840 - DNA, 1049 bp, Homo sapiens
caagatagggtgctcacagtcaagctggtggaaaaagcaatggatatccagttggtcagggccatctgggagcccagcacctgctgtgtaccaggccctgtgtatccccctacactgggtggtctcagcctggttatgcacacatgaagtggccctcagtgaggagcaggcgcccaccaagtgtgtgtggagtgagaatggagaccaacacttcaagaaactgggctcccaccatcttcctcccagagtacacgtgggtggcacagagaaggttactctcagaagcactgctggtcactgtggctccatgtcatagttttttcatctgtgccttggatggacacagcagttgacaccccaggcctcaggggctcaggctgggcactccctgccctgccctgccctgggtcctgctgtagtggggaggtgccggttcctgcctgggtagggctggaccctccaagctagaggtgctggcataaggggccacactgcccagggtagataaaggaacaaaggcaggaactgggccaggcttgggtttgctgcccgcccatccgcctgggcaccccagccaggtctagagccagaagggtgtgagggtcaagcagcccagggttccctcagattaggggggctcctatggcccagcttctgggcttcagcagcacagccaaaatcaggcagaagtgagggtcaaatggagatttccaggagcaggtgaggtgtttgttcattccttgctcttgagagagtggagcctgggctggaagcctggacagaccctccttccttcacccatccatgcctgggcctggagtcccctacactgcagaatcactgccaaatctcagagaaaaagctcttccttcccccaccttgagatgacccaggctctggggcaccacctccctccgtggcagcagcagggaggtgtgagggccctgccaggccctttgttcagcctggggagtgtttactttttcccaggaagctaccccacgacacactgctgctgcctgggctgggtttggccagggattggggcc

SEQ ID NO: 105841 - DNA, 1671 bp, Homo sapiens
ctaaagagggtctgcctaggtttcctgtgaggaaggaggcttacgggggctgagcggcttcccaggtcactcaggagcaggactgagatggagcctgcatccgcctgatgcctgaggctgtcccaggactgagagtggagggcagggatggtggtggtgctggaggcacagacccttcacatgagctaggaacaaggaagattccagcattctgcagtgctggtttaggcttcctagcctcgtttcccaaagaaagggctggggtcgcactgggcaggctccccatgccctctgtctgccgaagcaacggaattggggtttgcttatttccaggctataaatccggccctccatcactctggcccttccactgagcagggtccctaggaaggcctctcatgtcagagatgggaacatcagggcctaagagaggaaagggctcctgttccagagcagcctggagtttgagccctccaggccaatagcccagaacagtgccaccgctcacatcatttgcatgtggcatcagaggaccaaggttgccaggtttggagatgatgaggttagaggttaggaagggtcacagcccgttgacttcccctcaggagttgatgtgagttgaggtgcctctagcaagccttgatggggccttagccctcaggcctggtgcaggagtaggggtggggctggagagctagaggacatgctcttgccccccaggggctccttggccagccagagcaaggcatggggctttggtgggggaggagggggaggaggcccaggagctttgaggccagtgtggcaccagggagctgggcaagggtcaggtggctctggcagctacagtgggggttggagctcacaagccagggagggtaggtgttccaggatacgccaggatgagggaggaaggaagacccaaagcatgaacttgagcccagatcccttgaggccagatctggagtttcagttttctggaaatgggagctgccttactcctgagagacttggaagtggccgctttggagttgggaggtcctggaagctgcacatcccccaactggctaggaattggtctttggagagaatggagacagggtccttgtgcttgctggagaacctgcctgacgcccagcctgggtcagccaggccaggggctggggctttcagctgtggccttccaggtcaagtggagcttcagatgggacctccactgtctgggcctccgcagcacaggccttgtctctggttccctggcatgatgcccgcccctccttccctggctccagcttcccttggcactaagtgaggagctggtgcatgctcaaggagtaaatcatgttccttggcagcccccactgcttcgtaatcgtaaagaatttaaagagaaaccgccaagataaaaatctcaccagcccataaaggcatctttcaccctgcagcttgggagacagtgagcctcagagtgggctcttggctgtctgcacctgtgtgtatgcacctccggccccttgactcctccagaggtggtaatagctcagaaggtggctttagggccatgggtacctggtccttgactcctgggagacctccatctcctcactcaggagagtggggtgcttaaatttggtgtaatgcagaagtggtgatggtggtggctgagctagc

SEQ ID NO: 105842 - DNA, 1030 bp, Homo sapiens
cccacctgggcctcccaaagtgctgggattataggcatgagccactgcagctggtctattagctatgctcttgaggtgatttacatttgttgtgtctgtggggtagaaatactgtacagtggtgttggcagctcttcctgattttgctttcagtgacctcaggttggtagcttgaaattagttgtggcaggagtattcacaccacagaaatgggctattgctactaatcagagctgatagttactaatcccaaccctcccagagccagtggtgaaacactgaccagcactccactggagataggatcatgccccagggagcctgagcggggagataaggccctgccctggaagtcatctgagctgtgccctggccctagcaaacagcagccccccaactgacccactggcctacccacagatgaggagctctatgctggtgtgtacatcgattttatgggcactgatgcagccatcttccgcacacttggaaagcagacagccatgcgcacggatcagtacaactcccggtggctgaacggtaagcgcagccccaggagcccttccgtggccatgtgtctgggatgcggcaaggaggtcgtaaagaagcacatgtgggggaagtggggacatgtttagcctatgactacctggggcaggggtagtttcttatctggagaggagttgggggtgttcttgcacctggctggggattctgttggagaacatcaggggcaccatcagagtaggggctcacccagctgacccctgccacctgcagacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctggtatgcattggcagagccaccaggctgccccttccaccagttctggcttcatcagccctgctccagccagggcttggggtcaagagctgatctgacccggcctcttgccc

SEQ ID NO: 105843 - DNA, 1084 bp, Homo sapiens
gagagcagcggatctggtccaatgcagttctgactccatgtagtcaggactgggctggagaagctggtctcagtgggggacaggggaagcttccctccagaggtaacctggagtcagaaggatgggccagaggtaagctggccatgacggggggcaggctgagcccaggttcaggggacagcttcaggaaggaggagagtgagcctggtgtgtgacaaggacgtcggggcctgcagtccagctgtgcaggagggagacgggtgagaccctaggaacaaccagagaggaaggagatgacaggggtggggagggggacatggaagggagtggtccgcttggccaaatgctgccacgaggtcatggcacctgaggccagggaggtggctgtggcatttggccacctgggaccttggccagagcaggacctgtagaggtcaggtgcagggcagaaacttggagagcgggtttggggagaggagcaggttgaggtagtggggacagacagtgcagcggcctcttctgaagctaatggctccagcctgccctgcccaggcagcctgggactgacactcgccacctgtccacagtgccctggtggaaccttcacgccatctatgaagtccaccaaggattatcctgatgaggtgatcaacttcatgcgcagccacccactcatgtaccaggccgtgtaccctctgcagcggcggcccctggtagtccgcacaggtgctccctaccgccttaccactattgccgtggaccaggtggatgcagccgacgggcgctatgaggtgcttttcctgggcacaggtacccactgctgctcccggcctctcccacgctgggcccaccgggtgcggggtgcagatccttggggctggggcttgccctgctagggcttgctgcaagctcatcagagtcacttcttcatcctcatcctttggtgccttctccctattgatgggataacagaggctaggggtgagaaaaccccattcccacttccatccccaggggcccaggagaacagggacactgggcatctggggacttatgtatgtatggcaggaaaggggtggagaca

SEQ ID NO: 105844 - DNA, 1139 bp, Homo sapiens
gctgtccagcaacagagctcccggcgctccgcacccaatcacagcccggtcccgcctgcagcccgcccagtgccgggtcccggggtttggaaccacccctattgccttttctccgcgtggccccgcctgcagcccaggcccgagcctgggctgcgcctaacttcccccttcgctccgccctcgagccaatcaacagcctctaatctcctctggccccgcctgcaagcccgccccggcccagtcacaggcttggttcgcccaggccccacccccggcccgccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgaggccgcgtcccgcactgggatccttgattcccagctcgaatccccagacaaggactttgacctcccagactagggcttcaaactcccagacccgggctgtctgggaccccacacctgggccaggaccagggttgaaaactctagattggactagacctttgatcctgcccagactctagaccagacccctgtctcatcccagaccccagacctccaaatccagtcaacagtgccccaacacccgcggtccagtgccctgcttggccatccccccttgctaactagcttcacagaacttcagagccccgccatccttccctacactttgcccaaacccccaggatgcccgccacttgttccccaaccctcaggctccgcttgttttcctcacctgcgccttttattcctattgggcatgagcatcccgcggggcccctgccaggccccccacccactccctccttctccttctgtgccccatccctagtctggaatctgtatcctccacctgtgcactctgacccaaggaacctctcgagtgggaaactgctcttgagccccatct

SEQ ID NO: 105845 - DNA, 1050 bp, Homo sapiens
ccaggggtgcagggtctggcttagcactttctagcctgggaagttcaccctggggtcctggccttctggcctttgcttactctgtgaaatgggcttcctgggttttggccaaaggagtgccccaggtcaggatggggagggagaacaagagcctcctggtggttcttgttggggatgtaggttgggagtaaagaccctgcagtgtgctgcaaagggctctgaccaagctctgcttgatattgatgacccagtctgccatggctgcctggggagggatcctggcttgagccatgcctttcccatccaggtgcaaggtggtgatgggagcccagctgtggtaagttcagagttctgggcgcctgtcccatgtagcgggagactttgtccaggcaacgggactcaggttgggcaactgccagccttccctcccagccagaaccacgcctgctgccccgcccgcacaccgcctccctcccatcttgggtagccctgccagcaggcaggcacagtccttgtcaccagggcagaggctgatgtggtacacacaggcaagagagtatttcctggcaactttgtagggggagcagataccagtcctattctagggatgctccccactcctacccagctcaacgtgactgatcagctaggcccaggtggaatctgggaccctggtctgggctcttaagggaaaggaagccagagtgtatgtgaggggggagagtctctgatttgggatgggcctgtgtggacagcttcacaaaaaaaggagacagtgtccaccattggctccataaaggcttcagaatgtaaacagagcagttctctcttgcccctggaactttgtgtgtgttgttccctacttgattgttctttaaaactttactctgggatcacctcccaggatccttcctggacatcctccctcgaccaaggctggtgaaacatctggctcccagcgctgttgcttcccccctcagatgcctggagactgcagggcagggctaagtcctcttcatttctgtgcccagcatggagcctggcatctac

SEQ ID NO: 105846 - DNA, 1039 bp, Homo sapiens
ctgggttcaagcgattctcctgcctcagcctcctgagtagctgtgactacaggtacgtgccaccacgcccaactaatttttgtatttttaatagagacggggtttcaccatgttggtcaggctggtctcgaactcctgacctcaagtgattcgcctgcctcggcctcccagagtgctgggattacaggtgtgagccactgcgcccggctgcagctgcaccttttgacttcccactttttctcctagtccgtatcctctcacagtgatgctcaagttatagctggcaatttaggacttcattctttccctaatattatgcttgttctcccataagccccagtcttagactgagaccaagcctggggaaggctcagaagctattgaagtccatggtgagggcctctgagactgggaattgtccagaggagtgaaatgaaagcatgttccttagggctgcactgtgagcacaggctcagtgctgggtgcacgtacggtactgtgtggtggtagaatgtggccatggtgttggctgatgactgcatgatagttgttgaggctggttcctcttgctccttggcctccgaatctcagtgctgtggcctagtggggccttgccctctcttgtaggggttcctaggggttctgctgtgttgccaggccaggccgtaagggactgagggggctgaggaaggcttaggagagccagagcagaagcgtccaagcctctctgggccatgaagccatgcacagagcagagacccgtgcatcctcatggccacccaagactgtgggtcccagagggtccagttcctcaccatgagacctcagactgtcctcttccctctctgtatccagcactagaatctgtgatgctgtgattttttttttttttttctgagactgagtttcgctcttgttgcccaggctagagtgcagtgatgcaatctcggctcaccacaacctccgcctcccaggtttaagtgattctcctgcctcagcctccagagtagctgggattacaggcatgtgccaccatgcc

SEQ ID NO: 105847 - DNA, 1041 bp, Homo sapiens
gatgcaaagcaagtttgcaccctcgtccctgggcagggtcacgaagcggcccacatcacctactaagagtgggcaaaaggccagaccccctcttcactctcagtggccagatagggaaactgatgcctcaagtgggcaggagtcccgaagtcacacaagatggggaagctttcaccctagacctcaggtcccccatgccctgggtagcttccctgctgagtctgagctcgcctggctcgggactgcatggggacccatgacttcgcatccttggcctctgctcctgcagttccccccatcctggctgtgactggctcctggttcttcctcctgctctggaggagccagtggggaagacagtcaggtagccactgctgccctccctgccccagtgggtgctttgagccccagggggatgggccttaagtgttcaggcatcgctgtgaggctttcctgggacctttccccatgtcctcattggcaggtggaggagtgttggtatgcagatcctggctgcccctttgccatgcacagcccaatggggagggagtggtgctggtatatatcccggtacacaccccagtgaagatactgggcccggcccctgtagtgcccaggggctaaagcaatagaggggattgctgccccagccacagcgccccagccttcccagggcctgcacatttgtatgtccacaagattgtgcaaccatcactgctatctaattccagaacataatcaccaccctcaaaaataaacttcatacccaactagctgtcactccccatctccccagatcccctcccctcatcctggaaagcaggcctgggacagtcagaagctcagtgattgcaggcgcctgatggcatttgtgaggagggctcaggcctttcccctcagggtggtctctggcgtagggggctgaaggtgggcaggggccttggcaaggcctgccaccatgtcccaatgcctgctgccgcttgttgagcactgcagacatggcccagagtctgcctggggagctagggagtgaacccagtg

SEQ ID NO: 105848 - DNA, 1070 bp, Homo sapiens
tcatgcctataaatcccagcactttgggacgccgaggcgggtggatcacctgaggtcaggaccagcctggccaacttggtgaaaccgcgtctctactaaaaatacaaaaattagccgagcatggtggcacgtgcctgtaatcccagctacttgggaggctgaagcaggagaattgcttgaacccgggaggcagaggatgcagtgagccaagatcgccccattgcactctagccttggtgacagagctagactccgtcacagaaaaaagtaaacaacaacaacaaaaaggttttagggcaagtctcatcctagggaatccaagaataccctagcctgggccccattccagaggtctccctgcctctggcagagtgggggtacattccttcaactgcctgaccacccgccactgtgcccaggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctagtgagtgctctgaggggctgggcagggcagggcaggggctgggggaggactaaaggctggaccggagggcctgagaacccccagaaggacactgctggtctttgcttatgaaaccgatgactgttaaccaaggccttcctgttttttggtttggggggtgggtgggtgtcacgttactgaaaggccaggaggaatgacaggcaggtggcttatacagtacatctcttccaggccagttgagtctgatctgtcttgacagtcttctaaagaacatttgcggccgggcgtggtggctcacgcctgtaatcccagcactttgggaggctgagacaggcgggtcgtgagatcaggagatcgagaccatcctggctaacacggtgaaaccccgtctctactaaaaatacaaaaaattagccgggcgtggtggagggcgcctgtagtcccagctactcaggaggctgaggcaggagaatggcgtgaacctgggagg

SEQ ID NO: 105849 - DNA, 1051 bp, Homo sapiens
gtggccctcaggcgccccccactggacagaagtgtaaccttggaacactggcaggggctggtgcctcacttaggcttgtatagttgtgtgtgcacacatgaagcccttaacacactcaagcatgtacccctgaacatgtgtacatgggcatcctccttcacacagtggggtacccctttgcacatctggcatgtatgggcagccacaaacattgtcatattatgcacatgcatgcacaggttgtatgcctggccgtccacacgcacagacccttgctgcacacgtaggatgcggcctgcctgccacacatgcagcacaagtcttcattttctctcccccaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatggtgagccagaggggctgtggcagggtgctggggaagaactaagcgggcctggagccccagcagggggttctgggggtgggtaggggggtgaacctggagggggaggggcaataggtgaccaggggacaagggaggagaaggcccagggtgtgaatcaggaggtcaagtgagtgaggtgcagggcatggaggaggtcatacaagcaggcctggcccagtggtccagacagaagggcctggccttgccctgggacagaaccagaggccatcctgatgttccctggagaaatctcacctcctcacccaccaggccattggcccagcctgccggaagctgcatgccagcggagcccagccctgctgcccactaccaccagctccatgtgcacctccagctcttgccctctgacttgtctgagcgtcccgggcttaggctggccccactggccctggtggaggtggggatgactctcccagtgccacagactcccctccc

SEQ ID NO: 105850 - DNA, 1224 bp, Homo sapiens
gagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaataccgagaactgatgggtattctctcccaggggcagaggcctgggctaaggtgtgccaaggtgatggtggtcctaacctcagtcctcaacctgagtcagggccctgactcagctttccgggccgtcctggagccccacgctctgagcttcatttctcccacctggactaggcagcatacatgtggggcccgtgtgtccccgcccttccagtactctgcagccttgggtctcgggcagctgggcaggcttctaagggagctgttgtaaggtgctcttccacacctggagcaggaggggtggccggcctctctagcgcggaaggagaaagtgacttccgacttaggtaccaaggcctgagagtgtccgttgccaaggccacacagccaggtgggccgcatgcagtcctggcttgactaaaaaggccagtaggggccttaagacatattcagaaagttccctgccccagagggccgccgccaaacctgaagggtagtgacaggtggccatactaccatgtgatgg

SEQ ID NO: 105851 - DNA, 2901 bp, Homo sapiens
cagccttggtgagagcgggtggaagtttgacaggggcttggtgagggctccatgggctgaggacaagaagcggtgctgaccaggtggccttgcagggggggatgtcgtggatgagcagggccagcaggaagaccttgaggaaaagctgaaggagtatgtggactgtctcacagacaagaggtacccctggctgccagccaactcctacacccagctccaagtgtgatcaagggagggctggcccatatgaccccccttctcgacctcccccagtgccaagacccggcagggtgctcttgagagcctgcgcctggccctagcgtcccgcctactccccgacttcttgctggagcgccgcctcacgctagccgatgccctggaaaagtgcctcaagaaaggttggacctgggggtgtgtgggagacttaaactgggcagacactggcccttgctgcatgggctgactggaaagcatcccacagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccacgtgagtgtgcctgtgccccatgaaacccttcctgcaccttatccctcagcagagtggtgggttccccctatcttcagcctcctttactctgaggggagtgagctccagggctgggaacccaggttcacccgctgaccgtggcattgcattgcccttctcccaacagtgtgcttctgcccttggcctgggctgctacgtggctgccgctgacatccaggtgaggggtctttgggcacaggtggtagagcatctagggctgtaactctgcctctgagctcccctgcctctctgtgctcctaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggtaggggtggctgtccactgggagggggaggggatctcaaagaggcccccaagccacacatatagctcagcctgccccttccctaggcagctgccccggctgccccagctcttgtccagtgaaagtgtgaacctgcggatcgctgccggtgaaaccattgcactgctctttgagcttgcccgggaccttgaggtgcgagggacaaggatggggggtgcttggtgacaccacctgcccatcacaggctggatgcagggggtgccacacaaaacagaacagctttaggtcattatgcagaggaggtggccccaaaacagatttatctcctagatgtcatgatgggtgccctcagcagtggtgtcctggcctgacagaggccaaggaggggtcaaaggggccaggcagagaagagagggtctctcagtgaaaggaggggtttgggcagtgccctgttcagagccagcagagctcaagcatctaccacacaccctccaatgctcccattgcaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggaggtgtgtgtgagaacatatgtgtcctagcaagggtgcacccccaggcatagcagccaagcccagttgtgttggcacctctaccctgcagggcggtgaatgcgaagaagagatagtgcgcttcggctttgaggtgctctacatggacagctgggctcggcaccggatctacgctgccttcaaggaagtgctgggttcgggcatgcaccaccacctccaggtgcggggacggacagggaggggacatctggtgtggttgcttcagtctggcctgagctcactgccctctgccccccagaacaatgagctactccgtgacatctttggcctgggccctgtgctgttgctggatgccactgccctgaaggcctgcaaggttccacgctttgagaaggtttgcacccttgggcacctttctcttccccctattcccatttcctggaggcctggaattctgtagaggccggaagaggacccccagccctttcccttcccagctccccagggtgtcactctctgtccccactctagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtcttaacccctgggtatttttctgttctccctccccatctactatcccaggcttgggcccaactggtcttc

SEQ ID NO: 105852 - DNA, 1164 bp, Homo sapiens
tgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgtggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgagtggggtggggggcgcgggacagctgtatgagcggcgggcgggggtcctgctggatccccttggttgttctcgagggccctgggtggggaaccccctcggccagccccacgcagcttcccataactctaccgaggctggcacgtgccccagcagtcattggccacgtgcgtgcccaacttgagctcgctgcccactgcctgttgggagtccgcgctcccagcggtgacccggccagcccctccgggcctcagttgcctgctgggtggacaaactcaccggacagggcaggaagccagtcctcttgccaaaccctgatcctttcctggactggtcaaggaagttggcgggagtcctggcctgctccggtgaagagagggagggggctctgttgggaagctacctggttagggccttggcagcttggcaggcctgactccacaaggtagctgagtatcctggagcctgaggcagtcttgggactcgcttatcagcttagaccaggagcctatcttaatgcgttaaacacatatgtttactctgctgggatggggtgcctaccacgcacaaatttatttatttttattcttgagggggaagggaggagggccgggcacaggaaggaggaaaatacctaggcacaa

SEQ ID NO: 105853 - DNA, 1032 bp, Homo sapiens
cctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttgggtatggctgtgacagtttatttgttgatccccctaccctcacctctcacctcttctgcaggtcccttatccctgcagaagtctccagatccaccttgg

SEQ ID NO: 105854 - DNA, 1155 bp, Homo sapiens
ccatcaacatgtctggctaatttttgtatttttagtagaaatggggtttcaccatgttggccaggctggtctcgaactcctgacttcaggtgatcctcccacctcagcctcccaaagtgctgggattacaggtatgagccaccgcgcctggcgcatgggcacatccattgagtgtgcacttggtgccaagttctgtgccaggcacaggcaattcaacatttattggaatgatgtagtccctgtctgcatggaattcataggctagaggaggaagcagtttgcctctggtcccatggccagagcagccccaggtgaaggttatgaattatttgtcccatctaatggtgttccagcagtctgccacatggtgggaaggaggccccacagagctgtgctgtctccttcccaggatgagctggagcacagcctgggggagagtgcggcccagggggcagctggagtggtgctctgggtgagctgggaaaatacaagaaccaaggtgagcttaggcctggcatgagggtgggggtgggggaggggtggggccattaagctgacggggtagaccctgacttaccctttctacctgcaaagtcctggctgaccagcaggtgagtgcctcagtgccctgggtgggtccatacatggccatggtgtccctgacgctatcctcccttcccacctaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatg

SEQ ID NO: 105855 - DNA, 1118 bp, Homo sapiens
ttgaggtgggcacttccagtattccctagactgacttgttctccccaacccttcttccagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgaggtatgtgtctccagggccctgccttttttctccttccttgaggatccactgcacatttgggttatcaggggccactataggactatacctg

SEQ ID NO: 105856 - DNA, 1054 bp, Homo sapiens
ctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgcacatgagagtggcatcctgtgggggctctgacacccagtgtctagactaccacctgggttcaataggtaggcctggcacaggactctggcaggccccctatgaccagcaaagcccaagagtaagtctgagcccagcctgtggccatcccaactgtggccagcaggtggctgtgtgttcac

SEQ ID NO: 105857 - DNA, 1028 bp, Homo sapiens
tccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcctgctgttggaatcttttatacatataaagtttttgtagagacatgagtctctctgtgttgcccaggatcctcccaacttggcctcccaaagtgttgggattacaggtgtgagccaccctgcccagcctggactctttattattataggcgcagagctgcagttgcccctcatggtgccagaagttgccaagggtgatggacaggctcccaggtgtcttgcaaagtcaccatggaccaatttgtgaagatgtagtatgcatacatacttggtcatcactcagctccctggggctcaggttgtggtggagacaaaaatggactgcagttagaacttagggaaactggctgggcatagtggctcacacctgtaatcccaacactttggttgggctaggtgggcagatcacttgaggccaggagttcgaggccagcctggccagcatggcgaaaccccatctctaccaaaaatacaaaaaaaatt

SEQ ID NO: 105858 - DNA, 1027 bp, Homo sapiens
cagcaacctcttcatgagcttggtgagttgactgctcaggaagggggcgtggggaggagcaggtacccagctatgtgcctgatactcagagggtcacaactgaggttatcttgggtgggcgcaagcagtaatttgtgcatacccagcctagccccaagtagactgacatctcacctggaacctattatcaaggtttggtttctctatttctttagaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaaggtgggcttcccaccccaccctgccctatgtgagggtatatacgcatgcacctgagcatgcaggggctgagcagctggccctgtctctgatcattacttccccttcacagtgtacttgcggaagctgttggatgatgagcagcccctgcggctgcggctcctggcagggcccagtgacaaggccctgagctttgtcctgaaggaaaatgactctggggaggtgaacgtgagtacatagttcttagtttcttggttgtcactagacaggactgatgggctgtagctacagtaaggcttggaggaggaattgtgctggaagacaagccctgcaaaacagttccaggagtgtataggcattgtaactaaagcaaaggcttccagaccactcatgccaaagcctagggttgtcccaagaagccaggaagaattgccttggtgctttgatctttcctggtgtggaaaatcttctggagatgcaggagtccatctaatgacatgaggaggcccccttcaga

SEQ ID NO: 105859 - DNA, 1038 bp, Homo sapiens
tcgagttaaaaatctctgggtcgggtacgatggttcacgcctgtaatcccagcactttgggaggtgaaggcaggcggatcacttgaggtcaggagttcaagaccaacctggccaatgtggtgaaatcccatctctactaaaaatacaaaaattagccgggtgttgttgtggcacgcgcctgtagtcccagctactcgggagtctgaggcaggagaatcgcttgaacccaggaggcagaacttgcagtgagccaagatccagccactgcactacagcctgggcgacagagtgaggcttcgtctcaaaaaaaaaaaaaatctttgggccaaatctccagacagcacaggcaggtgcagaaacccaccaggaagctgcctgtgtacctctggcagattggagcctggcctaaagctgccttttatgcagcttgggtcaaggttaaacatcatgtcacagtgatttttctcactatgtgtgagacatggagaactggctccaagtactactctgtccactggtggctggactactgatgtgcaccactctccactcctctcaccctgcagtgggtcatggccccgtgccggggcagaggagaaaaatgggctgccttctccaggacaaaccctcactccaactcaactagggtgctgtgatcagaatgtgcaattgaggtgtgattttactgattttttttttttttgagaccgagtttcgctcttgttgcccaggctggagtgcgatggcacgatctcagttcactgcaacctccacctcccgagtttgagcaattctcctgcctcagcctcctaagtagctgggattacaggcatgtgccaccacgcctggctaattttgtatttttagtagagacggggtttctccatgttggtcaggctggtctcaaactcctgacctcaggtgatccacccgcctcggcctcccaaagtgctagaattacaggcgtgagccaacgtgcccagcctgtttttgttttttgtgttttgaagcagggtctcactcagttccccaggctgg

SEQ ID NO: 105860 - DNA, 1033 bp, Homo sapiens
cagagtgacctttcctctctcctctggccccaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctgccccagaatccagtctaatcaccttcgaggcagctcccccgacgctgtaactccagaccaccttgagtgtggcacctcccctcccaagccccccttgacatcctctcagctactccagggcacctgactgctctgaggagagggaagaaggcctgctggggctttccatggccttctgctgtttctcgccaacactacccaggactcttgctacctggttccaactccagacaaccactatgccaggcccggagcctctgaggcatcggccagtccaggccctcatctgaggtaagaatgtacatcagctggcagccccaagcaagtggctgcagggacactgatgccacagctcctgggccggccctcacatctgaaactggttgccgagagccctgagccaaggcaaggatttgccaaaaatgttctgggggcccagcaaatgcaggagccgacctggggctgcacatccctgcccatccccagaaagactgttcctgtcaggatttgtttccctctgctgtggcggtgactgcttctggaccagaacagctccagctcccaggtattttctacaggaccacttgagtgggcagccaagcccaggctcgcagtatcaataaagcagttctctgaggaatgactcctgggctcttgtcaggccaccttgtgcagccccctcatcacgttcaactgcaatgttagacagggacttgattgtctccatggtaactccagctggataagaagcccattgccccagctccccaccaccgccaccaccaccaccacatgcgcactgccaagcagccttccaagagctattgcctcagactcttactcct

SEQ ID NO: 105861 - DNA, 1704 bp, Homo sapiens
ctcacacagtgacacctacccacacgccagccaacaaggacacactcgctcagaggtacacgcacaaatagagctactcttcctagggaattcagcaagtgtgggggctagagctgtgttgcttcccgaaccctcaccgccgctttcaggggttagagatgctaattcatcccttcccacctcctgagaaccgacggaaacggtccctgagaactacaactcccagcacaccccgcgctcaccacaacgggaccggtccgtgctcatggcctcctgggacttgtagttctagccagaaccctgttcaactcttccccggctgcaaccaaggactccgtatcccagcatgcagaggagccggaagacaggcgcttagaggacagcccgctgccgccggggacgcgcaggcgcagcacccctgtttgtcggccccccgagagaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagccgtccagggccttccctcaggtcccgggcgaggggcctacgctgcggcccggcaacaaggcccgactcggcccctcgggaccagagccccacccgatcggaagcggatcctttaccagggccataggccagtgactaggccgggcctgggcctcccatcggggccggactaggacgaggccccggggaggcccctggcctaccagacccttttctcaggccgacagccgccaggaagatgcaacgtgccctgccaggcgcccgccagcacttgggggccattctggccagcgccagcgtggtggtgaaggctctgtgtgcggcggtactattcctctacctgctctccttcgccgtggacacaggctgcctggcggtcaccccgggctacctctttcctcccaacttctggatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctacctgttcactgtccgtatccacggcgccttgggcttcctaggtggcgtcctggtggcactcaagcaaaccatgggggactgtgtggtcctgcgagtgccccaggtgcgcgtcagtgtgatgcccatgctgctgctggcgctgctgctcctgctgcggctcgccacgctgctccagagcccggcgctggcttcctatggcttcgggctgctctccagttgggtatatcttcgcttctaccagcgccatagccggggccgaggggacatggctgaccactttgctttcgccactttcttccctgagatcctgcagcctgtggtgggtttgctggcgaacttggtgcacagcctcctggtgaaggtaaagatatgccagaagacggtgaagcgctacgatgtgggtgccccatcctccatcaccatcagcctgccaggcacagaccctc

SEQ ID NO: 105862 - DNA, 1035 bp, Homo sapiens
cgcagagactgaccaacaccaatcttctctttgtggtggccgagaagccgctgtgcagccagtgcgaggctggccggctgctgcagaaggagacgcactgtatcctgcccccgccctccccgccgcccgctccccctctgccccgcgcgccccctccgtgccgccgccgccgtccgcctccttgactccccacccatgcccagcggacggcccggagcagtgtgagctagtgcagagaccgcgataccggagaggcccgcacatctgcttcgactacaacgcgacagtgaggagagggggcggtggacccgaaatcccgcggccttgcgcccgcccaggccgaccagctccttgtctctccccgcaggaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacag

SEQ ID NO: 105863 - DNA, 1040 bp, Homo sapiens
ggcatcctcgtcagcacagctgtggagctcagcctaggcaggcgcacactgaggccagcaggtgaatgtttgggacagaggtggggaaacaggcaatggacagggtactgcctgggcaggtagcactgatggtcccttgctctcccccaaagtggtgggcgtcaagctggacctagaggcttgggctgagaagttcaaggtgctagccagcaaccgtacccaccaagaccagcctcagaaggtatttgggcaggggcgggggcagtaacccagcagtgcccttcctggagtcccctggaacccccaccaaccctccactcagtggctccaacacctacatggaggcagggccagctgcagatggcctggggaaccggatgtatgaaaggtgatgggagggaggaaaactggtgggtggcttacggtcctcactctctgcccagcagtgcggccccaacagccactgtgagatggactgcgaggttaacaatgaggtgtgtgtgccctgaacctaccctggaccctagcttaccccacttccagacttcctagtcccagccgcgactcccagcacatcccttggcctgtgggtctcaacatccccaccctgacttcacagccttcccaggactgggggagtgatgccccccaactctgaaccactggactgcctgcggtggaaggtccggggcccagcccctctccattttcctccccattcccttcctcctaggacttactctgtgtcctcattgatgatggaggattcctggtgctgtcaaaccagaaccatcagtgggaccaggtgaggatcaggaagagagtgaaagaagagagtagggatttgagccttctaggggtgtagcactgccagccctgtgaccatggctttctcctgacatcctcaggtgggcaggttcttcagtgaggtggatgccaacctgatgctggcactctacaataactccttctacacccgcaaggagtcctatgactatcaggcagcctgtgcccctcagccccctggcaacctgggtgct

SEQ ID NO: 105864 - DNA, 1052 bp, Homo sapiens
cgatgctgtagtctccacaggccctccaccctccctgcccgtcccttctctctggctcctggacgtggaaatggcgggtttcctctttgctggtgtctccccctccctccagcccccctctcccctgtccttccagccccgtcagctctgagccccccggcctccagcctccccagcccccgccggataaccccccgtttctgttgcagattttgagttcctgctccccagcagctttgagtctgaaggacacgttttcattgctcccaggtagcttgcgtgtggccttgctgaggtgtcctcccctaccctgaccgccccggccccacctcctgcactgctgcctggagctctgtgtgtctgtgtcctgtgcagtgtcatcccccggcccccatacatcgcccggtatgcgcggctgtgtgcatacccaggccatgtaccgcaccaggcagcagtggccagctgcctcacggccctagctcccaccaggccggggcaggagggctccagactcatctgctgactttccctgccctcccaggcaaccaggcaggagccctttccgccctggggtggctgtctgtggcatgcccacccctcgccaggcagctgctgctctggtttgtggtgtcctgcccatccccccaaccccgcaccccatcgttgtcctgtgtcagtcggtgttcgtgtgggtctgggggccgagccagccagagcccctgtcggcagtgccgggtctaggcgtggtacttcacttggggggttgggggaggagagtgggggctttgaggagctgctccatcagatgaggagacggggccccgagcaagcccaggcctggaccatcccggagtgcacgctcagtgtgcacacacacgttctcatgtacacaccgtctgcctttggcccatgtctggggaggccgggtcccctgggtgctgaagcccttccatgacccaggcttgggatgagggcaggtgggtggatgcagctgacaagagacccaggggcactggaaggcagcacacgggggctctggacatgcctcacct

SEQ ID NO: 105865 - DNA, 1103 bp, Homo sapiens
gcccggtggcccccaggagagtttgagaagtggagagcctccagggtgccggcccctagaccatgaacctcctgcagctaagcggggagaggggtccctggtggtgggaggaggggatgctgcagctggggcctctgcccagctccaaggccatggggagggggtgccagtgtggcccgcctccccccagccgtgacccgagcttctcccccctcagcctggggctggtgctcccaccctacagcaccttctacctccaagccaatctcagtgaccagatcctgcaggtcaagtgtaagtggcccggcccctgcctgcgccctgcaccctgcctctgccccgcaccctggccggccccaggcagcatagccagcgccgcttgccggcgaggcagtccctcctgcccagtctgcccaccctcaggtgcccgcaggctggggcacctcgaaagtctgtggaaatctgcatgcttgccttttctcagattcggttccagaccattctttcatggtttctgttgaggttgctgtttttggtttctcctactccgtgtcttccctccttagcctgcctgccccacacactcctgggggctgcattcttggaagacaccccctccccttaccttccccctcccctccccacccacctccactccccttcccctcccctccccttccccctcctcctccccctaccctcccctttctcctccccctcctcctgtccctctcctctcccctttcccctccccttccctttccccttttccttccccctccccttccccccaccctcaccatcccccctcccctcaccttcccccctcccctttcctccctccacctcctctcccttcccttcacctattccccctcccttcaattccttcctccttccccttacctcctccccaatcccacctcccctctcctcctccccctcccctcctccctctcccttcctccccttctcctccccctctttcccctcccctcctctccctccagtccttcccctcccctcctcccccctcccctccccccttttcccttcccctcccctctttctccctcccctcccctctttcctctctcttcctg

SEQ ID NO: 105866 - DNA, 1020 bp, Homo sapiens
ggaagggaagccccaggtaggattccgaagggtccactcgtcccgctgctctctcttgacgtggggacaaggaggaggcacaaatcaggggcagtagtggctagaggagggccacaggggtacagaagcagcagacctgtggggccggtggtggcagagaggtcaggacaactgacagctcatgagaaccagggggagaggatgaggactgcagagcagcagcccacacgccggttagccttggcaagggctggtgcacaaggggcaacccgcctgcgggcctggctggagagacaggcttagggccacgtggcatgggggggcccttagcccaaggcaggcaaacagaatctctcggtgcggtgggaggccaaatagggaagaactccggagcccagggaaccccagcccatccctccagaccctgagcccccaatctgtgcctccagcttggagccaacggctatgtgtttgccattgacctgaacggctacgtgttgctgcaccccaatctcaagccccaggtgagccagacgggtggcctggagggtgggcaaaccttccacaatggggacttctgacttcccaccctgcctccaacagaccaccaacttccgggagcctgtgactctggacttcctggatgcggagctagaggatgagaacaaggaagaggtaaggagaggaggagaacaggggtgggggacagagcagaggagtgtaggggccctgcccctcacatctctggcccttccagatccgtcggagcatgattgatggcaacaagggccacaagcagatcagaacgttggtcaagtccctggatgaggtaaggaggcagggctgggggccagggagtcagggtgggcacccttctaccccagcgccccctgcctgctagcccaagtacctgacccagcctcctctcccagaggtacatagatgaggtgacacggaactacacctgggtgcctataaggagcactaactacaggtaagtgaggccagggctgggcgggc

SEQ ID NO: 105867 - DNA, 1038 bp, Homo sapiens
agcccacccatcctgggggcatggggcggggtggcttctctgtagtctgtggcagcccagtcgcctctgcaaggtctgcctacccaggccagccctttcctgccagtccccctcaccttctctcctccctcagccaccccgtggcgagcccccaagaagatcgacctgtacgatgtccgaaggagaccctggtgagcgagcaagaaggggctggggagggacaccccctcagttccccacctttcctgcctgctcccctccctccccatttccaagcctcctagcagggcgcagccagctgtatccaattttcatttcacacatggttgccactggaaaatggatcccatcacccaggcaggcctcccagctgccatgccccccgtccactgcccagcacccccacccactcaggactgagagattggaagggagattggaccagaaggggtccccaaaggcagatgtagcctctgtagggttggccagtccctgccccacccgtctgagccccagatatccctcccctctgttctgcccctccggcagctccctgtgactctccttccctgccacctgcaccatcccatacacagctagactgtgccctcggggccccaacctgaggcagaggacacaacaagccactgaagccagggaatgtggctcctgccccctctggggatcacctgctcatataccccctggtactttttccttgctgaggaaccagaccattcatgtcatgggcaaggactgtgtctgtttcgttaaatgtggtatcatcggtgcatagaaccctgcctggcccacacagtgcatgctcaagagaaatgtattgaatcaatatgtatgtgaaggaaggaaggacccacaaggtcccagtgggccttaccctaacagaggcatctcctgggcaggtatatccagggggcctcgtcacccaaagacatggtcatcatcgtggatgtgtgagtgagcagtgctggcaagtggggctggggcagggacgggcaatgggctagactctgctgccct

SEQ ID NO: 105868 - DNA, 1120 bp, Homo sapiens
taataaccaagtgtcgaggctgattgcagcagcaggatgcagccagtattcagagcagctcttaccctgggcatttccacctggcagccaggctgtgccctccctgcccaccacctccagccctttgtctgcctgtcacctctgcctgggccctcagcatcatccccgggccaaccagtgcttggctttgtgtcccaaagctggtgggcagcgacaaggtggagcctcaggcgtccacatccagcagagtgacagcctagctggaagagtctggctcctgctcccactcttctggatgacctgtgcagggagccctggctttgtcttggcctaggttcatatcccgccttgctgcccagggacacagggagttgtcagagcccatccctggcatggacaaagctggattcagtttgagctctgccatttgatcattgtgtggtcttgggtgggtgagtcaccctctctgagccttggtgacctcgtcgggggaatgggaataatgattgggcttcttggggctttttggaagcatgtgtgtgaagcaaggtgcagataatgaaatgaggtcctgtggaagaggctgggccatgttcataagcacaaacacctaccgcaccaatccctgagtccagggaggcccaggagaatcgaaggcctaaatcagctcccctggcctccactgccctccttcctacccccacatctttgccctctgggcattacttcccttatccccttcatctgaccttgcccttcaagttttgcctggtgctccctttcccaaagcccacctggcttagcctaaccatactcctctcccatagggtttatgtgccctttgagacagccttggatgctcactgttctcctctcatgtctgccttcatcctcacagtcttatgaggctgggactagtagaagccccgtgttagggaggaggttatcaggattcagagaatggtatcagttctgtgcattacacatgcagctcctggctctgccccatggggtactgtggctgctggtcactgtctgcccagtcccaggtcctactagaaccaggagagtaagctaagccccagtctcttcaggggccctggtagagtggacaagcacc

SEQ ID NO: 105869 - DNA, 1029 bp, Homo sapiens
atcccatcgggccagcgttttgtagagcagaattgctaattatttcagaggcctggccacagccgaagaaggaagggcagtagtgggtgcagctttgggcggcatctgtcaacagggctaggcaggcactgggatgagacacccagcctgccacccttccactgccctcccaggatctgctattgttttggaaggggggctgccctgtcccttggtttctgtttcatggtttaccctagaggaggcagcagggtctgctcttgccagccctgctttgacctcatgttgaggactctggaaggtatttttggggtcttaaattgcttgtttgtttagagagtccacaggttgtggatgagaagactgcagagaccccagtggttttctccctgtgtgaaggcagagctgttcactgtaaggaccatacctgggcttggccacgcttgcacggtgcgggtatgtggctcggtggctctctaaccttgggctctgtgtgggcctgtgggggttgggcatgactgtgtgctgtttttgcgggtccagagctgcctggcgtgactgcatgcatctgtgaatgagatgtctgtagctgtgctgcatgggcctcagaggtatggttctatctaactcatttctgtccctgcactgcaaggtaaaggaggctttggaagacagatggccagagggcactagacatcagaaggaatgggccaagactggctcagctactttagggatgtcccaggtttcaagggggctgcatggcaaactgactaggggggtgggtttcatgggggaaatggggccctggcaaccgaaaccctggcttctgcttcatgcagctgaggagccttttatttatttattttttgagacggagtctcaatctgtcacccaagttagaatgcagtggcacggtctcggctcactgcaacctctgcctcccaaagtcaagtgactctcctgcctcatcctcccaagtaactgggattacaggcgtgcgtcaccacacccggctaatttatgtat

SEQ ID NO: 105870 - DNA, 1160 bp, Homo sapiens
catgcctgtaatcccagcactttgggagcctgaggcgggcagatcatttgaggccaggagttccagaccagcctggccaacatagcaaaaccctgtctatactaaaaatagaaaaactagctaggcatggtggtgcatgcctgtaatcccagctacttgggatgctgaggcaggaaaattgcttgaacctgggaggtggaggttgcagtgagccgagatcgctccactgcactccaccctgggcaacagagtaagattctatctcaaaaaaaaaaaaaaaaagagagagaaggggatggaatggagtagggagtcatacaaagccacccaactctgacctgtgcctagatgttggcgttgggaatggggaagttagtgcataagaaaatagagtggctgaggccagagctgaggatcgggggttcttgagggtggaatctctcaggatctctggaaggttctctgcctgggttctctgtccctcagtttaaggaagagacaatctcagtggccatgaacagaacctccctaggcagacagcactgctctgcctggaagattttagtcgctaacccttggctttgctgcagggcccttccctgaagtgagggccgctcaatccttccatcttggggatcagcaaggtttgtctgtgaaagtttcctaaagccacacacacacacacacacacacacacacacacacacacacacacacacacacacacacactattctgatgaacttgctggttctcttcagaggtccctagggaggctggccttacagcaggacagcgggagatcagttcaaactcagcccttgcatcttgttgaagagtagccagggtctgctgtcaccccagccggcctatgcatccatctctgaaaagggacagagctgccatgtccagagccggaggctggtctgaatgttcgagggtgggagatggggcttggggacagagggctgaatgggtttatgctcggccccctggggacagttgacccaatctgcattcctcccccatccttcactccctttcattgctggatcagtggcagccacggagacacttgcctcggattcatggagccccaagcacttggcggaggcagagaagtaattggttctgacaaaccacagccggccccaggggcg

SEQ ID NO: 105871 - DNA, 1049 bp, Homo sapiens
gtggcccagcgacactaaacacccctttcctggttgctgggcttggatgtcagcagcctccatcacactgtcttcctgtgaactctgaatgactcagccgcacttggaggccagcagagctttccagagaaagtgctgtagaaaaagctgttccggaacaggagtcaatttaggctcaggaatagcacccagcactaaccaggctccaagtagccactgccaaggatagctgtgtgggctaatgaaggaatgatagctccctgatgtgtgcagccagcacctttccaagtttcatatcgggacataagctataccacatatcaggagttaacggtactcctccagtcaataatccttcatgcctcaaacctttagcttgaagatgttgtttattttatattcacgggcaactcaggctctgaatgtctggcaatgagaaaatagtgttcatacgtcatggccgaggtctgtctggaccagtgagcttgctagattctgagaaccagagatggaatcccagctcagcgtaccatcatgtgcccctgggtgagcctggatcctctctgatcctcattcttgacccatacacagctgggaagtctgaccggaggatgaagtggtgaaaacagcaatggacaggctgatacagatacgccccttttttggaaatcaaatttgaatttccctcattgatcattttcactcccagggataatttcccttcctttctcatgggacttgagagattctagacactttcatcagtgagcctgtctcccccaccctctccctcccagcagtcaccaaggtggtcatgctgctggcttgtagcagagctggggcatggacccagggctcctgactcctgttccaacgtgcagctccggctgtggctccacttcccctcttggtagggtggacaagatgagcctggggcagtagggagctgggccagagcagggccgtgctcagcgtggcaggcaggcaggcagagaagtgctgacctggcatccccggcttctcctggcactctggtggagtgtctctgc

SEQ ID NO: 105872 - DNA, 1021 bp, Homo sapiens
actgacctcagaaaaatgaagggacctgcttaaagcccacaaccatgagaggcagggcaggggaaaggatagatctgtcagacacttggctgcccagccagagggctggggacatctgggcagtgggcccaggaagtggaggggggcttgaagcctgaatctctgggaagaaaatgaagaggcctaggatatgagagctgggcctgggacttccagctgtaactttgccctgtctgtctctctttcctcctctgggtctcaggcaaccctgaggggccttccttggcatgaagctgccttgccagccccagtgcttatagccccagtgctgacctccatctacctcccacgtatacacaggccatcatggagcacccccagcccagagctttccttcccccagctttgagttatgggccaggcctgctctgtgtggaggggtggaggagaggaggggcttcatctggagatgagatgccatttccttctccagattccagtctgattccggagagaaaggtcatggaggtgggggtggggctgggggttgttcatggaaacctgaggctggctcctttagtcccttggcagttttgccaggtctgaggggacttcacagggctaggatcttatagatgctgggggagcctcatgccatccggatgggtgggacttggggggtttgggaaccagcgttcaagggcttgttgctagggaactctccaaggggcagctggaggtttgggagtcaaggcaggtgggctgagctctgtctggcagggcgatgttgcctgtaagataggagtggtctttctctctcttcccccttccagccacctaccccactcccgtgcggagatttgcctccagacctggtgccttgtgtctttaagtgactgggctgtgggcctcaggcctggggaggacatgctggggaggacatgaggggctttcccattgctggctacagccctccagccaactgggaagattctcttcatgtcaggtttttttttctttt

SEQ ID NO: 105873 - DNA, 1044 bp, Homo sapiens
tgccagccccgttgcctcatctctgctaattgtttttactcagtcctttcatttttaaactgctgtcttgttggtttttaatttttaattattgctgcctccccttccatcctaattggtccaggcccctattgaggctccctgtgcctgtggctgtggccagttccctcctagtagccaaggcttgcccaccgcctgccccccctctgtcccagtcggtctcagccttactccagaggcagaccgcacacctggcccctggtgcaacaaaggcatcatgattcaagttcatgctccaaacacacattagtcactgactgtacagggtgcagtgatccttgggggatgtgaatgaccagacctacctgagtactgcctttgttgtgttgtgggagggctgcctgtgttaggtgggggtacttgggggggatcacagccacctcccaactacctgcccctccagctctgctttcctcatggccttgggcctctgcgatgtactataataggacaccagcctcctcccctactgcccctagcccagaggtcactagcagcctcccctccaagcctttgctcactccggtgcccctagcgattccctttctcctcctggctcagctgaatcctgctcagtgctctctgactgttcgaattggccggtccacttgtccatccctctgtccatcatccactcatttgtctgttcatccctctgtctgcccgcctgtgcttatcagcctgtctatgagtctcctagtatgattttttgccgcaagtccctctttgcatctgccctgacctcagtccttcccatgtgtctgccttgaaacctctggttttcccttctgcgaaggccccttctgtattttatttggtcacaaacaaccagccacagccaacttcctgagaagtttcaaaattaaacttgaccctcatttctcccagctgatgtcacacacattcctgcctccaggcctttgcactcagcaggcatctctgccagatgtaccctctcttctccttgacctatccaatgaccac

SEQ ID NO: 105874 - DNA, 1034 bp, Homo sapiens
gggatagttgcttggatcacagctatgaggtggcaccccaggtttctcttgagccgtctgaggaaatgcctctggccctgacttcgaggttgccctggggcttcatttcccaactgtggattggggtcccaaggcctgtcaccccctagggtggaaaggtcaactggacaggaccttgtgagaccggaggaggaagggggcttgagccccaagggccccgacgggggtatggcacctcgggacccaaaggagctgggtctgaaacatgaaaggaagcaaaatagtgtggctttttctggagcacaggggtgcaggggaagggtggggggtgggaagccattagggtcatctgtgtggaatccacccgcagggttcagaagggtttgggggagaatgacactagggtgaccagccatcctggttttcccaggactattccagttttagccctgaaagtcccacaaaaccaggactctaagtgacatctaggctctccccagagagctgagccttcaggccagcgtcatggaaataaggggcgggcgagcccccactcccccagttccacgatggagggctgagctagaggaaggggctgggggacagggccttaggtgaggggagggccacgtgcccatgagccaacgacactggggtcacagctcagcctgtcagtgatggccttgatctttggaagaggtctcctcccctcagcagattggcaggatctggaggggcatggagtgagaggaaaggcggtggtgggctgtgtcctcccaccctgttgggtgggccttcagcccagggatgtgggagcttcagaagatccagcgtctgggggatcctgaagaaaaggggcctgtggaataaggctggctcccagggaccaggacctggatgggggctccaggagaaccccagtgcccatccgctcctgctgcctgccccatgcccctctcctgcggggtgggcttggctagacgatgtgcacagggcagctgtctctgtgggtgccagggcacatgttcacacct

SEQ ID NO: 105875 - DNA, 1078 bp, Homo sapiens
cagagttcagtgcaggcccaaggactcccagtccagtgctctccccaagtctcctctgtacatccatccgcgttttgggggcttgagtctgtcctggcacgggtagctggcaggggtcccgagttctggcccggaagggcctggccacccactgtcctccgcccaacttcggcgcaggccacggggtgagggtagtctctaaaaactgcgaccaggttctaggctccctctgggggtggagccagacccgagcgacaagcgaacggtccaattctgggcgggctctaggcccgacagccaatcggaggccgggggcgcggagcgtgcagggaggcaaggcgctgtagcttcggggatcccccgaggctgctcggcccggccccacctccgccgtgggtcccggccctacccaccctagctcaggccggcagagccagcgctcgcggatgcggctggtgcgcagtagcgggcctggccagcggctcggggcttgcagggagggcggatctcgggtcggacccgcagccccagacgccgggcttgggggttccccccgccccggcctcctgccagtcactaccacccctagcctctccaactgagctcggcgccgggagaggattaagtaagtgctgaggtcactgctcctgtgcaagaagggaggcatcacagggtcgcggaggcgggcatggggattggggcagggaggactgagagacctggtggagaacagcatgcgggttctcgaaggtcgcggtgccgaccccttttaccccggtttccttcccttcccctttggaccctgaggcaggcctggaaagtggtcagtagggcctcttctctcctttgggaggcgatgttaacagagccccagggcacgagttaagggtttggcccaaggtcacgcccgggatcagttgcaaagccaagaaaagaacccgggacttcctatgtgcccagatgtgcccagcctagctggagggagaaggcaaagagggatgagcctttctaccccataaccctctgccagccttgccccttcctcagggaccatcagaggtgtttacacatctcacac

SEQ ID NO: 105876 - DNA, 2152 bp, Homo sapiens
catgtccttggagccaaaacagttaagtttagtgttgtcaagaggacaggaagagggaggagggaggacttggggaagggatatccaggttttctgttcactaagagtgcttagctgagactgatgggatttttctgaaggaacgtcttagcgcctggcacacactgtaacagtttgttggatgaatgaatatatctctgcctaagtgttctgggatagacacctggaagcctggtgttagctgtgtaaccttaggcaggatgctgccccctctgggcccagatgatgagagggttgggcctccagaccagtgctgggcaggcattatccacataagacacctgggttgggggccttgggcccagtgagccagccacttatattctctgtggggacagtttcagagcctgaggccggcactttggacccagcccttgacctctcagcaactacagtgtatccgggagctgagtagccgtcgattgcagaggtgagcacccatggatcagacctgaaggatgtgttcagggagcagcagtccagcctcccctatccccaccaagttcagggaggaggagaatgtccaaggactagggaggtgttggggtgcaggagtggcaagagtggggccggggtactgaataggaagaagggagggagggagggttttgcctcaggagtcccaaggccctggagacatggtcttgcctgatacctttggccacaagtggtatctcaacccaggcatggtcctgttggtcctagctctgtccctgatgaccacccagctgccccctctgcaggatgccggtgcagtacatccttggagagtgggacttccaggggctcagcctaaggatggtgcccccagtgtttattcctcggccagaaacagaggtaggtgtgccaccagggcaaggcaggatcaggatgatggtggagttcagggcaccagtcttaccccaggcttcctccagggggcactggggccccatgacttcagggacagtgcctttctagacatgtatttcctctctgactgtgttggcagagcccagaggacagaggattcctgttggtccccttgactgttatgttccaagctatcaacccagcctctaggtctggcaatggcccagagtgcctcaaatagtgctgcccaagtacttagcctgttctgccatttctctgggagccatcccatggctcacccaacccacagggaacaaatgtcttccagcagcttctcaggaggcatggaggaagtggagagggctccagccggacacctggagacctggtatcagctgtgcaaccttgggcaggtcactgccctcctgccatctctgggcccagatgatgagagggttagccctccagcccagagaatctggtggccctcttaggtctactgactggtctggtaatcacctgtgttgtccctcaaattactaggactagggatgtgtggcgcaagtgtgttatcccttggtaaggcaccctggtcctggaagagacgctttatatggcccttcttggactcccctctgaccttgtagatgacagagctgggagccagagggcgcagaccagggagtagagctgggtgagagctggtgggcaagccagagggcgccaggttctgagaaggagtgtttctagaaagacctaggcacacaaacatttctgggaaaggttagttcccattcccctgctgtggccagggggccccaaacccttctttcactttctcagcttctgtcccctagccaagaaactctctgacccctctcctctccatatcatgtggttgggaggccaggtccttgcttcactgcccagtgtcagggcagggacagtagggaatctgaggccttgctgaagtcacagggctgtcaaggaagggagcatgggggcagcacgtggacttcctgactcccagctcagagccccatccctcacatggggctgccccatctgggattggcatgacctaggacacagtatggagacccagagcagggtgtggcctgccacctgcagactttgggaggcttacctgtggctcctgaaaacacgtgatctctggcgaagagatcatttgctgtctccggcttcccagggtcagggcatggtgacttttgagttcctt

SEQ ID NO: 105877 - DNA, 1029 bp, Homo sapiens
caccccaatgtaaagccacatcgggggatgccttaccaagaactcaagaggacgtggcctgtggcagggagtagtgagaatgggtgcaggggatggtttctgatgaaaggggagtctgaagtgcaaacttgcaggaggcatgtgcccagtgagttgcattttccctaagggtgagaaggtggttcagcccctggcctggcagtgaatacagtaggaaactcagggctgggggtgtgaaccattctcacccagcctgctgtgaggctgtacaggttgtgggaggctcagtgttttgtctgtgattggcttgaaggaggcaatgccacctccctgggtctgccccaccagggatgccatcctaatagagggtactcatgggcacttaggttctgcccaggccttgggccagcctcttgatggggtatggagtccatgttggggcagcagttctaggcagagccaacaactgcctgcccctcacctctttcccgcatgcgtctgtgccccaccctgttcttggattcttaccatattcacctggagggggtgccctgagcctgtgaccagcatggcttttagtcttgccgaaagagccaccagcgttaggctgagggaggctcttcactaggaggagaagagaaagtttctggactccttgggctgttatctacccctgccccaggtggctctacaaccaagatgagtttccggtgctctggagtgttatggcaaacaagaggccactagtggtggcaggggctcagtttcttagcttcttaccctccccaaggtggccatccacatacgtggtgtgtgtctttgaggtctttgagtatctctgtgaggtggctggccagtgtggctggctgaggggtcattctccagccagagtaggtctgtctatgaccaggaaaccaagagaggcttacacacctgacaacaactggtcaccctaccaacctctcagcttgtggcctcaccactgagaccacaggctctcagccacagccctatactgctcactctgta

SEQ ID NO: 105878 - DNA, 1045 bp, Homo sapiens
atccccacgaggtgggctatcctcaactgggctcagatgtacagatggggaagctgaggcctggaggggcagggtgacttggccatgccccagctgacatgaaggtcagtctggctttggctacctccccttcctacgttcacaagggtaactgcttaggcctctgtaccaagacccccaggagccacgttggcaccgactctgatccagatccctctgcttcacaggaactggttgagtgggtgctggaagaggtggcccagaggtcccatgctgtgggatccccaggcagccccctcattctggaggtgggctgcggatcaggagccatctccctcagcctgctgagccagctcccccaggtgagcccctccacccactctggatagactgtgactgacactcactgtccctcccattagtgcttcccccacatccctctgctaggagcgcttgaggggaagcagctggatgagggaggacagggctgcccctagcccactgtggttcacagactctaacgcctaccacatctatctggctagactttggccaagaagaaaaggctgttgggtatttcccttctcttctggtggggggttggaggagggtcccccaggcccagtatcttccagcatctctcagcattgccttccacatatcctctgtttgttcttgggacagagccgagtcattgctgtggataagcgggaagctgctatctctctgacccatgagaatgctcagaggtaggtgggggagttgcactttggggcctaatcttgactccttttcaggtttcaaactcaccaatgtctgatttctactcccaagaaggaggaagcagtggggtagcctggcatgggtcccatggggttctgaatgggtagtgggcagtgagtatcttgccagtccaagaagggttgactataagacctcattcttgtagtgaagggtaggggtctgcccccgtgcctacccctttctccctgtctgtgtaggcttcggttgcaggacaggatttggatcatccacctcgacatga

SEQ ID NO: 105879 - DNA, 1132 bp, Homo sapiens
gctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcacgaggatgtgaccttgggcagatgacttcacctcactcagccttggcttctaaggctgagaaatgggacttaatgctttattttataggatgcatgtgaggagcccatgggatgtgcctggcttggcacattgtggcatttttcctt

SEQ ID NO: 105880 - DNA, 2256 bp, Homo sapiens
agccaccagagactaaagagtggcgaattcaacaacgacaagatgccacctccctcggcatgtttaaaaagttgagtacgctgagggttggccaacactaggcaagtcggaagcctagcaagccatactggagggccacctggcagcgtgcagagcaaacacccgactcaaggagagctttcaagagaaataagacgtcctgcgctgtcacgttctaggttgcgagtaaaacccgggacccgcacagtagcggactgccagtacaggggcctccctgggtgtccctggaaaccgaggaagtaaccgccccctcgggaagccacgcctcctattttgttccggctcgggggcgggacccagccggggcccgcctggccctttaaggctgacctagcggggccccaagttgggatgacgcgcagggagcggggggtggagtgggggagtgggggaggggggggtggggaggggggggaggtcacgtgggcgccggcagcgcgactctcggccctgggatttctgcggccgccagctcccgcgaccgcctctcctgcccctcgccggtacctcagcaaggtgcgttgccgccaggtacgccctcgctgggccccctctgcggcctcctccggggacctcgcggccattaggcgcccggccccttcccttcttgacacgtgcccgggcggtgctcgcttgtaccccgccgcgcgaccaccgccccttgctgcacgtctgtactctcaggccgttcgtcccgcactcccagcttgccccgggctcgcagcccagcccagttcagaggctccaaggctggggtgtgttggaaaagtctgggcgggactcactcttcccctttcccccaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaaggtcagtgagccctcactgaggcctggggtatcctggagggtccacagcggaagcctgtgagtgaagctatgtctagcgcccctgctaagcttcctatgctcagcaacatgtttcatcgtcatactgtcctgtaaggtcaggcttgtggtcctccctacttcacagatggggaaactgaggcgtagcctagctaagctttgagtgtcccagtgagcaaggggtggagtcactatggctagagatgctgtatccggaagcagggaaggggtgactcctgactctgggattctggctggacccatgtgttcaggcccaaaggggatctcttgttcagcttggctgccccttccatgtgaagctcctctgactggaatggatctgtttccctttgctggaagctgagaccccaccaaggcttgggtgggactgcttcttccctgtggcccctgcctgtctgggctggagtggtgtgagcctcccagggctggccagaggacaaggctgatgcccactgcacctgtggagcctcaggaggctgctgatagactcctgacgagtcgctggtcccgtgttgaaagggacaggccctgggccaacccacccctggttcctgggcagagggcgggccagccatctagccacctcagactataggctccctggagacctggcatgctgatataggtggcatggtgggggtcagggggatgctgggggcgggtacctggttccagcttaaggcatacagttctgggcctagggccacaccccatacccagaatcccttgaatctgtcatctctggggtctttactcatttgtagcttgtgccaatggatgggtagagcatggcagggatagtggctcctggaggctagaagtacagcaaaggcccttctcattttacaaaagattttttttttttgaggcagagtctcactctgtcgccaggctggagtgcagtggcacaatctcagctcactgcaacctccacctcccaggttcaagcgattttactgcctcagcctcctgagtagctgggactacaggcgtgcgccaccacgcccagctaattttttgtatttttagtagagacagggtttcaccatgttggccaggatgg

SEQ ID NO: 105881 - DNA, 1001 bp, Homo sapiens
ctagaagtccttacccagctaagcaggcatttactatctcccaatattgggctaagcacaacctctggtacagttattttacctgtcttgtgagtggtagctgtggccacgaggaggaaggtgacatctccccacttatagcttctgcccattgcccaggaagaccaggacctggggacctcagtacatgggcaggcctgggcccagggagcttagccagctcatgatggatcacagtcctctccttgcatctgcctagccctctccccgcagttgccccagctcagcctaggcaacagtcgtgggctctgtgtctttctgcctccctggtgatgtactccaggttaaccagggtggcctgtcctcatcttataacttgaccttgttcaggccatctctgcccatttgtctcatgctcatcctcttggctctgttgcccaagatggaagatagtgcttaacaggaagcctgaaactcagcaaacactcataaaacaggaagagctgtggccactgtccttgtaactgttgctattctgtggaggccctagaggagcaggtccctccctcccagggagctgggcctcttccgctttcccttagcccctgaccacctgcttggttcatcttggcctcagtcatactcagtggctccctcccaaggctaccttctgctgccagtgcagccattctactccattgtaccccaagccctcattgctgtcctcttggcaggaactggaggactgcctttcttggagagggtgtatgggccaggcggtcctccagtgtctgcttctcctgctgacctcttgcttgtgccctctcccaggcttaactagttaattagtaccttcagctttccctctaactgggcacagccctgcagatttgtcacacatcagttaccccaccacatccaagatccagtccttcaaactttatcacatacatgaaaattgggacccaaagtgagtcacacggtttgaagtggggggtgta

SEQ ID NO: 105882 - DNA, 1036 bp, Homo sapiens
ccctgaattctgggaaacaaggaggggaggagtgtaaggccatttcaggaagacccaggggaatcctaaagccaggggtccccaagcaaacccaggaactgttttcacccataccatcatggcccccaataccttcagtgtgcactggacaccaagttcatctgagctctttgtgtgtgctctcattccctccttgtggctccctgggaacaggagtattagcactatccccactttccagattgggcctgtgaggctcagagaggctgaatggcctgcccaaggccacaggggagttgggaatagacctggacccctgtggctgcagctagtcctgctgtgcatggtccctggtctggggcactgggaccctctagcactcacgttcccactgttcttccctcttccttcctgggagcctcgctcaggtccctctttctagaagcatttccctccactcttcccatcccccagacttagcatttcagcctttgtttccaggttgtctggggctggtgggaagcagaccaactgaggccatcaaaatttagtaaattggaggaatcttgtcttcctaagacttgatgatttcaaaatttgtgttggctatcctgtcccagagcttcctgggaagacactaggcttggaacctcagctactccctcccctcccaagaactctggtgagaagtggtcaggtggaggttcccagcctgtcaagctgccaccctgccccccatcaggtgtcctggccttggcctagaaggggagtggttgtttaggggtcctcctttcttgtgagttccctcagaaggggctggccttctccatcttgcctgttctgccaggttctggttctggaaagaaaggagaagggaagggaaggagccaggaccagtttcccaggtgtagatgtcatcatcaagcatcccagttggcagtgactcatccatagacccctaaatccttgaggacagagtgcccatggcagcattcccagtcccagtccaggtctagcccccagacagggccagtac

SEQ ID NO: 105883 - DNA, 1036 bp, Homo sapiens
ctaacacggtgaaaccccatctccactaaaaatgcaaaaaatagctgggcgtggtggcgggcacctgtagtcccagctactcgggaggctgaggcagaatgacgtgaacccgggaggcggagcttgcagtgagccgagatcgtgccactgcactccagcctgggtgacagagcaagactctgtctcaaaaaaaaaaaaaagaaaagaaaaagaaaaaaaggtgctgggaggactttccagagagagaaagagagagagagagagagagagagagagagatggagacagagagagagagagattgatcgatctgaattgagccctgaagtttccccaaaaagagggagttgacccaacagagaggatgaggcaagaatgcacatgacagggaccagcacagacctagacacagaggcctgggggagtaaggcctgtttgggaacaacatatatatttttctggccagaacaaagtggttttggcccagaggtggcaggaagtgaggtgggaaaggaaggcaagccctgcgtgctgggggaggacatttatctggaagatgtgaggaagtgtctgtggccacaggtggattagagtcataaggggagaggcagggctgaggaccctaatgaaagcattccagctgtgagcttggacttttaagagagaagaggaggactctgatgtgggagtgagatgccacaaggcaggcagtgaggagggagtgtgggagccagcctgggaggcctgacaggagatggtcaggtcagactggggaggagagaaccaggcagggggagggggaggaggcaaagaaggaacccggtgcagggagggaggatggtacctcttggctcctgtggctgaggattggggtacccctagctagggccgccacaggacatggtggaggcaagtggggggcactgagctttctggtcccagtgctgagaaagaagctggtgattgggaattgtgcgggcactaacctgaggggtgttctggaaggcaagggcagcatgagcaaggatccatggtg

SEQ ID NO: 105884 - DNA, 1018 bp, Homo sapiens
tcagcctggtttagacccagcagaggccacgtttgaacatatggagtagcagctccagtggcacaatctccaggccccagtgcgctggttgcccagcgagatggcattctctgcaggtcttgtggttctgtggtggaactggtttagttcactatcccacttacccttggtgtggtccgagggagtaactctccttttgtgccttagtgaataagctcagtgtctaccacagaggacggtagtgaggatcatgtgatgcaaagggcttggcccagtgctgggcacacagtgggcacagaggcagcacaggctgtcactgacattaaggggctgcccaggcaggggggtgatggttcctaaggtcagtacatcctgacctcttagtgcccaccatcctgtctgtccccaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaaacctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaa

SEQ ID NO: 105885 - DNA, 1039 bp, Homo sapiens
tttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcctggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcattttctcttggctcctgggtttactctttgtctacaggggtggacaaaggtggcccaagggcagcttctcagacccactagtgatttcaccccagctggagggggtgcctcaggcctgataagcatgccatgctaactccaaggccagagtcctcgccaggcctagaaaggtcagaagagctgagggatggcagctgccacatgcccccagctctgtgctgcccctgtgcagtgtgtgtgacacctacccccggtcctgtgtgtgccagcatctgcccagagtggccacccccagctgtgtgccagcctgctgaagggcgggcagagtgcctgctgcagcgctgagctattttcagaaactgccagatttcatttggcagtgagaatatcgaggaggggagggggcggcatgctgcaagactgtcttttgactactccagtaagagagcactctcacccctccggagcccttgtgggtagcttcaaggagggccctaactgtggcatttctctcccagctcctatcttgagaaacctcccagttttccaagagctcatctgctgcctgcagcgctctctcctccacccccacttc

SEQ ID NO: 105886 - DNA, 1001 bp, Homo sapiens
taaatcttattaattacagattctgaagaacacgatccatctcaagaatgtgtaaatgttacagtagaaatacccatatatgccacagaagaggacagtagtcaagccaaactacatttaaacatatttaggccaggcgcagtggctcacgcctgtaatcccagcactttgggaggttgatgtaggcggatcagctgaggtcaggagttcaagaccagcctggccaacatggtgaaatcctatctctactaaaactacaaaaattagctgggcgtggtggtggacgcctgtaatcccagctactagggaggctgaggcaggggaattacttgaacctgggaggcagaggttgcagtgagctgagatcgcaccattgcgctccagcctaggcaacaagagcaaggctccctctcaaaaaaaaataaataaacaaaaattaaaaaaaatttgaggacctgttctaattaggactaaagatgcccagccaatcagacggaaacatacaaataaatggactataacgtagttctattcaaaggcagctaagcatgggtagattacctattcataaaaaataagtaagagggcacaaaatatagttagatacaatgaataagatctagtatttgatagcacaatagggtgactacagtcagcaataatttattgcacattttttaataactgagggagtacaattggaacctttgcaacacaaaaaaaggtaaatgcttgagatgatactacatgtaccatgtgattattacacattgtatatctgtaccaaagtatctcaagtaccccataaatatatgtaaaaaacgtgttctgacagccagaaattaattatctaattgttgctaatatattagaatcaaaaaagctcatacctttatgctgaacacagatcaggaagaattttatataacactatttcatcatgtgactaattatggctccagaattattgcttataatcttattagcacaaaataaatgta

SEQ ID NO: 105887 - DNA, 1062 bp, Homo sapiens
cctcagcctcctgagtagctgggattacaggtgtgcaccaccacgcctggctaagttttgtatttttagtagagacggggtttcgccatgttggccaggctggtctcaaactcctgacctcaagttatccacctgccctggcttcccaaattgttgggattacaggcatgagccactgtgcctggctcaccatggcctttataaactgtcatggcactggtgggagtgtcgtttaacatgctaatgcattataattagtgtataatgagaaatgaggacaactagaggtcgcttttgtcgccatctggttctggtgagctttgactggcttctttcggattaaggtgttagccaccatgccccacctagattctgttattcttaaaactttggctaatctaaggaatagtgtgttcaatacactttaaaagagaaatctgctatcaaatatgtgtgaaactatctataatatgattcagaaaaaaatcagatttatactctccagcttgatggtagaaatgttcttacagaagagccaacatcaatgttagtgctacaggcagcacaggaataggcagctaagtcaaatcacactaagagaacaagaaagaagaggtggaaaatggaaatgctccaggtaaactggaagctggaatcaagcaaaaaatctatagcagaagtacatgcaggtgccaaagtcaaagcatgatacaaaactcaattctagattaaactaggacatgaaaaagatggcttcagggagctatacggagaaaaaaccaacaaactcatgcagtttggatcactggcaccagtcttccagcacaaagcatttttttaaaaaacaaataatatctcaatatttaagctagagaatgttttacatactttagaattatgagcccaggaagtgcatattaagaagaatcctggcttagaggtgatgtaatgaagacaagatacctacttgaattggctcttgaaacagattctaacactaattgggatagggaaaatgacattaaataaacaacaaacatcatgcaatggtctgaggacacc

SEQ ID NO: 105888 - DNA, 1036 bp, Homo sapiens
ttttaaactcatacattatttttaagtacatcttttttctgaagcatctattctcatgacacttatatttttctacttttaaggttaaaactactaccaggtccataattaagtttgttaagatgtttccgtttaactcttacaaaggtgacaatttttattaaactgaaaagactggaaatctgttacaccagagggagtcggggaaggacacaccgtttagaaaagctaattagaaaatcagatgaggcctagaaatcaggagtgaatttcactccagggactgtggctttatattgaaacattagttgcttcaaaatagggcaaatgattcttcctctcccaacttggatatctctcctggagaaaccagagttattgctggatggttgaaatttttgcttttatgtgaactgcaacttctgtgagggaaagcagctctgggctcctgtgtaacattctgttctaagtttagtaactttgatttactaaagaaatgaataatctaggatgtggtagagataaatgctacttttgcatgatccaaatcaattatgttactttgttggatgtcactacgtagagatttttggatagaaggaggtaatgactttcagactttaaaattaagttcctctttatattaccttagtagttcagagaaatgagcacttttcatagtttaactatttctctttttcttttcattccttttccatgtctcttgtatttcacccaacaccaaaaatgccctttcagaaacacaaagtagatcttttctacaaactacgccatgtgatgaatgaacttattgacctgcgaaggcagctactgtctggtcacctgactcaggatcaggtgcgggaggttaagcggcacatcaccgtgcgcctggactggggtaatgagtaagtatgaaaattgtttgggtatctctcagtttcatttatgataactcagtcttcagggagtttgcacctatacaaagcttctctttaatgattcaaaggcaatgttatattcttcactaagcttt

SEQ ID NO: 105889 - DNA, 1054 bp, Homo sapiens
catgtaatttgagcttcacaataactttgtaaggaagataatacaggctcttatctgaattttatgttcaggaaaatgtctcctggagagattaagtgatttgtctgaaatttcacagtctttgagtggcaaagcttgaattagaatctgcttcttctcatttcagccagccagcagtaaaggaacagcatggggaagtgtttgggagggagccctttattgttaaaggcatcattgtggaaagtctgaagaagctggatcaggcagctcagaaagtggtacagtatatggagaggacagtggcaaagcaaaaatttagtaccaggcaccgacttgtgacttgtctgttagtcagatctggaagggctcaggtttgaatctggattttgccactttcttgctatgtgaccttcagcaaattacgtccatactctaagccttagttgtctccaccaaatacgaataacacttattttacaaagttatcagaattaaatgagatcatgaatataaaaggcatagcagactgcccagcatatagaaagttcttaataaaatttagtttctttcccggtagagtttatttttctttccttctttccatagcatttatctagccggcagagtgtacagcaaagcacatcccaggtaagcggctttcctgggtcttccagcctttcccctcaactttttctgttaagagattacaacatatgaatacaccaggaaatgacagacaccactgacttcttgactgtgtggtgtctttatctgaggagctttgacctctaaacagttttggccagactctacttctactgtgcagatttgcataagcacaattaaagcagactgaaactaaaatgaatcagtctgggagaaaataaaaatgttatttagaatggtaactattacgaggtaacagtgtaaatcaagcgcattggggtcataatggcatttctttaaaatgagtttgaaaatggttttccgggctgggcgtggtggctcatgcctgtaatcccagcacattgggaggccaaggcaggtggatcac

SEQ ID NO: 105890 - DNA, 1119 bp, Homo sapiens
ctaatcccattcacagttatagaggtaacacttcctaattccatacaggcttgactgttacagccttctagccagtagctgcagcggggaccctcaggagggtggtgtggagggggaaatttcaggagattctaactttgtgcacaactccaagggtgtaagtagtgagccagaaggcagctcacctgaggggatattacaaatactcccaagttttgattaaagatcatgtggaggatctgaaatcctcatggagtcaaggcttagttagtcccacaaaagcgccctcttttctttgcagaatgtgatgtctcctctgttgcaagccagtgcaagattgaactagaaagttacttcccacactttggcatactcctagcataaaacacagcacatcttagcttgctcatttctcatatttgggatggcctgactgaaggtcttctttggtcatgtttgtttctagtctttagatttctctaggttcctaaatatacaacttatgtagttgaaccctctcattcaatattcacaagggccagctggaccctagttggacgctggggaacagagggaaagacaactcaatctcccagacctcagtctatgtttaatagactaattctctgggttattggggtcactttgacttaaatttctttagctttccaaaatgtttcttcaaaataacttatactgtctgcataaaagtttttctcaagaattttgctgaactttgcacattttcttctggaaaatgtgactgtgtcttttcaagtactatataacagggtagaactgtggttctaagaaaatgcttttgtttttgcaggtcttatcatttctctgcagcttcttcgtggagacatggaacagattcggagagaaaatcccatgatatttaataggggattggcaattacaagaaaattgggatttcctgatgtcattatgccaggtatgcagaactgcttggggctgggaaggaagatgggttaggatggaatctggtgctcccctcctgagcaggtggtgaactgtgctatggagaagacctgcagctattaaaatctcccacatcccaagtcaggctgcttactgcagtctgcagtcaatggc

SEQ ID NO: 105891 - DNA, 1051 bp, Homo sapiens
attttctaagacttgaatttctaaggttatcattgattgtaggtgatatgagccaaattacatattaaatggttttctgtcttgtcataagaagtccatctatgatttattatgttgttctaatagatgactaagtttttttcctaaagcagtggttgccgaacctcagtgtgcctcagaatcacctgcaaggcccataaaacacagatttctgggcccaccccaagagtttctaacttagtaggactgtggtgggacctggcaatttgcatctctcacaagctctcaagtgatggtgatgctgctggtctggaacctcctttgagaaccatgtcatagagagtactctgcttatggatgtttttctccttcttgattccctttactcaattactgctcccctttggacatatctattagaaggcagctatataggcatagcatccttttagaggaccctctgactcttccccttgtgctcagaaacacactctgtccttttctttgactcctgacaaaaatgtgcatgtttcatcactgaccttcaagtgatgtttctttcttttcgtgtttgtcttaattgttcttgtttttctctgtgctgtcccttcattttcgcccctttctttctgacgcagagatgaagatagttgggtgtaagttctgtcttttgtgtgctctgtctgcttattgcctgctttgttctcatcttcatttgtttcatggaatgttgcaatactggggtggggtatcatgtacatattaataatcctcatcagcctcaccttcttgggtaactgacaagacataaaaagaaaagctaccagcccatcctataacactgtgtattacttttgagtattcactaagatctgaagaaactggagacatattggaatgtctagaaaatcttaacaagcttaaggtgtatagatacaggaaactatttttgtatgagactgatcagttgcattcattgaaaagaaaaggaatcgtgcttactccaagccaaaagaatcagaaaggtggaaagcttctctttttggctttg

SEQ ID NO: 105892 - DNA, 1082 bp, Homo sapiens
tccgcaatgacctgtacctaaccctggagaagggggatttcgagagaggaggaaagagtgtacaaaagaatattgaagtgaccatgtatgtgctttatgcagatggagaaatcttgaaggtaaggcttgccagtcagtcatttgggttggaggataatcctataataattctctgtggactttatccagaggcccattctcttcaagcaggattaaaatcaccccatcagcctttttctctgcctttttctttcttgaagaaaactctaaagtgtgctttgataatgacttccagtattgtacagccattgcagaaatttatcctagtgtctgacctgaatccctcttgctccagtttagatttattccctctagttctatcctacatgttacctctcctgtcattccacctagcatagagctgcctacttttggtaactgttattaggtcccattctgcctttttattccttgagctaatacagaaagttatatttacactttggtcaagtgtggaacttagacaatcacttcctggtaccaagttataggacaaagaacagcagactcaggccgtggaagatttaagccaatgtagtacaagtgtcctctgttattcttcactgaaaatgaagacttcagtgctgtttttctgttgcatgtgagttttttcttcagtctagtcatggtaaagtctgcggtgaataacaaggcatcatttgcagcccactttgtagaagacaaatcggtgttgtacgaaccttgcttctgtgtgttggcagcagccctgtgagatagaacaggaatgatcattcccatttgacagaggaaaagggtaaaattagtcaaaatcatttcccaaatcaagacagaaatagaggagaatgttgaaatagtagtagaaacaacgatttgtatgtcattttaaaaacttaactcaaaaacctaagcctgttcactgtttgcatggagcatgccagtggcaggagaatggtcagctgatcacatcacccctgtgtggacagggacctactctggcttatgtggcccaaagcttcctgttgtccagacaagggcatggg

SEQ ID NO: 105893 - DNA, 1047 bp, Homo sapiens
tgtagggatctttttggagatgtttttcatcccaagaacctaaagagataggcatggcctgagccagccttctctccccatctccctcctcctcctctctccctgtccttcttcattctttctcctccctctaatcgttctcttttccctctttttactcttcctcccaactcccttttctccctctgtctctccctccctcttattcccagcttcctctatcatgtctcgtgatccaagctcacatctgagatagcctaggatgagcagtactttcatgctagcagtccttaaaggagtcaagcaggtcctggggctggaccaggctcctgaaagtctccctaactctggcccagctcttcagcctccacagtagggtttggcccaaggacttaaacacacaaacaggacttatattccaggaccagtattccttggcagggtcttagaggaaatgctgactggctgaggatagagccccctattcacatatccaaacctcattttcaactgtggggctgactccaaatgttttctaaagatcccttcctgctaaacaggctggctcccagatcttaagggatatgagcccaattacctgctgctacctggcacccaagccaagttctcttctcatcacccaggaccactggacagaagtggcagggagacaagaagtagagctgttcaatgctgcacgaggttgtcatgagcaaaaaattccccctctagggataaccatggccacaggagccctgagggaggttgcactacttaaactcagtgggcctgacccatttggggcggacctgctgtgttcttggatgctgcaggttctggtcatctccgtccctccaggctcccagtgcaggtctcagcctgtgtggacaagtgtggacagcatgaaaagagaaaaagaagcttgttgtagtttgagaggtaggggcacattttccagaggaaagcctggagatcctgaaatttctccctctgttaggattctcccatggtatttcaaggtgaaatatgcagagaagctcttttaca

SEQ ID NO: 105894 - DNA, 1028 bp, Homo sapiens
ggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatgggttttcctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcccagccaggcttccaggccctgaggacatgtg

SEQ ID NO: 105895 - DNA, 1032 bp, Homo sapiens
tatagggctaaaaagggcttggagcccggcgacaagggttggagaggggcacatcctctgctcccattcagtgaattcagtggatcagtatcacgtatttatctttaattcacatcacagcagtcaaggaagtggggaaagggggaaaaaaaatcaagtggcagatatttacatctaaaattcacattacttgttggattttgaacatgctaccacaatatatacagtaaaatacctcttgggacaatggtacaaattttgtttcctttaactttgcttttctggtacaggtaagatcatttttaaatcactttttttctttaaacatgaatacacaaaagaaatggttagaagtttccttgttttaaataagcacagaatgcgggaggttaaaaacacatttatagtgctgaataccaattggacatcacactctatacattttttgctcaaattcctgtacaaatacacagcattcaaataggtatttacaaataagcttgaaagaatgaaaatcagtattttacaatcttttcaaagggttctcatctctggcctcccatttcccctcagactgacttattctccaacaaaagggatttcagaatgtgtccttttcatttagttagggaaaatggagagggaaaacaaacggtttcaccttgcataatgcgaagccaaatgaacccatactcccctccctacctcttgtgccaccaagtggagaaggtagctgttcttatgtgatgactgccttgtccagggattgactttcagaagtgccttaaaatctaagccctcctacctatgaatcaaatccaaaactagcccctaacccctaaccctctaacacctgtgaacaccagatggtccagagattgaagcttgcaaatgaatgtaggctgagaagcaggccagccctttgaggtgagggctgctgtaactgacccatatcctcagcagccttccgccccactctgcctggagtgaacctggtggtatcagaagggacccacactggtgataaacccc

SEQ ID NO: 105896 - DNA, 1096 bp, Homo sapiens
tcatttggcttcgcattatgcaaggtgaaaccgtttgttttccctctccattttccctaactaaatgaaaaggacacattctgaaatcccttttgttggagaataagtcagtctgaggggaaatgggaggccagagatgagaaccctttgaaaagattgtaaaatactgattttcattctttcaagcttatttgtaaatacctatttgaatgctgtgtatttgtacaggaatttgagcaaaaaatgtatagagtgtgatgtccaattggtattcagcactataaatgtgtttttaacctcccgcattctgtgcttatttaaaacaaggaaacttctaaccatttcttttgtgtattcatgtttaaagaaaaaaagtgatttaaaaatgatcttacctgtaccagaaaagcaaagttaaaggaaacaaaatttgtaccattgtcccaagaggtattttactgtatatattgtggtagcatgttcaaaatccaacaagtaatgtgaattttagatgtaaatatctgccacttgattttttttccccctttccccacttccttgactgctgtgatgtgaattaaagataaatacgtgatactgatccactgaattcactgaatgggagcagaggatgtgcccctctccaacccttgtcgccgggctccaagccctttttagccctatagacatgtcctttttgcactgagtagagccaacggttcccgcatcctgccttgaaggcaggcagccaggagggcacttgaaaggagggcagtcgaaaaggaaacatcctccagtgcttctctggtgattcccgggaccccactcaggaggtcccacggcagcgggggaccccgagggcctagccggggaggcaggaggaggctggccagccaccaagccacgattcagagcttgtaagggcacctcccgagcccctcaccttcccactctgaggcgaccccatgtcctcgaccgatgatctggcccgggcgcttccctccacggtctagagtggcggcccagctttgagcttggcgcgccttgagcccttccttcagatgtcccgcagtccgtccaccccgcacgtctccta

SEQ ID NO: 105897 - DNA, 2066 bp, Homo sapiens
ttgcctgcggccgcccgcccttcctgcctaacctgttgtcttggctgaccccagaactcctgcaccacgagtcggagtccgggcgaggagatcagcaggggttttcgagggagcctggggcccagggcaggggtacgcgggtcaactcaacagatgtaaggcgtggccgaaccccattcagctagcagtacccagcctcagccacagtcgctgcccttacccaagatggcggcccacaccgcttccgtcgctgctgtagtcgcttcctgcggccagcccgggttcaatcagcggccgacaactgtctagggctcagacaccaccagccaatgagggagggcagcgtggagccgcccgtctgggctcgcggctcctggaccaatggggaagtggcatgtgggagggcgccggggggccccccgccaatggggagctacggcgcgcggccgggacttggaggcggtgcggcgcggcgggtgcggttcagtcggtcggcggcggcagcggaggaggaggaggaggaggaggaggaggaggatgaggaggatgtgggccacgcaggggctggcggtggcgctggctctgagcgtgctgccgggcagccgggcgctgcggccgggcgactgcgaaggtgcgggatagggggccgggggccgcgctccgtgaccgttctggcggcggcgctgaaccccacaacatcaccagacggccggggccaagagggcgagggcgggggcgggggcgggggcgacagcaggtccccgcggggcctgcatgaggaggctccggcgcccgccctagtaaatctttcttgggcctagaaaacattggtccgacgaagaaaagttgagactagatcccgttgaaaacttgtcctgaaatctccatcactcctgagttattgtccccaccaccatctagaggttaccgctccccgttcggcgtcgggagctccagggctggccgtgggtgctgcgccctgtctgttgggatcacgaagctgcacctctgggtccgctgttgtatttggaaattagcagcagcattttgatcatttttctcttcaccttccagtctctccatttatgaggtcacagtgagtcccgtctcaaggacacgtgttcaccatgggcttaaacttgatgaaaggagcagggagaagtcgtttataggtcattgggtgatgcttggtcctttgatgccctgggtgtaccaggggacccccgccacttggaaccgggttctgtctacctgtagacacctgagaaaaatcggtgatggaaaagctcacctctaatgattcatctccgtgtctcctattaaaattgctggcggagttcttttctggtggattggaacagcttggtgattgctgagcatctcccgtccctctcttttccagtttgtatttcttatctgggaagattttaccaggacctcaaagacagagatgtcacattctcaccagccactattgaaaacgaacttataaagttctgccgggaagcaagaggcaaagagaatcggttggtaagtagctggtgatcctccccaactggccctggctcatgttaaccctcggcttcaccagccgtttgataaaaggccttgcccacctctctgttcaggaagccagctactctctccataaactaatgtgagaagactgaagtgcttctatgtccttcccaaagcagcatgtgttctgcaactgtgatttttttttatcctgttagtctttattaagcacctactatgtgctaggcactgggaatatcaggggaaagaagtgacagtcggacacacaaataatgcaatgtctgggtgtcatgaagaaaatggaccagcaggtgctgatttagagtggccaagaagtctctgaggaagggttatcattgaagtggggtaagaccatcccatacagggaacagcagtgtgagtgcccagaggcctgaaagagtgtggcatgtatgtggacaggagaaggtgacagggtgcctacaggataggcaagggccgaatccaagacaaaagccctagtgaagcaatgggttttctaacttgaa

SEQ ID NO: 105898 - DNA, 2296 bp, Homo sapiens
aggcatggtgacaggcgcctgtaatcccagctgctcaggaggctgaggcagggagaattgcttgaacctgggaggcggaggttgcagtgagccgagccaagattgcgccactgcactccagcctgggtgacagagcaaaactttatctcaaaaaaaaaaaaaaattgttttagttagctgggtgtggtggcccacaccggtagacccagctactagggtggctgagaggggaggatcaccacccaacagattgaagctgcagggagccgtgatcatgccactgcattccagcctgggtgacagggagccctatctcaaaacacaagtaaggccctacagagagatgatgtttcaaggtgtcagtatgtttggaggagatggctctcaagcacctcctgaaggccattgtcctttattgctccagtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatggtgagtatgcctagtcctttcttaatgaatgctgtgcaccttctgggtttgtttcccatctgggagaggaaaatgatgagctagagtcatgagtgggttgtattgtatgacagatggtgctaaatgctggagggctctggcatggaagtgggtggaggtcagaataggccttattgaagaagtgatatttcagcaaactttgaaggaggtgaggattagccaagaggccagctaatggaagaggatacaggcaggataaaggtgtccagtggcatggcaagtcagagagcattgcaggctggtgagggcttttaatctgcgtgaagttaggagcattaggagtttttcagcagagaagggacatagtacgacttgggtttaacaggctggttctggctgcaagctctgaagccccagtgatttttactattctgaaaagaaacactatgtccaagcatgcaagcccaagagttaggaactacagcatctctcttgctgactgggtctctggtgtacatagtcccagtcttcagaaacagtcagggcctcttctgaaaaacttgaatggccaaggacctgtgttcacctacttgcgtcttcctggtacaggtccagttggctccaggtcactgtggtcatggagagtaagttcctaactcaaaggcctgagcagggctgctctttggcaccagcctggagttgttagtatgtggtgactatgtcagaggcacttggaagatgggaaccatgtttctcctataaggacagtgtggcctctgtccctatccttgttcacgctgcatatctgtagtagacataatatgtagccagccttcctggtgaagaggctagttccctcttgtgggggcagtaggcactgacatgcctgtaaatgtgtctggaaatgtctcttcctctgaaaccagtagggctggtttggccgttcagggagtgacatactctgggactactgggggactgcaggtgctccacccagtcagtgactctccctgctctctcctccagacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtccttgcagaattatagtgaataccaaaatggggttttgccccaggaggctcctaccagtttctgctttccagttgcagagtttggggggttattcattcccatttatctctcaacccaccagtgctgaaaataccagagcaggacataggggctggggccagctgatgtgtgtgggtgtgtaccactagagggcagcaggcactcagcagaaaggaggtggcgggggcggggggtgctgcgcttgataccctgccccttgataca

SEQ ID NO: 105899 - DNA, 1037 bp, Homo sapiens
tgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttgga

SEQ ID NO: 105900 - DNA, 1118 bp, Homo sapiens
cccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgtgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcat

SEQ ID NO: 105901 - DNA, 1313 bp, Homo sapiens
ttctgtaagatcagacagtaaatattttatgcagccgggcacggtggctcacgcctgtaatcccagcactttggaggctgaggcgggtggatcacctgaggtcaggagttcgagaccagcctgggcaacatgatgaaatcctgtctctactaaaaatacaaaattagctgggcgtggtggcacatgcctataatcccagctacttgggaggctgaggcaggagaatcgcttgaacctgggaggcggaggttgcagtgagccgagatcgtgccactgcactccaggctgggataatagagtgagactccatctcaaaaaaaaaaaaaaaaaaaaaaaaaaaatgctttgtagggtatatggcctttgttgcagctcttcaactctgctgttgtagtgagaaagcagtcatagacaatccgtaaatgaatgattgtggctgtgttctaataaaactttgttttgcaaaaataggtggtgggcttgtagtttgtcaactcctgcttcagaggattagccttagaatgaaaggccaaagtgtagctctccgccgagaggcatggctagaatcagtcagaagcagcccctcatggggtgctgttctttttggggtgaattataaagaaatgcaggccctcttgtggaggagccctttcctgtctccctttggctaatccctcctaacagccaaggggaaaatattttccctttggcttctggtttattcacttccttttatttacctttttttcttaatccaaattttgaggaacaaactccagttcttctagttatttcccattaggtttctgaagtcaagttgtcccctgactatggtaatgaatcctgcagaaatcagcaaatagttcaaagaggctgttagctctgcagctgtacatgaatcttcttaccaaggctgtattttgaggaagcttgagggtgggagggtaggggagtgtcttctatatgttcatctgctgttcatcaacttctgttttttcatacttggaggctgaggtgattcagtggagtaggccgaagcctggtcagacaaagttttaatgaacgtttttgtcacgtgtgaatagtgagacatgggaaacaagttatacctcctttcaattacaagtagttagcagggcaggttcgcagggtcagcaaacagcaggccagctgatggtggtgctcccaaaataagagagcatcactttaatttttccattcttaatttgaatataaagccactcagtttgtatttggcctgtacaattactgcctcttttagctgttgaggaaattccttctttcaagccaaa

SEQ ID NO: 105902 - DNA, 1035 bp, Homo sapiens
aacaattagaatcctttgctattggcaaggctgacagttgatgtttgagcagaaagataagtgtcttgagtggcagctacgtttacttggaaatgcctcttatccctgtcaaagcaaagaggtatctttgtgtcctctcccttttgaagggaaacagttgggattctaatgcaaacctgaaatctgtggcagatgccagaatgtaccatttacaaagcccagagtccctagaacaaagtatttcattgatgttctggtaattttcttgcctttgcaagttcttgtaagaatggaaagaaagatagtttctccagcatacttttttttctttttggcttatgacaggaaatatgggtttctgttagtgttctatattttaagtcttttgttgcaatgttgttctgatcaaatgtttgtgatagcatagttaggagcttatccacattcttggttagaagatcaagggcaagagcttgaagggctgaggagataatgagcagttgtgttcttccattttgttaaagcattgcattttagattccaggtaaaaggattttttctagtgtctcagctgatttcacttgctttggttgatgcaggtgagaaagaagagtccccttgggctcctagaatattgaaggcagagacttctgtgaagcgagttgtctgtttccttgcataagggctatgtgaccattaatccttgtctgaggggtgctttgaccgtcttgagggacatgtgtgcctatctcagccatcactgacaagtctggctggctcatgaagtctgtgctcgtctagatcactactaccctctactgacagtttcctaccctgtctctttggtcgacccgccatgtggcccccatgggtcaggcctctgtgtttgtactaatgaacattacgctttcttaccaggaagaggaagaacaggaggaagaagatgatgatgaagatgatgatgacaccgatgatttagatgagcttgacactgaccagttgctggaggcggagttggaggaggacgacaataat

SEQ ID NO: 105903 - DNA, 1442 bp, Homo sapiens
aaatctgaggccaaaactggattgtttgtcaacatcattatcccagccctcccatatccgtgcatttaataaggcagtgggcggcagtcttctctgggaaccatcacctgggtccatgtgatgcctggtgtctgtctttgagggggaggtcaactcagaggaaagttgagattgccctagacaccttgggagttggaaggctattctctgggttcgccttattcttgcagacatggagtggtgagaggcaaaggcactggaggttggtggctggctgtggaagcgagaggccaccataagggaataatttaagagttatactcctcttatcccactctctccaggaaggcttgggtcagggaaaagactgactaattcttcttcttttgtcctgcttaacttctgagaagttaagggagaaagagattaggaagggcatatggtagtggtcaggacttttgacttggatgcaggaaggaaagcaagaggctgcctcagcgtgacagccaagagtgagaggggcagggtcaagagggctctaaggagtggctctggagcccagcctgtagaagagccggaaagctttctagctcagagaagactaggtggcagggtaggtgtgcaacatggctaagttattactgtggcttccagatttcttaggatctaggcatgtttcactccatactgatattacagcttttattgatcatctggtgcatttcatgtttgaaggacctctgttagagaactgcttatcccctcaagcccttggcattttgatttttgatttagagatgtttgatttagagatacgggataataccgtatctatttgagtaggtctcttttgtaaccttaattctgttgatccatgctccttctagaatcttgtggtggagtttggctgtttttactatctccatcagatttctgcctactgcctctcatgcacagtgtgccagcttgaattttttttaaactcactttcctttgtaggaaaaccagtctctagttttactttgctttgtacgcttcacctgattttaaaactagagacttttcattttcctatgaatcatttgctattcaaagttttgtcctagtctagatatctgttctcaggtcttctcagatgttccagatatgacttatgtggctcagggatacaggcacctgtgaccaacacctttgaatttgccttttcattatagcaaaataaattcagaagcctgaatggtcagccgtcatctaataaaatggtccagcataaagagctttatcgagatataattgacatgccataaaatatttgtcctttgtccttatgcttaaataagcttggagattaagaggaaaggatgaaaggtacagctagctgtatctagatgaatgaaaacctaaacaatgtattggacacccataaatatttggttcctgag

SEQ ID NO: 105904 - DNA, 1064 bp, Homo sapiens
cattcccctcctagtgggaccttcgaacttttcatcttttgcatactgttcccgctctggatcagtgtcgcgtggtgttcaatcacacgggaacagtgatgtatggaggtaataaaccttatccttcattattctctttccttttgctctaccccttcacttaatttgatacttctttttggaaccatctctcacttgtgaattggaaagcatttgagagttgtaacataaaagataaaaaattgatagtatgaatggtgacaaaagatatgaaaataatgttggtttagggtgaaaggcagcttactttgaagataacaaggaaatcttgtatggaaagaaatttcatgcagtattttccagtgtatcattatgaacttaagagcttttgcatttgtcctcttgtgttgttataagccttgtaagtacagtaacacttcttggaggtagatgagaggctgaggatattatttgtcacaataggtgggatatgcaaggaagatgctctgagaggagctaactagatgcagagtagatttctgtacaagggaatttgtatgtaaacctatatgcaagtagattgttttgattggccattaacattttctgcacttgtgaagaggggatgtttgtgattcctaatagtgtttcctcccccactccccctcaagctatgttgcaggcagatgatgaagatgacttaatggaagagaggatgaaaagcccctttgggtcatccttccgaacatttaatgcaactgactacaaacctataggtaagcagaaagggacagacattgatcattttgtcgtgttttggtgttccttatttaagatccttcattttctggaggcctgtaattttttattgaaaaacagagaagttatggaaatacttttgagcaatcatcctgaattcctttagaggaaaagcaggttttagggtcacagcaatagtccaatcccaatcttctcacattctattttccagcaaccattgatgtgaaacggaacatctttgacctgtgtacagacaccaaagactgctatcttgctgtcattga

SEQ ID NO: 105905 - DNA, 1059 bp, Homo sapiens
tggctaatttttttgtatttttgtagagacggcatttccccaacgttgcccaggctggtctcgaactcctgggctcaagtgatccacttttcttggtgtcccaaaatgttggcattgcaggcatgagtcactgtccccagctgatagtatttacagccatgaacttatatgagatcatcaaggggactagagaagagttgtgggtatagaaccctggcatgtgtttaggagttgccaaatgaggaacttgggaaggaaatcaaatataatggccagtaaggcagaatggaaccccgagaaaaagaggtgcctggccgggtgcggtggctcacgcctgtaatcccagcactttgggaggcagtattctgtggtaatcattgatccatgtggagaatttgtgtgttaattttagaaactgctttgcacattttctctttaatttgtcagtggatggattggtctgatttttctcttcccatcccttcttctctaaagatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagattgtatcctttatactcatgtcttaccttccatttgttgtctggtttgtggtgcagaaataatttgttctatctttataccaatacctggttaaagtgtccacactggtaataatatggtgcctgtcctttggtttgaaatgttagtgaaatctccaaagcactgttgccaatgttagtaattactgacaactttcactagcatgttttctatgtatttggtaagagtgaccagtttcctacctcccagttctccaagaattgaattagcttttatctgtcttcagaaggattttacttttgctctgtaaaaaatcagttgccacataagag

SEQ ID NO: 105906 - DNA, 2231 bp, Homo sapiens
ttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcaggtaagaagaggccccttcttactccctgggaattggaatgattcttttatttaaatcaaactgggcagtatcagcatagttgtcctgaaataccactgattgttactttgtgtaatacttgaacaatgtaattgtaccaccttttgtcaaccatgggttccttgtgtgattgttggcagtatattgatataatcgtttgtgttctcatctcaactagtatgttttctagaacccacaccccctcattactactgtccataaggaggctcccaaacttgtgctggtgcaagttgcttcctgttctgattcttgacaaatcttacataaaggttacgggatcacaggttttaaacatgggaattttttttttttttggagacggagtctctctatcgcccaggctggagtacagtggtgctatcttggctcactgcaacctctgcctcctaggttcgagtgattctcctgcctcagcctcctgagtagctgggattacaggcaggcaccaccatatctagctaatttttgcatttttagtagagatggggttttaccatgttggccaggctggtcttgaattcctgacctcaattgatacccccccttcggcctcccaaagtgctaggattataggcatgagccactgtgtctggcctaaacatgggaatttttgttatttaaatttgtaagtggaaatctttttcttatttaaaataaaaagcactgaaggtcactgtgattttggaagaagccatttgaaacattaatgttctgtgctttttcttctatcctagcagtttgctttttctgagtccctgcacattctttgcctgtgattctctcttttttttgcttagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggtaagggttccttcctaggatgctctcagtcattcttccaagatgaattggtgaactagagtaaaggaggcttaccctttattgagctctctcttttaaatgagtcctcaactggaaagtctagttgaggttaattcatatttcagatggagactgaggaatatggcaaagttagtaggaagaaaggaaccatctttgacatcttctcattttcccccctcccttttatctattctatttttgtggctagttcagtaggatttaatattctcttaagtttggttattttataggacactataggtgtatgtattcaaatcctagtggcttctgaccatttcttggtttctg

SEQ ID NO: 105907 - DNA, 1103 bp, Homo sapiens
ataaaagattaagcaatctatggtcattacttcacatatgggcttttgactcaagaattgtggaatttgaaaggtattattatttaatttataattaaaaccttggccaagcatggtggctcatgcctgtaattccagcacttgaggaggctgaggtgggaggatcgcttgagtctaggagttcagggctgcagtgagctatgatcatgccactgcactccagcatgggcaacaaaatgagaccctgtctctacaaaaaataaaataattagctgggtgtggtggcatgtgcctgtggttctagctacttgggatgctgagacaggagggcagcttgagcctgggagattgaggctacagtgagccgtgatcaagccactgccctccagcctgggcagcaaagtgagaccctgtcttgaaataagtaaataaaataaaatctcttggccagtgagctgtgctcaaggaggtagtaggcagatgtagagttatatataataataatactatatatctctccttataggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggtgggaccagagagagatttcaaatgaagtttgatgcatctttttgttaaagttgatgttggtttgcacattgtatatgcttaacaaacatttgttgaattgaattgaaattttggacttgaatctgagaaattagattaggcatgaaaatatgatttttaatttacagcacacttgttcatatatatggtcttggtgattgtaaaatttgcataataggcaaggattagcctctgtactgtcggagaaggtacatgatttacacggccacagctgcagagctggggttaaagtcttgtcttgagcctggagtccaggattctttagtacttaaagtgtcttgctactacttgacaaccatatataatgtttatattacgttcatataaaattgtccttttactctt

SEQ ID NO: 105908 - DNA, 1061 bp, Homo sapiens
tcaaaatgtgtgtgaattaaccagagaatgaataccaaactcctagacttaggatcagaaatctgagccacttttatcacattggagaagttccttacctcttcctcttcttttaagtgagaatcctaatacctgtataatggagccctcgtgagcattaaatgatgtaaatatttgttggcactcagtaagtataggttgtatttaaatatttatctaaatttaggtcgttttcaggtttggaatggatcgtgttctaaaattgcctttgtattattacctaaactttgtactaagagtgacttgattggagatggtcattgtattctgcagatatctatactggcaaattttccatcctgttcaagggctcctttgcccacaatttaaaagcattgttttatttgtatttttttgcaggtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttggtgaggttctttcagtgcttttctccctaggattgagggtcctggttgtcttggctgccctttaacggcacacccttgaagaaaggaagcttctgattagaggagttttgctgccattctttttgtgaagttttttttttttccctttcttcacaaatttctctttttctttagtagttagaggacactgtgccgttgtagacttgccttggatatagtaatcttataacggggattggcagttgatgatcttgatctttgtaaaagcaatagttttattcctgtacattttttaatatgattaaaagcttgttcattttttggtatgagtttaatgttttgctttcatatagctactgttagcatgctatatacatagatatacataaatatgcgttgatatttgtcagtcttgttaagcataaaagtttactgatacataagcagaatatgtatggaaa

SEQ ID NO: 105909 - DNA, 1050 bp, Homo sapiens
agaaggttctgatatgtggggctaaattaaacactactttgatggagcacctctcagaacgttaatatattacctgtgctttgtgagcttctgtgagagatactttcagtgatccccagttgatcatggagccttttgggagttaacatctagattaggactatattctggggattgttaatttttagcttgagttttgtttattttttaattatttttttctgactgcaaagacctaaaagagatagcttgagttttattggctgaataggcttctattgcacagatactttatataactaaggaacctattggatgctgtagtagtactttttttactcttacgaacattgaaatattaaaatttttttcatgagactgaaatctttgcttattgttaatcatgaacttgggctttttccgaaatgtactatttaatttcctttactataggagggaattgtcgagaatcttttcaaatgggcccgagaggccgatcaaccattgaggacatattctactggactgttaggaggtgctatggaaaatcaagacattgctgccaactatagagatgaaaattcacagctggtaaggactgtgttagaataaatttttatataaaatgggagagtattcacaggttcttgttacttgaatctgaataagtagatcatattgattatcttgtactggagcatggctataatttcaatattagtttccataagagtttttaaaaattgaaaatagctttttttttttttgagacggagtcttgctttgttgcccgggttggagtgcagtgatgcaatcttggctcattgcaacctctgcctcccgggttcaagcaattctcctgcctcagcctcctgagtagctggggttacaggttcccactactatgcccagctaattttttgtatttttagtagagacagggtttcaccatgttggtcgggctggtctcgaactcctgacctcatgatccacctgcctaggcctcccaaagtgctgggattacaagcgtgagccaccgtgtctggcaga

SEQ ID NO: 105910 - DNA, 1032 bp, Homo sapiens
tttatataagaatgagtttgggggccaggtgtggtggctcacgtctgtcatcccagcactttgggaggctgaggcgggtggatcacgaggtcaggagatcgagaccatcctggctagcatggtgaaaccccgtctctactaaaagtacagaaagttagccgggcgtggtggtgggtgcctgcagtcccagctgtgcgggatactgaggcaggagaatggcatgaacccaggaggtagagcttgcagtgagccaagatcacaccactgcactccagcctgggcgacagagcgagactgtcaaaaaaaaaaaaaaaagaatgagtttgggagaggaaactcttttatgagataattgtgtagatttctatgtacatcagaagaaatagtctttttctaactttgcttttattttctaccttgaccgttgaattgactgttgtagtggtggtccatttttttatgcttgtccagagttgaccccttgtttcctttgtgctaggatgtctcaattgattgaaaaagaaactgaagagtatcgtaaaggggatccagacccatttgatgatcgacatcctggtaagatttgtgctcttaagtgtgggtcttttttttttcttttaagacacttttattaaagcgagggtcttttttttcttttctaaaaaagaaaaattgcttatgggaaaatttttgaattgaaatagcgtcttttgtggtaagttttaagaccttttatttgttaaaatgttgctcaaggtggagctagtgaggaaaaataaatttctggaaaaaattggaaatatttttgatatttgccaatcgaatatcacataactaacctaaaggaacagaagtaggtgtactttagttaactcagttgatatgatgacaaagaattaaaaagaaaaattgtcttcctttcagactttttcttttttggagatgggtactcactctgttgcccaggttgcagtgcagtggcatgatcatagctcactgcagcctggatctcctggctcaaacgatcctccc

SEQ ID NO: 105911 - DNA, 1054 bp, Homo sapiens
aagatggagccccgcaagcccgtacggaacagagactaggaggattggaaggaaaaagaaaacaagggaaatgaaatgcgcccctcctccaggtaggggcggacacaccccgcccccccactccgggcggaagagttactctcgggaagcttctcgtggggagtggaggaagaacgtggaggccccgcccccaggacaagaatcaggaggaggaaaagtcctgtcaggccccgggcccagcctcccggcagaccggcccgccccctcctcgccggcggcccaagcaggtgccgcccctcccccaagcccggcgcccactctgccgcccggccagccgcgcgacctgcttcctcgcgcccctcccgtagagtcgcctccctccatttcccactcaccgtccgaggcggctccgccgctgcccccccccgaccccgccagtggccacagttcacacacacacagcctcaggtcccgcactcactctccactcacacacacacacagcgcgaccacggctccacagcggcccacatattatgcgtcactcgcgcgctacgtgcaccgcgcgcgcgcgctcgcgcctacttggcgcgaggaccgcgagcaaggggcgggaagagaacgcctgcacgatcggggaaaaaaaaaaaaaaaaaaaaaaaaaaaaaaaaaaaatcgaagagccccggggacgcctgggaaatgaagttccgcgtctaggggcgggcccaccagtcccaattgacgcatgagctcttcgcctggcgcattgacttctggatttgtagtttttttggataaatgcgaactgctgagtactcattggctgcttcggaaggcggaagtgaaaagtgagggagccaatccttctaagacagtactgtaatcgcctgatactttttcagtgtcttgttctgacctgtgtgcgcaaagagcctctgttttatttggccatttgccttatcttacctagaacataccgtgatctaagaaaatatttctcataaacatatcagaaatcacagcactcattaaatcagaaggcactggttgt

SEQ ID NO: 105912 - DNA, 1866 bp, Homo sapiens
ctccccgaccccctctcctgaggtctgggaatttggcagactggggtcgggctggggcagaagaggcattgagagtttagcttccctgaggtaactggtgattagttcctggaaaggcaggagctcagctgggcacaagagagttaagcagagagctggatcctccggggccctgatgcaccctgacgaggagtggttttcaggcaaggaacttatcacaggagtgagtagtggcacacggtgagtagtgctagctgtcttgtcgttagggtgaggccggtgggagttgtggtttggggagtgtagaggagggttgataggctactgagattggagaatcagctttatgtgggtcatggtggtggcagcctgggagatgaacaaggaaactttgcagagtgggcttcctgatggagagtgacctcttactgcgtgggagtgggtgactcagatctgttaggattcctgttgcttgctagggattgtggctgactatattggtggctgaacattgaggtggatgcaactggaagggttatgtggggctggatgagtttgttcccacgtagaggacagtgtggacctttcttactccaagtcagagtggtgactgtcattgacaacattttaagtaaggaatttctttgtggtatttggatccaaagcttttctctgttcatttttttctttcctccgttgtttttgaattgtgactcatactttcttttcagcactgtggctatttgaaatgatagacaaacttagacttcatcatacatgtaagttccaggcgttttcagtccaattcttataaatctaaatttaaaagcttcttttcactaatttgtgtaccattgtttaatgtgtgcaacactaaagaaggataagaaaactctaacatttatgttgttaaatggtctttccatccttaaatccatgaaatttcatcttctcttactgccatgaagtgagttcgttgaatctattaaatcttagtgactctcatttcagcatccttgtttactctcacaggacattgtcttcactagaagtattatccatcttcaatgaatttggcctgtacactgtctccctgtgacaatctatatcattgaaagacagtacgcaaactccaactctgaggcctgcagctgtgggccggagctctgtatgtattattcaggcaaaagttggtgtgttgtctgtaggtgaggtttaaagggaaccctacatgaacaaaaacagtatcagaatcattgtaccttctgagtttagagtggtaggaaatatagcctaactggagtctagtataaactttcaagtgcaatgttaggtaattctgtttgtagttgtactgatagttctcattattgtaaacattatctttttccttaagctttaaataattatttttcttcaatggtattctttctttcttggctgggtgtggtggctaacgcctgtaatcccaacactttgggaggtcgaggcgggcatatcacatgaggtcaggagattgagcctgcatggcgaaaccctgtctctactaaaactacaaaaattagccggtggggtggcatgtgcctgtagtcccagctactctggaggcagagggacaagaatcacttgaatctgggaggcagaggttacaatgagccgagatcgtgccactgcactccagcctcagcgacaaagcgagactctgactcaaaaaaaaaaaaaaaaaaaaaaagtagtattctttctctttctccattcattctttcataaacgaacatttattgcattttgccaggcactgctttgggcacctcaaaaatgctgatgatattttttaacattttgttagtggtagttcctggttta

SEQ ID NO: 105913 - DNA, 1048 bp, Homo sapiens
gagtaaatgtgacagttcttcattggtattgtctgatcttctgcaggccatttactgctctgagtgctttgtcttcatatgtaaagaagtgattagttggtttgggccacagggtatctagacaactaactactgataagccaccacctgctgggaatgggtaatgacttgattgattgattggagatggagtcttgctctgtcacccaggctggagtgcaatggcacgatcttggctcactgcctcaacctcaacctcctcggttcaagctattctcctgcctcagcctcacaagtaactgggactataggtgcgccaccatgcctggctaatttttgtatttttagtacaaaatttctccatgttggccaggctggtcttgaacttctgacctcaagtgatctgcccatcttggcctcccaaaatgctgggattataggcatgaaccactgcgcctggcctgggaatgggtaatggatttaacactaggatattgtgaattttgctgcctggttggccttttggagacccatctgagctcagtgtcaccatatacaggaaataacgattatttgagcaaactttattcaggagttagaattcagtgactataaaattatctgtatccgttttctgctcagtctaatactgtactaattctgaagtgtctggagctgtatgttctgagttatttacctagaagttacagaattgtgccaatttatttagttaccctcctggatcttttttgttgttgttgttttgtttttgagacggagtcttgctctgtcgcccaggctggagtgcagtggtgtgatctcagctcactgcaacctctgcctcccgggttcaagtgattctcctgcctcagcctcctgagcagctgggattacaggcgcgtgccaccacgcctggctagtttttgtatttttagtagagtcagggttttaccatgttggtcagtctgatcttgaactcgtgaccttgtgatccacctgcctctgcttcccaaagtgctgggattacaggcgtgagccatgatgcctg

SEQ ID NO: 105914 - DNA, 1158 bp, Homo sapiens
aaggaaggcatgtgttttaataaagccttttcagattgtgtatattctttggtactatgccaaaactctgataagtggtagcttctttttttttatttttttttttttgagtctcgctcttcttgcccagactagagtgcaatggcctgatcttggctcaccacaacctccacctcccgggttcaagcaattatcctgcctcagcctcccaagtagctgggattccagacatgtgccaccacgcccagctaattttttttttttttttttttagtagagacgggatttctccatgttagtcaggctgatcttgaactcccgacctcaggtgatctgcccgcctcggcctcccaaagtgctgggattacaggcatgagccaccacgcccggccgacaagtggtagcttcttaaaggttaattgtaatacagagtttgaaaaagttacctcgaggaatttttttgtactttattaacataaaaatccattttttatcttgcactttgaatggctttttttttttttttaaactggggtagcctcttgagccatggtgggctcagagactccctgaatggctctttaaaccataattttgacattgtggttccattgaaagggtcttggggactcccaggggttcccagaccacactttgagaattgctgttttagaatctggaagagatcttgaagattaactcaggcccatttctcccctgggttggaataagaggagtgattgaagctgagggaggactgacttgcccaaagtcatttagctagttattcatagagctgtggctggaattaggtttcttgactgattctgtaaacatgtctttagtgctatgctaggttctgattccctgggccaggctacattgtgctatcttttggaggtagttgtctcctgtggagagagttgtcttctgtggccctggtccttcgagtcttgaatgcatttgttcaccttttgtttcttattttctcttaagtttcaaattgccaaaatcatcattatatttccaagtaaaatgttgagctgttgtgtcagtttagctctgtggctgctttgtgtgtatctaaattttctttatgtaactgatagacactcaaaaggcattgggctacatggaggtttgaagtatgcattgggt

SEQ ID NO: 105915 - DNA, 2441 bp, Homo sapiens
gaaggtggtgatttggatacggttagcttgccttgcttagagaagttccggggaattcatgttcagcatttttttctttgtttttcttttggagagagtctcacctcgtcgctcaggctggaatgcagtggcgccatcttggctcactgcaacctctgcctccccggttcaagcaattctcatgcctcagccacctgagtagctgggattacaggtgtgtgccaccatgcctgactaacttttgtatttttagtagagatgggttttcaccatgttggccaggctggtctcgaactcctgacctcaagtgatccacccaccttgacctcccaaagtgctgggattacaggcatgagccactgtgcccagctagcatttttttctttgaaagacttgtgttcctaagcaaaacccttggtgattctgatgcctttcatcctctcctagcacccctgcagtggaccatgagtcggtaatgcccactgaggacctctgggagccatgtcagacgaatctgcctcagggagcgatccagacctggacccggacgtggagctggaggatgcggaagaggaggaggaggaggaggaggtggcagtggaggagtgtgacagggatgatgaagaagacctgctggatggtaagtgggctctattgagtgacagaagttgccttatattttcctccagtggaatttttgctgggagaccttggcgtttccagttagatttcttaggccatccatagtgggaagatacagactaggaactgagatgcaatgaattcagatgctcattcctaggaaatagattattgttcctccacataagctttgttttactgctggaagaacctttagcctttagcttgtctctgacagatgtttggactcaggtccagagattcgagtgttgcatacttgcccaggtcatggaggagtcaatggcagagttcctatggtaagactttgcagtctggaggccatgggctcttcaggtagatgtgagggtaactgtgagtggtctgtaagttttctgaaattatacatacaattgtgcttgtgtgtacatgagggaattgtccaggcagagattcttagacagattcacaacttcagaaagctcactgcatctcctgcagtgctgcgctacctcttggccattccagtgactataaattgcccctactgggagggcactacatctccatagctggtagatccccttttgatgccttctatttggtttgctcagctcactccttcctttgccctcagcttcttgaaatggcattgaacttttaatgttcagtctaatgttaggttatttggccagccacaaggcttctcaattaattccagccttttatggcataggatttagttgtttgtaagcttcctactgactgaggaatagggtttttgtctgttcataacagaccccctagtgggactgaacgttgcattagatcatctaattacttgaatctgaaggaacgtaggaaaatgtactcctgccgttctccagattccaggaggatgagcactgatcctctgtctttactggtgtttactatcttcagttctcattcatcctaacagctgtcatgtggcttgggaatccgtttgccctcctttatactgtccagaagcctctctccatttctgcggggaaatgaccattcacttttatccctccagtagcatttgctgtctgttgctagcttattcagttggagtctcatttctagaaagtagaatgaatagaaataatggaagacagtaatgtttgcttggctctcattgttcctgagatgctgttagagtccctaggtgtcagcatcactttttgcttttcatcattgggttctcataattgtatttacagacacccttagaactcccatcaggtttagattggattttagatgcttctggtgagtgtaatggatatatacacactatcttccctgttggcttcttggaattctcttttcccttttccttgtaaaattgttaattattcaaaaattatatgatatgcttctgcggactttactattatttatttagaaatgacaagaatttaattgtgatttgtctcagaataatgtagctgtgcaatttggttttggtgtttttttttttttttttttttttttttttgagatggagttttgctcgttgcccaggctggagtggaatggcgccatcttggctcactgcaaccttcacctcctggttcaagcgattctcctgcctcagcctcctgagtagctgggattacatgtgcctgccaccatgcctggctaattttgtatttttagtagagacgggatttctctatgttggttaggctgttctcgaactcctaacctcaggtgatctgcccgccttggcctcccaaagtgctggggattacaggggtgagccaccatgcccg

SEQ ID NO: 105916 - DNA, 1082 bp, Homo sapiens
tatcatataatttttgaataattaacaattttacaaggaaaagggaaaagagaattccaagaagccaacagggaagatagtgtgtatatatccattacactcaccagaagcatctaaaatccaatctaaacctgatgggagttctaagggtgtctgtaaatacaattatgagaacccaatgatgaaaagcaaaaagtgatgctgacacctagggactctaacagcatctcaggaacaatgagagccaagcaaacattactgtcttccattatttctattcattctactttctagaaatgagactccaactgaataagctagcaacagacagcaaatgctactggagggataaaagtgaatggtcatttccccgcagaaatggagagaggcttctggacagtataaaggagggcaaacggattcccaagccacatgacagctgttaggatgaatgagaactgaagatagtaaacaccagtaaagacagaggatcagtgctcatcctcctggaatctggagaacggcaggagtacattttcctacgttccttcagattcaagtaattagatgatctaatgcaacgttcagtcccactagggggtctgttatgaacagacaaaaaccctattcctcagtcagtaggaagcttacaaacaactaaatcctatgccataaaaggctggaattaattgagaagccttgtggctggccaaataacctaacattagactgaacattaaaagttcaatgccatttcaagaagctgagggcaaaggaaggagtgagctgagcaaaccaaatagaaggcatcaaaaggggatctaccagctatggagatgtagtgccctcccagtaggggcaatttatagtcactggaatggccaagaggtagcgcagcactgcaggagatgcagtgagctttctgaagttgtgaatctgtctaagaatctctgcctggacaattccctcatgtacacacaagcacaattgtatgtataatttcagaaaacttacagaccactcacagttaccctcacatctacctgaagagcccatggcctccagactgcaaagtcttacca

SEQ ID NO: 105917 - DNA, 1057 bp, Homo sapiens
agcactttgggaggccgaggcaggtggatcacttgaagttgggagtttgagatcagcctggccaacaaggtgaaaccccgcctctactaaaaaatacaaagattagctgaacatggtggtaggtacctgtaatcctagctacttgggagactgaggcgggagaattgcttgaacctgggagtggaggttgcagtgagccaagattgtgctgttacactctggcttgggtgacagaaggagactctgcctcaaaataaataaataaataaataatagggaatctccaagcctactgtggcttggaaggctgcctgaaaaataaacaaatgaataaataaataatttttggggtagaggtggggtcttgctctgttgcccaggctagtcttgaactcctggccttaacttgtactcccacctcagccttccaagtgatggaattacagatgtgagccactgcacctgagggaagtaagtgggctagccaggtggttgtctagggaaaaaatattgtaggcaagtggaatagcaagagctgttggagagtttgggcagaggagtgacacaatctgacttttaaaagcttattctggctgatatggaggtaattgcctgtatgggggataagggataaagtagggaaaccagctaggaagataatgcagaaatctaagtaagaggcgatgatagcttggtggaggtggtgaaagtagttggattcaggatatgttttgaagatagagctaataggatttgttggtcaaatggatatagattgtatgagagaaattaaggatgaattccatggtatttggactgataaactggaagatgccattttctgagcttgggaagattgtgggggaggtacagatggggagcagataggagtttggttttggaatccatcgtttaggtttgtaatccatctggaattgatttttgtatgatgtgagataggggtcaaggttcatccccctctgccccagtatggttatctaatttatctaggactttgcattgcatttttattgtaccctttgttgtaaaccaaggt

SEQ ID NO: 105918 - DNA, 1046 bp, Homo sapiens
agttacattattttgcttaggttgtgaattcacttgattcagtgttcagaaggtaaaaaaaaaacaacacagtgaaaagttacattttgactgaaggaaatttaattatagaatttttgaaataacagattttttattaagaatagtttattaaaggtatagcatctattataatgttatgtaaaaaccataatcatcatgaaacagcaaaaatgaagcacttgaaagacatgtatttacatgacaatgaactttaaatattagcacatctgtaaactaaattcctttaataagctaaaagtagttgttgaacccagaagctgaggattcattcaaagaatgctgggtggtaaggaactggtttagacatgtatcatctgtataaggcatgagaattaaatatactgtgcctgatgattttaaaattgttactgcacttggccacattcagcctcatgtcagacaggagttcacagtgggccacaagccttataacttgggatgaatgtttgataataaatctgttggtgatattgaaaggtcagcaggttccattctttctcctcccgggaacagcccattccacaaggcagaagccagaacaaggaaatacagcagttggcaaaaagttcccccctgcccagcagatcaatttcaaaccctctggacttgccctctgttctctgactctgtcctatctgcctactctctaatcttgcctccaactgttcctccaagtgattgctcaataaatttgcttgtgaaatagaaacaaaacaaaaaagaccaggagagcatcagaggtcattatcagaatcaggccagaggacccagcaaaacactaagttgaagtgtgccaacccagcctcaagtgtagtcggtatgttgtaggccaagttgcagtattggtggaagtagtcatttagcagtagatatcctctcttggggagtctgctgcccagccaactgtttgggatgaggaatttgatggcctccccttttaggagggaagaattcagggctgtgaagtaggaagaagttgacag

SEQ ID NO: 105919 - DNA, 1359 bp, Homo sapiens
gagactctatctcaaaaaaataaaaataaaaataaaaataattgtggcctctcaggaatcctttaaagtcattcagcttcttgagagcacacaatcagaagaagatcatttaaaaagctaaaatgaataaaaatgtactctttaaataggttttatctagatttttcctcataactttggattttaacttaccaaaggattgggaccttttctggtggtcaggtggatagcaggaaggaaaaaccagtagagaaagggaatttggaaggagggctgaggtttttgagatgggctctgcttctcttctcagtggatactccccatgagagctataaaagaaaaggggtggtgaattgttttgggaaatatgttagagccaaatgtggtcttgacaccgttcccttccattttgcttttcctagaggaaattgctttaagggcaagtgacggtccccaactgcctcctcgggtcttggcccaggaagtcatttgtttggacagtagcagtggcagtgaggatgaaaaaagcagtcgagatggtaagatcaaaccaggtgcctccctttcttccgacctggtgttcatgctgagatcggctatactttgaaaagagtccagtccttcctccttcaatttgggatgtggctttgactaatttccctgtgtctccttggtaaatataagttttttgcttgtcttaacttgaagctgaaagagagaaatagtaaaagtcaaaattttaataagtgttgacaagttctaactttaagtttctgtagtcttctgctctgactgtgtgcagtaaattatcttcactccctggatttttggttttgcttttttttgctgtctcagaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcaggtacagcaaaccttgactgttttctccttttcctttttgtttccttgttgtgaacattgcctgctggtggttattagcgtcacagcctgtgaagtacttgtttggtaccaagagcagcttgttcagctgttggaaagacctgatacttccttctagcagttgatgtttcaggattcctgatgaataggaagggacagggaaagggaagagacaagcttcaggtttgccctactccgtagaaagcactggatctcttgacctaataatttgagcctct

SEQ ID NO: 105920 - DNA, 1054 bp, Homo sapiens
acccgggaggcagaggttgcagtgagttgagatagcaccactgcactccagcctgggtgacagagccagactctgtctcaaaaacaacaacaaaaacaaactactcctatggaatgggctgccttaagagggtgagctttccaatgctgagggaagccaagctgactgaaagatcctgtcaggaatttgacactaccgattcatgcattacatggggtgttacactgtactagtgaatccttttctgttttttccaagaggactgtcaccagcaaatagatcagtcaaggtacagggaatcttctatggccatccacacctgctatctattataacgccttctcacttacttaattcttactaattacaaagtgagtaaaaactggagccctcatctttgtgagcccctctgacatttgtctttgtcccttgtcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggtaagagtttttgggaaggcaccacttaagtcactcctgaagagctctgtgttaatgcctttactgggcaccaaaaagcttgatgagctcagctctgagtttgttccataaaactctctttttggacttggctttctaataggttaatactcttcagaattggctggcagagttcaacatgtggcttccacctcctgaagccctcccggctgacaacaagcctgaagaagtccagcctcggttctttaaagttcacatcttgaatgatgagcacaagtaggtggcctgccctttcctctctgcccctttccttttagacttctgtccgtgatctgatgttaaggcagtctctttgagtgtgtagcctgtgcatctagatttgtttttggtttcctgatgtatcactttctctgttcttgctactcatttttttct

SEQ ID NO: 105921 - DNA, 1028 bp, Homo sapiens
tctgctgacttaccttaggctagtctaaagcagacccctcatttttccttgttgagatggcatatggagcgaaagctcagagaggcagcccaaattaaagtaagaacctcaagttcccctgtctctgtcatgcagtcagacttgacctgggacaggtcactctgcctcttagtgttagttttcatccttaaggtgagtttcttcttggttgttgaaccactctgcattattgcaaggctgcagtgcatgttgagatcctcaagagggaggtgtggcaggagtgcaaaaggctctgtttttatcttgtgctgacccctcctggccacactaccttgccgtttctgttctgtttgcctccataggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaaggtgcattggggcctcagggaagattgagatggggactaaggatacacatggtcccaagggagttactcctactgagagtcttcaataaagggagaataaagtgagagggggccacctcagttcactgcactggaggtttgggggctccaaggagagaggtgatggttttgtaccacataactcctgggggtgccattcacacagtgtaatataactgatgccccctgcagtgtgcaactcagctgcacaacttgttattccaaggggattaatggaaaaatactgtggggcagcgtttttgactgctagcataatcagaattcaagagatatatagcttagacaagttattaggggtaccttccattggattccatacttaatcagattgagacctctctcattcttttcttgagggacctgtttcattgacttcatacctctacccctggctactcttcagcagacctgttaggtattattcttaat

SEQ ID NO: 105922 - DNA, 1009 bp, Homo sapiens
ctgactttaatttttggtgtgacagtgtttattgtgggacgtgtgtgtttgagcaagtatgtgtttccagactccctgggacacccttggaatgttttttgtcctgtgtctcctctccctttccttgaacctcagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggtgagtcaagcagatccttcaggaaccataaactattgctgagaagggatggtgcaagccctgcctggggaaggggtagggatgcatggctagggtctctgtatggaattataaaggtggccagtgagctgctgccttggaaggaaataattttatttctagtgatctggccttggacctgctctaagctgccttgtttctctcttgcaggccaaggaccttctgactaattaccagactggagtcctagaaaactctcccaagatggtactgcttttccacctgattgaggaaagtgtgaagcttggggacaagatccttgtgtttaggtaggatgagaaacttccatttgaggctgtgtgtctatggtaaagaatgacaaaaccaccacagagcaagaccaagaccacccccgcctcccccaagtgctattgtgaggaccttcttgcatgttgtctgtctcttggagtttctttcattgcccaatttgatttctccacagagaacaatttagaaccctaggttagcactggagtctaatctttcaaattctggcctgtttttgtttactttgagagctaaggatagtttttacatttttaaaaggttataaaaaacatac

SEQ ID NO: 105923 - DNA, 1022 bp, Homo sapiens
gttaaaaatgcagattcctggtggaggaacatcatccatatcaaaacccttagtcctgcactcaccaggactcacaaggctgaggcagagaggtcaccttgagccagtattttccaaattccctaggtgattactatacattccgaagtctaggattcttggctttagaattgacctaagatagtaaaggggagaaatgtagtttataatccatggtgcatgtgagaatcacctgggggtattttcaaattatagatgcctgggccttacttactgtagacccatgatacgtccaaggggtgagatctgagcactgttgtatttctatttgttttgctctttaaaacatatttgcccagtgattttgctgtatatccttgctctaatatatccactgcttatggttttccttccttcctagggctagatggtagcacccctgcctttgagagggagcggcttattaatcagttcaatgatcccagcaacctcaccacctggctgttccttctctctacaaggtgagtggatcccaagaggggaggtcaaaggaatctgttcaggcagttggccacctgggctggtaccccaaaactccaagttccctcagaagagatcagctcaggtttgtaacttgtttctggggtcagagagggaacttcaaaaggaaattaggttagcagggcagtcatgatagtatcataaaattttttgagaccttcattaacaatggttgtggctcatgcctgtaaccccagcactttgggaggccaaggtgggaggattgcttgaacccaggggttcaagatactgagaccttgtctgtacaaaaaatcaaacaattagctgagtgtggtggcatgcacctgtggtcccagctacttgggaggcagaggcgggaggatggcttgagtctgagaggtcgaagctgcagtgagctgtgattgagccactgcaatccagcctaagcgacagagtgagaccctgtctcatttaaaaacaaacaaacaaatgaacaacaa

SEQ ID NO: 105924 - DNA, 1017 bp, Homo sapiens
tgaggcttagatgatgtgatgaatatgaaagtgctttaaaaagtagaaagtgcaaggtgactgtaaaaggctgatggtattgtctcatgccaagcagcttgaaggctgtgctgccttctgccatcgtaatgcccttggcaggatgtaagccagtcattcccctaagctgttagactaaaaatagtggaaacatctgtgtgcagaagtttcccctcaccaaggaacatccctccaaggccaggatgcgggggccttacttgttacagaggagagtgagttttgtttctgagctggtagacactttcatgttggatttcagggcacaattttcagtgcttgaggaatgtactgtttatcagcaggacagcaaaatccttgagtatgttgtacttagggcttaggacagagtaatattggggtagaagtcacagagggcaaaactgatttgaaaaccttttttaagactaaaggctctgtgattgttggcttgtcttttaaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcaggtgggccatcttccagacttcggagaggcacatctatacaggctaccatccttttagtatcaagggtgggagaggagcaggatatgggaacacaggcaggcttcgagaaagccagcatttcctcctatctcattctgattcaaattgcttaaaaggtaattgacctcaacttgttgaaggtgagtttaatgataacagccaagctcgttatacaagttttccccttatatgatgtttccagtgtcaccagcacctcagacctagtctttgactttcagatatgggatgacttttcattattagtgaccttt

SEQ ID NO: 105925 - DNA, 1077 bp, Homo sapiens
aaaaactatgaatttctaattaaataaagggaaattgattgcaacgatgaccagctcagatttctgacaaagttcctgttttcatagtattctttgtttagataattgtgaaagatcctgcttgcttcaccttccttggttctggacctctgccccactgagaggctgtagggaaaccaatgaagaactggggtagatgtgggactttgcaattttcccccctccttcagtcaggccccgtgcaatctaaatttaagatctgtgtttttcctagatattgttattcctggactcaacagctccacagatgtacaggcaagaattaatgctggtgagagcatccacatcatccgtgggacaaaaggtaagagcctgaccaaggacctgttccctgcctttggttgagagtgctgggctgggaagaagaataaatacatatgacttgagctagacgggtcataggaatcatcccattaggatgtcacattccggaactgaatgagaaaatagcatttgtaggagcttaggggagttgggttgagcccatagggtattagtcagtggtttaaaagaaggaaattagggtccctacatttctctatcttgctgtctttttttttttttttttttttttttttgagatggagtcttgctctgtcgccaggctggagtgcagttgcgtgatctcggctcactgcaacctccacctcccaggttcaagcaattcttcagcctcagcctcccaagtagctgggactacaggcatgcgccaccacgcacagctgatttttgtactttttttttttttagtagagatggggtttcattatgttggccaggatggtctcgatttcttgacctcatgatccgcccacctgggcctcccaacgtgccgggattacaggcgtgagccaccgtacccggcccttactgtcatttttatgagaatcttgggatgggacaagtagacacaaggagaccaaaattggagggaaagagcggtggaatgggttataagcctacatacatttacccacttgcttggagcagggtgggggtcccctgataggatatgta

SEQ ID NO: 105926 - DNA, 1023 bp, Homo sapiens
ctttcagcttggtgggcaacctgctgggggccccaagtgaggtggggaggggctccctagctatttcccagtgacctctatcacatcatcgtctttatcctcatcatcattggagctgaacccaacctcggcaacctcatgagagtcaaatggaggcacctgggaccgtaggaggccaccagctgggtagcctgcatgtggggacatgtagcctggatagatagacatgccccgcgaaaggttgctgggcaagacaggggaaggaaaaggcgcaaacatcctcggctcggacaggagtggctgtgagaatgggagtgaatagctgggtagtatccctggcacagaagggttgagcatgaaggaggggttgctggcagtgactgaggtagccgtggaagaggaactgacggggcctgctggcaccagagggtcagtagtcactggaaacaccaggcgggcatctgccagcaaattggacagctggtagtaggagggggtactgcccataaacagggagttctccccagcctgggaggtgaagggggtggtgaggttatggtttaaggagacgggtggcatggcaaacccgccagagactggatacccgtgttcatacggctgcacgggggctggcagatgacccttcctggaccgccggcgggatgactcctgggcagcaggtggtgtggccaactttcgcttgtggccccttaagtccagcactgggtgcctgtcaccacagggctggccagtcaccaagagggaactattgaggcaatgaccccctagtcgaggctcagttccgagagctgtcccgggaacagcactgctgtccataagttgggccggggggccaggcagggcggcattggtgcttggggagctctgacgggattcccgggcagcagccacatctgcatactgctgaagctcactgatgatctctgggctgtcaggagagacgggcctggccagcccctcagggtcgggggctttgggtgatgaggcactgtgtctgccgtt

SEQ ID NO: 105927 - DNA, 2438 bp, Homo sapiens
aggcggttgctgggttgagggactgttgatttcatgttcgaaaatatcttcaggtggtccatgtaggcctggtgtctgctgcctccatctttgaaggaacatggaggagccctttctctgtaggagccctaagtctgggttttatcttaaaagaacacaccagtcattctgggtctccccttattgccattgccaggggagggtcgtctagtccttaagcataaacactggctgtcttcctactggtgtccccgccccctctgtatcccccaccccaacactttgccagacagttctttatgatgaacaaactttggctttagagctttaccacttacccatggctccctccttactgggcaggtggtgtacctgcctcttcccagcccagaaggcagcttagtcaggtcatcccagtagtagctcctacagctcttctgaccagcccatttccatctttggagggccttagcagactctggggtattgtcctcagagaagagacaaggagatgatggatggggtgcatgtgtatatgtgtgtttgtctgctgtccaataacaccaaaagtggaacttaagaagctttgtgttttcataagcaccctgccagacacttaactcttctactcatggaagccttagatctacaatttagctatgcaaattattttaataatttaaaaatagcagttccaaccagtgctttctctttcagatgcatcccaagaatggatggtgaagggactcagttggagtgagctctcaggttgaggctggtgcagtaggagtgagctagactgaatctccaatttatgggacacactcagaacctgggttacactgatgcctctcaggccctggagcactgggatcccagagatgcatgtgtgcatgtgtatgtctgtgtgtgtgtgttgtcgggagaagggggtagtatttctgtgttcacttctaggaaatcactgtactagcctccaagaatccggaaaccttcccagccgggaactgaaaccattccctggagggatgggcttggcttttgaagttgacagaaagtaaatgggtattctgagaggcagcacatgcctactgtctatccagtgttccagggactgggtcttgcttctactcagcagaggccatcattctgggaggctgacctgactagagaaggctttcttttatatgtgcagtttctattgtgtagaggggttgggggtgggatcatgggaaattggagtgctaccaggtccatggtttttgctttttttttttttttttttttttttttttttttttaaagaaaataacctgaaaacacttctgacttttccactgtctctttatatgtgctgataggcaaatgtgcatgcacaccaaacataagcatgtttgtgagggaagcaggaagtatctcagagcctaagaaccatgttttatagtttctttgatcataaacacttggtggtgtcttccacccattatccaggcctgaggggggcagggtggctggtgataagagggagggcagaaaatcaggcctaggcgttttcccttaccattgtcttccatggaatgttttcaagggcctctcaagccccattcatctggtttagccaagttctcagcctggggaacacagtactacttaatgattgaggtttaccatttatagtgatgcttgatttccttttcttaatatatttgtagataaaaattgaacagggacaaagtagctatttaagaaaggaagtgaaccatgttgggtcatatcattttctttagattggatatctatgaagtccacacccctttgagttatgctttttaggcatctatctcatcatctcctgatttaaggataattctgtctggtccttggagctctcttccctaggaattagtgtgtggagtctctatatgcttgtgatccttggagctctcttccctaggaattagtgtgtggagtctctatatgcttgtgattcacaactaaatatgaaatttctcaattcaggagcaggaagcaaagtgctggggtacagttttgcagattggttgaaacacttagccaaacttaagtggcctgggtaggaccatcactcccaaagttgtcagcagagaagggccctctgtgtgagtctattcaaacctggcattgctctgaaattgagtcctcatcccatggggaaggtcttctgggggctttacattccttgttactagtgttctggatattaccttctgcttcccacttccttttttttttttttgagacagagtcttgctctgtcacccaggcttgagtgcaatggtgtgatcttggctccgtgcaacctccactcccggtttcaagcgatcctcctgcctcagcctcccaagtagctgggattacaggtgcacaccaccatgcccagctaatttgtatatttttta

SEQ ID NO: 105928 - DNA, 1110 bp, Homo sapiens
cttccttttgatttctcagatcagtctttcccttctgagccatggccttctgtgcacccagctcagtggctcttcacccctaaaactaagtgaagtcatccttccccaaaaggacccctgggagatgttctggccctctgctgactactcccaggaatcagcacctcaaggactatttgagaatgttgtgctctctattggtcaccttgagactccgttcccctgctgccaactcttctcttctgccctgtgtattctgctgtgatccccttaacggcttttctgtgctactagcttagccctaggccttttatgaatacctgagtcttataacaatgaacttcttgagcaggcagtgtccaacttctttgctcttcagggacctgagtgtgcacctttcccttttgcaggtctatttgacatagtaatctagtgtgttggggaggggtagccaagcaggctgcagtgtctgcaatgcagagggcttggggaggtttgggtactctctgctgccactactgggatgatattcagaagagagaggacctcatactgtgactggacccaggaccctccctggaagagagctcagcccagctgtgtgtgtgtgtgtgtgtgagtgtgtgtgtgtgtgtttgtgtgctgtgctcatgtgcacctgggtgtaaaatgactgttatctggttgtgttactcagggtgggctggggactcaccagaagaatcccccccagcctgcccaagacaggtttttcccttgtaccatcttcagagaggtcaggggaagagggtccaggtgggttaaggggggtcgctatggataaccactaagaccagactgctgccaggaggagtgggggataatgaggtggccccagggtcctggcacctggctttggttttccgtcttctttcctcaggacgcccctgaggcctgggacctgtgcctggcttcgaggagcatctgtggctgggtgatccagctgctggtgtgatcatgggcttccctcctctcagcagggcaggcgctcctgccccagagactgggcaactggctgtttctatgacgtatttatttttacttgtgtttcatgtcacttttttaaaaaaa

SEQ ID NO: 105929 - DNA, 3520 bp, Homo sapiens
cctcaggactctccgtgtcccctccgtgacccccgcggcccgggccgctctttgcatcttgtcttgcccacagctggcctcggccaggtccgagggcctggatgcgaccttggggcagcccctactcttccgggcagcccacttccgcggccaccggtgcagggcatgccccggggccgtggaggtgagggaaagaggcgcgagtcgcgttttaactccgcccccgtcccccaaggccgcgcctcgcagcctgggctgcaaactttagcgtcctttaagttacagacgtgcgtggggctccgtgaggaggtgggcgaagagaaaggctctgagtaaataggcaaggcccggggtgagcaggggctggaatccgaaagtgggaggcggcggccccccaccctccatagtccttccgccctctgctagcaccgaagtttagcccaggacgggggccgtttaagggcccggccctccgccgccgcgcacgtgagcggcaccaggaagctggctgggcgcagccttccctgaggctcgctggcaccggccgcacgcgtccatcccgggcctctgagcggagggggagccgaggctagagggagggcgcagtctgcccaaggtcagcggcagcggcagtttctgggcgccaagtgtgattggagtactccaggaagaggggcgtgaccagagctctagcgaagagacctgacattgtaaagctaggtttggcttctgatttccacagggggtttgagaatgggacgagggtgctttagagggaccggtaggctttccctgaggacggtaatcagggcatgatggttggctcagtggttatttcctgggcaggggtgactgttctttcagctcccagcactggagcgctcggcccctgccgcactggatgccagcagttactaaaagtgagcctggcatttcaggtgagctcccagaccttcttccttttctcttgaatataggggaaattcacgttacctctccacgtgccgaccaaggctctgagacccccaggtgggttttcttcccccccgccgttttctgagcagtttgggaagtgagaggaagagaaaggtagatactaagtttccttgaggagacaggaagtgttcagctgagatggcagatcagggtgagggcttgtcattcccaaggcaagtgggggcctagatgctgagagttttccagctttgggctcagagatgtccaacaaggatttaatgcttcaggcgttttggaagccagtcaccagagaggagagagaaagtggaaatgaggggctggaatcagactgtctgggcttgtgttgcctgcattttggtccacgtggctctgtttaatacctgtgttaccttgggcaagtctcttaacctctaactacttgaacctttagccttacctacctctttggattgctttgagggtgaatgaagtagctgtgtttcaacatttagacagtgcctggcgtatagtaagcattcagtggaagatttctcatcattatcaaagaaaattggaatgaaagttactggagacaagatgagtaggacaggcagaaaagagagagatactgatgggtagaagcacagatgggtgagactagtgggcaacacctcaatttcttgacaccgaaagtttagaaatttactttgcctctttgtgagcaaatactgtgtgctcattgactccaaagacaatttttttttagcgtaaaatcaacacccagcacccacagggaagaaataattccacagagctaagtattccacaaagttgcagcgtggcctttttagcttcaaaaccttttaaatgttaaatattacttttaaataattggggtgggaatgtccccccagtgggtcacatggctcccttcctctttaaacagtcttctctgggctgtgatttttcccccccgccaggcaactcaggtcaagccctctgtgtaagagggttaggcctctggccccaagctgcctggagaactaggcagcctgccttgaatagctcacagactggcctctgtgttatgttcctgggactgctcttgaacagcttcttttcctcttagggataattgttacttcctcctgctgtgcgactccccttttagcagccttttcctcttactactcactgtttcttctgtgggctggaaaattgggatgaagcttgttaacattggtggttcaagtctgggaagcttagtgttggactttgttctgcctgctcaggccgctttgctctggtctttcctctggttctggatgggtaagcttgctggatagcaaggtccctgcaggccagatgtacttagaaaaggagagtttcttatgaaattctcttcctgaggcacatttttcctcacaagtttttgttccttatggtttccctgtcgttagtaagtgtttggaccctagcatttgccagtcctccctctggcagtcgtccctgaggcttggggaggctgggctggtggcgtggctcagctgtggggaggaagaggtaatgtggaggaaaggcaggctggctggtatctggtacatcttcggggagacttgtcagggcccggagtatgtctctggctgaatcactcctgtgcccctctgtgactcagtttccccaggtgtgaccagggctgccagctgacagtttgagctgctctgagatcctcaccaactgcgattaagaaataaagaggcttgtggcttcagtcatccttgtagctcccttccaggtcactctgtgtgtaaacacctctggcccctcccctttctgggtcagagcacccaaggcaggtctgaggaggttgggccagaactggttggcgggcaagtgggcacattgtcagagtaggctaccagcctcctctcccttctttctcctttgcagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtaaggagtctccatggggttctgccccatggatgggcctggtgggccagggcttctttggggagggtagttttggttgctgaggaaagggtgggagaatcttcaagctggccctgcagacccctcctctatgagcttgaagcaccttccagatttagcctggacttctgctcccggcatccatttgtgggctttctatttgcccaggtctggttccccttgcccatggctacttgtggatttccaaatgcagtggactataccaccatgaatccctggcttctgccaggactttggtcccctgcctcctcttcttgtcat

SEQ ID NO: 105930 - DNA, 1079 bp, Homo sapiens
agggctgagagggcagtccctggggatggggcttggaatcttacctcttcagccattctgatgcccctcaacctggtgatatggcatttccttagacctcaagctggtgctgggagatggccaagggggctagtggagccagatgagttacttagaatgttcagaatgctgaagtcaaaaactaatccagcatcactagcaccctgtgagcgtctggctgttcttacaacctatggtgagtcagagcttgctaatgtaacctactgctatgctatggggtggtgctgcccacagctggatgggctggcagctctgtcaagggttcttcagcctctactactaagccatgccaaaccaagcatttggaatccccagctctgatttccttgcctggagagctcaagtgcacaagtcctgcagtctacccaatgtgtgctgaccggcttactggggcactagttgaaacaggatgtactggttccctctctgtgccaggttctactctacacctacactctggagatgaatcagacctggctctgccctcaggaagctctgtgtggctgacatgtcagccccacataagtgattctccaacaagacactgtgcttgatgtccacagaactttgagctgtaggttcagggaggctgccatgagtctgctggggaggctcagagaaggggtagatttcagctgggccttctcatgtaagtagaattttgctttgttgggaaggggtacttggctaagaaaactgtgacagcaagagcctgaagacatgggatgaccagagaattgtggttagtagacatgtcttgggtggagaaaggtggaagggtttgcccagccaggtggtggggaagtacagcaggttgagaagaaggatgtggcacaatttgccacctttgttttaggaagttagctgaagggcaggtggaggagggaaggagatgaggcaggaggccgtagaagagattgggctgggtccaggtgagaggcgacatgggttggttgaggttttgcagtcacatggccaggagatggcactaactgaagttgggagcactggagcctgag

SEQ ID NO: 105931 - DNA, 1141 bp, Homo sapiens
accctgcccatcccagtcctgggtcagtccagaagacacctgtgtccccatttagagctaggtcacacttggcacctgggatggctcagggacacttgggtccccatttactcttggagctggtcagtgcattctctgcctgacagagattgtaacaggttcagggaaccatggacccccaggcttcaggtgctcgtggctatcacagactggtccggaaggacctgaggcctcctggtccacactccatattatggagggagaaacagattcagatagtaggagaaaggcactgatctcatatgtttttgttttcatttaacaaatatctgagcacctgctctgtaccaggctctgtgttgggcactagggtaccatggggaccaggacctgccagtgtgtgggtgttaggagcctagaggaaaggccccatcctggtcctggagtgggctgagaaccaaaggtttttgtcccctaggctgcctccaccagcagtgtgcagcgtggcatgctctggttctcagagaaagagaatagaggctgacctgttcagtgtcccacccccactgtgtccttccctagcccagagtgacaggagccagaacctgcttctctgtgagtgtggggaggcagtgaggctgtgtcaggctctgtgagtggggtggtgagtaaccaggtgagaggtgccacctggctttagatgctgcccaccccatgaggtgtgacggacagctccctagccatgcctcgtcctgtcctcagctgggcagggagtaggctggtcccacctaggctgggtgtggacccaggaagtagcacaagaaagggtaccactaagattggacagtggcagttggtgtggacctgttcatagtagctgctgctggagctgttagccttgtgccctggagtcctgtatgggaagaggctgcaggtctgggtgagtggttcttgtgaggcaggaggaaggattccattctccatccctgaaacccttggcatggttgggaatgggaaggtggggaagaagtcttttgggaagtggacagaccctggcaggggctcatgggtgtactcacccacctcagagcccagcattcatggagtgtgggccattcctcttcaaggtatgcaagggatg

SEQ ID NO: 105932 - DNA, 2409 bp, Homo sapiens
cctaggaggtggtgtttgctccaggcatggagtgggttggggaactggtggtacttgcttctgcctttagtaaacaagactgccattgaagccccctttcccttagtccaatgagaaccaaggcccagggccactaggtctgcaggggcctgtggtcatttggctggcatgaccacagcctcacagaggctggtgagagttctgatgtaggcctgtgtcacactccctcctccctcagtgtgtgtggagagaaggctccctgccctccctggaggcacttagtttgggtggagcctgggaaggggtgagggagtaggatttcccaggactgacctcctcaacaaaggcaatgggaatgtgggctgggatgtttcctgagggctcaggccgccccctatcctggttactccatggttattttctgccaggtggagtccaggcatttgctgtgcagcaggttaactatgtgggacaggtctggaagcacgagctcctctctgcccactagaactgtccttgaggtgaggtgagacgaggtgtgagaggaaggggcttcggatttgcccttctgggtttgaatcaaggctccactgctaaccaatgtgtgactttaggtgagtcacttggcctgtctgagtatgtctcctcatctgtcacatgaggataaaagaatccctacctcagggtttttgttttgtgggggctaattgataatgatatggcccaatacccagttctttaaataggtgggtgtcacacttgacatccagtcctgcctgaggacctcatgccactgggactttgtacttttagggaccctgcctgcctctctggtttagtcccagcctcctgcaggttgtctgggccatgtgaggcggcacagtgcagggaaaagccattgtgcagcccgctttcactagggccaatttccgggactcctggatgcccctgggttgtgtggcgcagctctgaagctggtctgcttgagtttgaatcctgacttcagcactcccttgctgtgtgaccttggctgaatggcttggttgtctgggccttgggaacagggttgaaaacagtaccaaccacagaaggctgtttggatttaatgagcttatgcttggaaggcagagtctggggaaagtggtgagtgcctggtcagatatcagctgtttttaggattctgtttgaaggtgtagggttatagaggaaggttcctgaaaggtttctaagtaaactcacctttgagggctggtatcttgttgactcctttctttcctcccgagcctgaagaatgaggcttgtcctctggcctagctgtctgcatcatctcgtgtcctgactggtgcctgtctccgtgtgcctttgggcataagcttcccagggaagttgggggttggcgtgttgacctgtagcacctaggagggcaaacgaggtcccgtatcaaccacctagtcatgggccagtgcagctcgtctattcccttgggagtacaagtgcaaatgaagggccctgcctctactttcccccttaacttgggtagctctgggtcagtgggctggcatgggaagagtaagggcagccctctgtgcctgggtttgagagatggtgctgctgtccctgtcaggttgtgtaggttgtgggcctggggttggcagtttgtattaaccctgaacccaatgactacatttggtctgggccgctgacaccatttctcattcctgcatcctggaagattatcagtcttgtccagttcccagactcagcgaggtcttggcttggcaggggccccgagatggctgtcttcgctatagcctcacacaatagggtcggcagggcactgtgacaccactcaggaaggggcagtggggccagccttgggactagctcgtacctggaagcctcaggttctaagcagactgccctctcctcccagtaatgggactcaggaggcttttcagcccaaaggagatgctctggggcctggcatgcctctgttgttttcctggtactcttgctttgaggacacatcctggatgggcttgtctttaccccgagtggtggtgggtctggccactgccctgtttcccagatgtggttccttgtaggtactagttctggtccaattcttgttctgggcagaggtacccagagaaatagctgatctggggaggaagaggagcaggcaggtagggctgggaggcccaggcctatgtcctagggttcggcccaaatacagatactcattgagccaaggtggatggggtctcttgcccatcaggacatcccaaccttctgggcacttgacagccttagtaggccttttccctggaggcgggtctgggctttactgggaggccaggaaagctttcctctgccactggatcagccttgccactccctaggttattt

SEQ ID NO: 105933 - DNA, 1051 bp, Homo sapiens
gcttcccagcttcaactttgcatggggccacttagtgggtggtaggcttgctgagagaccttctaggctcctccttaggccagggcaggggaggaggtaggaagtgttcttacttgtggaattagggagttgcttagccaggaaaggagctgctgtgccccacacacctcctggatcctgggagccctgtcttcttagctcccttcttccactttgacaggagctctgccttttctccaggtggagggagaggaagtttgttatggtgcagggcttgcttgtgtgtgcatgcatgtactgtcactgagcatgcctcaagaactttctgtgtgcgcaggatcctggacctttttgcctagaggcctggagtgatggagagagatggggaggccatcagttacagtgcagcacaacacctgctccctggtgggtacttgggatcagagaggaggggctgcttggtggagagcaacagaaggctttgaaggggaaagttgagctgagtcttgcaggatgggcaggagtttcccagtcagaagggactctggaatagggtgaagaaggacatttcaggcagaggaagtagcttacgcaaaggcaggaagcatgggaggatgtggcatgtttggggagctgcaaatagtttcatgtgggtgtgtgtgggggtgtggcgggtgaggaggctggcaaggcgggctgggccagagcctggatctgtccctccctctgccatgcagacactcagttggtgcctgcccacctgggctctggcccctgctggggcctgaggctgcagaaagggagtgcaaggtgagtgtgtgggcaaattcatgcagtattatgtgggccactccaaaagagccttgcctattggcttgtgaatttagtttcatcctagaggtaaattgggagccattgagaggttctgagcaagatgaccacatgtgttctggtgtcttttggctactgaagaggatgttgagctgggagtcccataaggcctgctgaagcgttcccaggaaagaccctggaactcaaacccaggcaagcc

SEQ ID NO: 105934 - DNA, 1049 bp, Homo sapiens
agggctgagaaacccccaggggatttcagagagggcttggaaagggctgtaatgggagggagaggtgagaacaggtaataatgacttcacagtgctgggaaggagggctggggagaggagtaagtggaggtagagggagaagcctgtttaaacttaggggtcatccctgtgaaggtgaactgctggcaaaaaaaatttttttgcggtgggtagggagaaaggagcctttagagttgagcaaaacccaggattgagggtacaaggtctgtgctgaatctcttggattcaagatcatatgtctctgagggcccagtctgaaggctggtacagacttaggcacctggaaagctgacgtgggaaacaggtagcagtaggtgagacaaagtgaggcctcttgatgccaggaggagaaatgagtactgggccttgcagcattcattcagtcctaggaagtgttggaggctcacataggagccttacatggctgaggtttctgggagccagaggagggaaattaggtagggaggcaagcagagtgggaagtgcaggcactagcaacctacagagatttggaggggaaccagtggtcttggcttttagccaggaagggacttaggaagtgggataggtccctggatgggccatgggttgcagaagaagtctagaggctctggtgatggtagctggccctgccagaggggtggggaggatgatctcttcacagaatttcaccagcaacccagatgtcagtgatcccaatcctatgtcctgacaggtgcttcctgcagcccctcctcagccacttgccaggtcctgaccctgcaagcatgtgtgtaaacacacacacacgtgttcttgctttcctagggcatgaccgtggagggctctgagctctttattaccactcctcagttttgctcccttgcctgccataatttctctgcctgtaaagcctgctcttctccaggagataggagggaaattagctaataggattttgctggacccaggctgcaggatcagccactgtacagttctgctggtggccc

SEQ ID NO: 105935 - DNA, 1017 bp, Homo sapiens
ctaagttggggggtgtggagtcagcaatggtatgtgtggcctggagttgaggaaaggctgggctggtggatatatttggggacatcagcctgttggcagtatttgacctgggaggctgccctgtgcctccctgcctctgtgggaccaggtaggcagtggacagcctgtggcagcaaaggctgcgcagagggcgtggccagtgtggcaggggtcagggaacaggacgagagtcagtgggagtgagagcctggtacacttggaggatccttgcaactttgttcaccaaagcagcttggggaaagggacacagcgttgatgatggaaatgggagttcagatgtccctggagtctggtgttggggctgaggaatgaataaatgaggccctgggtcaccagctgtgtccttggcggtcaaagacaggtttgaagaatcaggagtgagaagacctggaaaggggagggctgtcacggtgataaggcaagggcacagggagaatagaggggagtttcctttgtgagctggagggtggtggccaaaaggggtgtggggcaggatgtgcttgcctggctgcggttggactggaggtgggggcgggctggctggtggtgtgggcaggaaggaagataccagtgccctaggcctgcttagtgtgctgcctctggggagtcccgccccatttcattcaaggaaggcctctccagtcctgtcggtgccatcctcaacctcatgggcccatctggaggggcacccctgggaaagagacttcttgggttccagacctcagaacaggacatgtggcatgtggtgtggtggtgagcaactcagccaccaaagccttttcctggcttcaggggtttatttttagacacctttgtccaaatttcccggcccctgacagcttcacaagttgcctggttttgacgtcacctctttgatgaaagcccttcctccttcctccccgctcccatgggagcctgtcagctgtgctcctggagtgggggttgagacaaggaagc

SEQ ID NO: 105936 - DNA, 1279 bp, Homo sapiens
agatagaggccggctgcccacagaagaggcatggccgaaggtcctgggcttgttttggcagcagggtgtgggggttgcctctgcccctgtgtttagcctgaccttgcgtcttggggaacaaagccaggggagagatgaggaaggggctagctctgtttgctggtcacagcctgcagtggacaggggtggccctgtgcctctctcagcccaggagacagcaaggagagagtataaggctcccttccatccctgccttcatctcccctgccctgaggtcagagaaaggagattactaatgagactagttgcgtctcactcttctagcaccgacagcttttaactgtgtgtgcgtgcgcgtgtgtacacccttctttttctctctggatctgggactgctgtgaaggctcttcaaatggaatgacagcagccgtcagctttctgctttggcaggggtgagagaggccaggagccctgctgccaggagttgcggggggaggacttggcaggctcaccagcctctccagaggctaggtgaggggcaggggtgaatggatcttagcttcgggtttgggaggtggagagcagctgctgtcccgggagttgcagatgtgcctgagcctggaacaggattggtctcatgggacagagggacctgaagttcacggcgagaggcccaaggagaagcacttgtcaggactctcgggattctggaagggatggctgatctcagctttcctggtttgcatggcagcctctggctctctggctagccttccccagcttggcagcctggcaaactgctatagatgctggaactctgcctttctccatataaactgctaagggcccccaggctgaacactcattcccctggaatccatgcgtactgtgtgaccatcactccatatggaagatgcctcagctttgtcaggctgctccgctggagtccaaggaggtggcctctagtacaggaggagaccactccccaagtcccaggaaaggggtatcttctggaagctgcaggatggaacagagcttgcttgaaattgcaaacctgcagaggggagatggggcccagatgtgagcccagagcaatgggcagaggcccccaaattcaccagtcttaatgagtgtccagggaaggcttcggacacatggaacagaccaggactgagggatgggcctgggaattcgatgtgtgggattgtgtgtgtaaggtctctagtgcagtttgctcatatctgtctgtagcacttggtgaggaaggccattgagagtg

SEQ ID NO: 105937 - DNA, 1914 bp, Homo sapiens
gtagattactccagctcaggagtttgagaccagcctggacaacatggtgaaacctcgtctctacagaaaaaaaatacaaaaaaattagctgggcgtggtggcgtgcacctgtggtctcagctactcgggaggctgagacaggagaattgcttgagctcaggagacagaggttgcagtgagccaagatcacgccattgcacattagcttgggtaacaggagtgaaacccatctcaaaaaaataaaagtaaaaacattaaaaaaaaaaaaaaagggaaggaaggaagtaaagtaagaaagtaaggcaaggaccccagaccatagttctcagactgccctggctgtgctgaggtgccctgtggctatcagcctgtggtgggagctgtactcagaccctttcctgcttcacctggagtagttctgcctgtgagttttacaacccaggtgtcttgagcttttgtttggaagggagcttctaaggctcagctggtttgaaaacctctgtcctaagagaggggcaaaactgggcagatgccacctccagtcccgcccactacatgtctgttctcgatcctgaggatgctgtaactgcagtatgagtggagctgggaggcaccagggcccagcccttgtgcaggtagggcaggagctccaaagagaggcacttgtcttgaggggagtgtgactgattggaagctggacctggagggaccctggggagctgcaggttggagttctcctggggtggtggtgactgaactcctgagtggtgggtgatagcattatggggcagccagcttggaactaaggcctgtgggccccagcagattgcctgtggaaatgggtcagcctgttgagcagtggctgtgaggaagctcgaaacagcctggccacagcctgtgttctgtccagtgggcacagaaccgcttgtgtttgcttccctttagtctgcctcagtgaccctgagggagtcagtcggtgggtctgagtccacactggggccaaaacaccagtgcagagcaacaaggcctcggccggggaaatacaggtgaggacgccacgtgtggtggctcacgcctgtaatccccacactttaggaggctgaggtgggtggatcacctaaagtcaggagtttgagaccagcctggccaacacagtgaaaccccatctttactaaaagtacaaaaatcagctgggcttggtggcacacacctctaatctcagctactcaggaggctgaggcacgagaattgcttgaactcgggaggcagaggttgcagtgagctgagatcacgacactgcccagtgagctgagatcacgacactgatctccagcctgggtgacagagcaagactccgtctcaaaaaaaaaaaaaaaaaaagcaggtgagggagccccagcaggaatgtgaaatctgtggtcatttccctcttcctgcctgtcacctttgccaagctaacatgggaagcttccaaactttatttttaacaagggaggccctcttggcatctcagctcagtcacttattcagcagttatttactgaggtctcttgtgtgtgtcattgttctgcgcatggaggaaccagctaggaggcgtcatagagtcctaatcaaagccagcatccccattgttttacagatggggaggctgaggcctagggaaggaaggtgccccaaggtcaagggatggagcggtagctgagtccagactgggtcccttaggccgaggatcgttccgatggctatatgccttttgccactccatcctgtacataagtggggctggaaccaagaggctgagaacttgtcatcaatttgggatatgctcgggatggtgccccagggtgggctttctttccttctttctccaaccctggtagtcacagttggaggctgaggcttcaggtctaggag

SEQ ID NO: 105938 - DNA, 1551 bp, Homo sapiens
gcactagggagacactgatggcgtctgagcagatgagtgacagtatccaggctgggcttcagatcaagtctcttcagtacctaggagatggggaggaagagccagaggccacagtcaaattctgcacaaagataatgcaagttagctgaaagtagcagtgacttttcattcccagatgtccccaagccaagaggcgatcctcccaccataccacggcttggcttccccggctccccttagggagctacccttgggtattgaggtgttgggagccaggcctctcccctttgttggcctaggcactggaacctgctccttagcctctctggctttaccccacctccctcccttcccccaggaatgaaagcacaaagccagcctttgctagggcggcgtgggagccaccactctcaaaataccagctcggatattgtagcttggcagccctgcaggaccctgggggctgaagcttgtctggatggtgctgtggggttgggctgtcaccagtccagagggagccttcttccccaggcagatggaatttacttatcaaagaagaattctgttgctcttctccaggaagcttgagattggaattagggaggggaaagagattccaaggagagaatttgcagtgcaccccctctcccccaagcagaacaacttcttcttcagctgagccctcagattaggagaggctagctgtctagttatgcaggtgggaaggaaaggacttcactgaggagtggagcagaggtcagaggtaccagttggagatgagaaattcagggccttctccttctctccctctcttctgtcccctgtctcctctccattcccacttgcccacttgtccttcccctctggcaattcctgactcctctggctctcaggtgcttggcttcccagctccatctgtacgagcagccttcctgctgctggataatcatcagcaaccagtttgtcagcttgtgagcaggacagggctcaaggtccttgactacacagacaagctgctaagaatgctggatcttggagagggggtgggctgtggagcctgcgatggtagagccatcatctggaaggctgtggctctcctcccagatttgcaagggagagcaatgggatcagggctgactcacccagtgctctagctgagctctccttggggtactcactcctgtactccccaaccctctggtctggccacacaacggcccaggcccaagaaggccagagcagggctgaaccagggttgtatcttggccctctgggcctagagaaaggtaaggctgggtatggatgcaggattaggggcctcccagtccatctgggcactaaggtgcttaagagcctgtgtcccatgtgcctgcttagagggaaacattgtttccccacccctcaataccccaggctgccctgtgcttgactgctgcctaggccctcctccacaggacaccgaggaagccagggcctgcgtcgtgccagggagatgaatagaggtgtaaattgtgtggtgagctgccggctctgaggtgaaaatgaaaagtc

SEQ ID NO: 105939 - DNA, 1751 bp, Homo sapiens
cgtttccattatgtttttttttttttttttttttgagacagagtctcattctgtcacacaggctggagtgcggtggcacgatcgcggctcactgcaacctctgcctcccggattcaagcaattcttctgcctcagcctcccaagtagctgggactacaagcatccgacaccacgcccagctaatttttgtatttttagtagagatggggtttcaccatgtcagccaggctggtctcgaactcctgaccccaggtgatctgcccaccttggcctcccaaagtgctgggatgacaggcgtgagccaccactcccggcctccattatgttttctacttggctgatctgttgcacagaaaaatgggctgtgcttgagttacctttgtgacttaatgtttgtggtagtccctccattgattctttttgggttttctgagtatagttttcttaccgtcacataatggtgtttttattcatcctttccagttcctcacttcttttgagatcatctattctaatccctttctttccttccttccttccttccttccttccttccttccttccttccttccttccttccttcctcccttcccttcccttcccttccccttccttccgtccgtccttccttccttccttccttccttccttccttccttccttccttccttccttccttctttccttctttcttgttttgctctgttgcccgggctggagtgcagtggcgcgatctcggctcactgcacctccatctcccgcattcaagcaattctcctgcctcagcctcccgggtagctgggattacatgcacctgtcaccacacctggttaatttttgtatttgtagtagagacagggtttcactatgttggccaggctggtctgaaacttgtgacctcaagtaatccacccgccttgacctcccaaagtgctaggattgcaggcatgagccaccgcgcctggccaaagagggaaagagggagggaacgataggccaaaagcctacagcacccggtattccaggcagtctcccatccaagtactaactagacccgaccttgcttagcttctgagatcagacaagatcaggtgcattcagggtggtatgactgtagaccctttatttcatacttgggcaaattgagggccagagggaagctaccgatttgtgtagccaagccaatgccctaggctcctgcctggggtgctctctgccacttcctgcttcctcttttccctccctggccatcctgtcttactccctgtctcctttgcctgccattttcagagctttgggctctgctggtgtgaggggagagtagagagaggggaaggtgctcaccagcccttctgcaggctctccctgctgctgtggcaaggccccagagcaccaacagacaggtctggcttctgggccagaagctttggggcagcctggtgggggtgagaggaaagtttccgggcagaataataacgtgctaccttctagctgcagcctcttgctatacctccccaaagcatgcacgtgccatgaagaccagctgcctgaggggcctccagggtttgagtccccacttgcagggactgctgtgtgcaggcaggtgcatgttggtgtctgtaattaaaaatgagcatgcatcacttcacccagtgaggagacgccactacctcgggtgggatgcaacagctgcttgctggctgtgcagctgcctgggtatccagcctggcacagaaggatagataggactg

SEQ ID NO: 105940 - DNA, 1052 bp, Homo sapiens
catcccttgctgggcctagagcttatgtaggagatgtgacccgtccttggcccacacattgcctccttcttttgggcatttgcagccacctagttctaagcaaacctccagcctctgggtagcctgggagtgggacccatcatcagccttcgtcctgggcctgacctcttctgtcttctatttgctcccaatccctagctgaagccagggcacagggtgatgtcctgaatacaaagcactaaatgaggatagttcaggtccaggtcctctctcttacctcttttcttcctctcccataattcagaaagacctgctggggaggcactgtgggtcccgtgggggaaagcttggcctggtgtatcagtcttgccctgttgtgggagccctgagctgaatggggtaaatgcctgcaccctgcccaggagatgaactcaggctgaagtgaggtgggagtgtgtggtgtgtccccaaggtagctgacgcagtggcactgtggcagcctgtgtgaggtgggtgagctgctccttcccttttttgccaacactcctgagtgagtaagcaggtgttggtgcagggtggggtggtggtggggaagtgctggtgtctggggtctcttagaaattcctgcatcatgggtggtgtcccaagtccccatcttgtttctgcatgtggaagacccaggtgggagggaaggcccggaggtgtgtctgagggactggaactctgaatccagtttctggcagaccctgggggcaccttggcatggttcactgacttttgcctgttaggtggagaggaatgtgaacatctgcaactctcccaccttggaaagaggctttatagtctccttgggtctgtgtgtgggagtgagctgctctgggctgtgggtttgttagatggccagtggtgtcagtggcagagcacgttctcatgtcctggcaatgcttccacacactgctggctgtctgggctgtggaaggggatgtgccagggctaggaggaccccaggcccacccaggctcttcaccagtgggaccagcccagtgtgacct

SEQ ID NO: 105941 - DNA, 1269 bp, Homo sapiens
agtagggaggaccagggcccccaggtaacagcaggtaggaccaggctagttttgggcctgaggctgcccctccaggggtctgggagcaggctctgggacctggtgctccctgtgtgagatgctgtgaggagggagagctgggcagagaaggaagggctgtgtcgcagggccacagttttctctccatcctctgtctcccttgatcctctgttctccctgatggctttgagatgaaggcgacggcaaggatggaggatgcagtttccatggcaacggggctgtccacagccaggcaacttcagagccgggctctccggaggaagcagatgcgcagaacagccgcagagctgcctcccgcctgccaacgagggggctggcagaacaggtggcacagggtggcagcctggtgctgcccagcctaggggagagggtggaaagagcagtactccctcttattatcttgttatggccaagttcctccagaagggaagctagggaggtggcttgagtgttgagaggggttgggctagggtccccattgtccctggaatctctgggtggacacaggctctgtcctctgggatcttcccccaaaagccaaatgtctgctgctcttgtgatggccactcagctactaccctttgggtcctttgtccagagtgtgaggatgttggtgaaggccatgccctgactagattcagggatccttttctttcatctagctactggggaaggacctggaccttcttcaggggcctccctgcccctggcctcagtgacctggaccagtttgctgagttgggttcaggtttggcagatgcctgcctctaagtgctggcattggaggggccccagagcctgacagctcctgcttcctgacactgtgatcttgtttagcctcctcctggagaccaaggctggagtgggtatgtgagtgggtagagaagcaaagacagccatctgtgtgtttagaaatgggacgtgtcaggggcatggactcttgagatggaggaagccccgagggcacccaggttggcaaagaagatttgactccaactattaaaaaataatgactttccttcaccgaccttggaagcatcagggctagggtgttctactttgctgttgagcacatggagacttaggatggaaggctttgcctggatcacccatggagtcagaggctgagccacagccagacctgggacaggccatccacctcccgcgtggcctcctagatgcaccctcccttcagctggctgctgaggg

SEQ ID NO: 105942 - DNA, 1599 bp, Homo sapiens
aggagcacatggtgtccggcgcggacgatgggtaagaggtcctttggatgtctctggccacggcttctgctcctgagtgctggctgtccacggggccctgagcttgcctcagggcacccccagtgggggagctgttgtaacctcttttcatggatgaggatgatgaggcagagagctcagatggccttgtccgggctgtgtgcccttgatcccttcctgtcatgtggccttttttctttttttttagaattaaaaaaaatttgttgtgggtgcttagtaggtgtacgtatttgtggggtacttgagatgttttgatacaggcatgcaatatgtaataatcacatcatgggaaatggggtatccatcccctcaagcattaatcctttgtgttacacagggggccttttctgcctctggccccctcactgctgtattccctccctgtttatagctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggtgggtgccctgagaggcagggaggaggggtcgccgggtgggccggtgcaggggttgctcactgttccagtctccccaggctcccacagctcctgtgtgcggctttggcagtgtggggaaggcttccggcagcttgaccttctctgtgacatccccctggtgagtgagtgtgcttgaatgctcagcctgtctctgccacactgcctaggcccctggagttagctctttaaggtctttcttcctgccagaagggaaccttctcagggcagggccagctcctagcacagggcctggcaggaaccctccccactttccctcctctgctccccttcctatcctaggccctgtccagggtgctggggtacaagtcagggagcagcatggggagaggcatggaggcctggccctgtgatgaattctgtactgctggtgccagattgggtgccaggctagagggtgtggacctcactgtccacactagggtgacctgggggagggtggcaggatctgtcagtgatgtgtgctgagaatgcagggtctaggtcagtggggacagtcatggggtctccagggccccaccaccaggagccagcctcaggccatactgggtgtacactgcctccttcatcctcacaaactcactgctagccccgtgctctgcttacccccatctcgcagatgtggaggctgaggccctgacaagtgaagggctggcctgtgtcaccaggtggcaggaggcagagcagggatttaacccaggcctgataaggcccagcccttgactgtgatgctgaggacggtggtggcggggggcgttctaatgtctttccgtgttgtctttctgctcaggtgggttttatcaacagcctcaagttctccagctctggggacttcctggtggctggggtagggcaggagcacaggtatgtgtggccctcgagggttcaggtaaggtggtgcaggctggacagctcggtggaaatggggtggagactgggccga

SEQ ID NO: 105943 - DNA, 1064 bp, Homo sapiens
ggagtgctctctgggtgacagtgaaagctgctgcccggcagtggggcttatgagctccctgtccctagagacctttgggcaaagtcaggatgatgatttaatgggaattaatgctgcaggtaggtggttggactagaagacatttgaggctgtgcagtcctgggattgagtgcccggtcctcctgggttcccatccgttgctggctgaccagcggttccttctacacccgctgtagtaacagaagaactcacaccatcaatcccaaagcccttttacatcccttctcttttttgggctttgtggctgctgtttggcactaatgtccctcttcatagatgaggaaactgaggcagcttgtccggaggctcacggtggctgagccaggtcttctggccgagtccgggacatttgccatggctcttttttccatgctgccccttgaggggggttgccagccagccctatccccccatcccagtagcttctcccccacccccaactgcagggagcgtggagagtggacggaagctgcatgtgattcctcgagccaagaagggtgccgagggaaagccccctggccacagcagccacgtcctctgcatggccatctcctccgacggcaagtaccttgtaaggccaggttggccctgggggcaggcgggaggtctggtgcatggtgggtgcctgtgatcattgtcttcatccctgcaggcctctggtgaccgcagcaagctcattctcatttgggaggcccagagctgccagcacttgtacaccttcacaggacaccgggatgcagtgtcggtgaggagctgggtctatgtcagtggatctttagtgggcacatgctagtgttctaggctcagtgctggcctctggagtctctgtcctcagggaacctgcatcctggggtagcgagtgggtagcgagtggtgctgtaaaatacataaatgggctaaagggatggggaggagctgggggagaccgggccgagcttgctcaggaatcaacgagggccttgagaagccgcctctgggcgggatgtagcggctcttgcctataa

SEQ ID NO: 105944 - DNA, 1119 bp, Homo sapiens
ctgaactgcaatgtcacagtaacccccttttcatccactttgtccccacagggcttctctgtccagggtcagtatggggctgtgaccccagctgaggtgagtgacccatagcccaaggcaccccttcctgaaccatgcctcctctgacctctgacccctctttggcacaggtcaccaagctccagcagctctcaagccatgcggtcccctttgccacacccagcgtggtgccaggtaagccacccctgcacaaggaggcagggggagggtcctaagagggcagccccctcccttccagggagagtggaaatggtggggcgggaaaggcccagaaccacactcagtccctcttctccccctcaggactggatcccggcacacagaccagctcacaggagttcttggttcccaacgatgtgagcaggggatgggatggctggagggtgggtagggggtctgggggtctggacctcacccagggctgaattctgccttccctctagttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctggtgagcgcgggctgggcggcagtgggggagcaggtcacggttctcatgtgcccaagaaaggcaggggtggggagaggaagctggcctcctctctctgtctgggcccgacctctgcctctcctaaccctactccaattccccatggtctttgcctaattcaccctctgttgccccatctcccccctctatatccacctctcattctccattgctgtgtcttttccctgggtctctggccaccccatttctccctgcacctcgtgctatatctgcttgtcctttcttcccttcctcttccacctttcccatcttccccttattgttctctgttcactacctctctcttgcctttcatctaatctcatgcccatctctgccctcattgcccctctctcactcccactttcccctttgtctcccctctatatccctctctccagtctaga

SEQ ID NO: 105945 - DNA, 1039 bp, Homo sapiens
tccatccaccatctggctgctggacgaaagtgcctctcatatggagtaagctttcagcctgaactccaccttcagggccccatccacagaggttacctcttccaagaggtcagggaggaggctctcctcctgactcccataggcttcctagttaattatttcttttagtgtctcagggtaagggaaaggctaggtacctaccatgtatgtgcttattgttttaattctcatcactctttggagatgggaatttgtatccccttctacagatggagaagctgaggctcagagggttgaatgggctccccaggcttacacagctcgtgagacacacataagcaccctggtcagagtgatgtgtggcgctcaaggtccatgcagtctctttcctctgggagtttgactagcccagctctggggtccccatgtaagggcaggggcagggtggactgggctcctctcgaacccctctttggctgcccctgccagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggtgagcgggaggtggagggccaggcgaggcaaggctgggctgggctgggtttcactgggtatcccagtggggaggggctgggcctgggcactggcacccatctgacggctcttgtcttgtccgcaggaagtgggcagcatcatcgggaaggtaggtgcctagctctgctctgtacatccccctccagctgaggcttcagcccagggaaggaggctgtgacctctaagttaagagtgattatctgttttgtacctcccacagaagggcgagactgtaaagcgaatccgggagcaggtgaggatggagtttgggggaggagcccagggcacctgatgtggaggggagatccctgccccactttctctctgaaccactccttctgggctgaccagtgagtcccccaga

SEQ ID NO: 105946 - DNA, 1075 bp, Homo sapiens
cagtgatgcctcatggggctgctcgttccttgggccctaggagaataatttggaagacatgggtcagaaccccttgttcttgcctaaagatgggaaagaccttgagagtctctcagaccaggaagggcgcagatagaccagcaactctctccctacccccagcccctaaacacaatacaggtgggtttaggtcaggtgaagacctggccaaagttacccactggacttggggcggtgggtctctgctggagacccaggcatcttttcatggcagaagctctagttctggccatgttccagccctcctgccccatttttcctggagccacaagaggtcatgtggagatggtttggggacaatgtcaggtctcccactggttaccatcccaagggggtccttgaaccccagaaaattttggaacttaagaccgaggctctggacaagttgtcagtcctttccaaataggatccctgtcttctagctaggcaaaggtctcagagacgactgaagcccaatccccactttcgaaggagcccgccctccaggaagaggactaacagatccagacaggagcagcctgaaaggggaggcagatggggctttggatagcctcacactagcaatgctagtcccactgtgtcccacctctctgtgaccttgggcaggttactgatcctctccaggcatcaggttctcctgtgtagtgaattcatctgctcagctaaccagtatgttagctgagttccagctgagctcagtatgttctgagcaccttctctggcctggctctgaactgagccctggggacataaggagaaggcagcagccttggctcctgctccaaggggctcctgggcttggctgtccagagaagcagaaaccaagcacgtcatcacaagtgctttgatgggggaagtgcaggcagctgggggaatgtctagcaagggcagccagcatgaggctggccaggatgctcggagagcacagtccctgcatccactgctcatctccagcctctggagtccctgtggcagaactcaaatggaaggaggagcagctgcacccaggggagca

SEQ ID NO: 105947 - DNA, 1056 bp, Homo sapiens
aaagccctgagctgggttctagggtagatgggatcagtgcccagactgcctgtcataacccagatggctgggtcccaaccctcggtgccaggtgtgaaaggagcagcatggctggccccaccccctcaggccagggatggtatggtttcagggctcaagggcgagcctcctgcccaggcaggattgattccaatggtgggttggcttgagcttcagggtgaaggtctggagctaatcttgttggtgaagcctgaatgactggaggaggagctgcagaaccgacccctcagctgctgtccttcaggagcctctcttgtcccaatccagggccaggtgcctttcacacagttaattttcacaacaatcttaaatggcagatacttttgttatccccctttaacagatggggaaactgagcagctgagagaggactgagggggacctacccaaggtcacatagacaataaatgcagaattgggttctggacccagacttcttgggcttcagagcctgattctctccaggacacttactgctggggagacaggcacagacgtggagagaagtgcctcatgcttggcacgataagatagaatgaggctactgtaggaataaacgtgggcacactgggtgttacaggaacctggccacagagaaactgacctaggagggcttcctggagagagcaaccatctcccttgttttgccattcactgcccttgtcttgtctctttcacacctgaatccctgcaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaaggtacccttgtgtgggaagctgaggtgcccctgccaggagcaaggaagggtgcatccctgg

SEQ ID NO: 105948 - DNA, 1071 bp, Homo sapiens
ccacttgctacttggcactttgggcaagagaatgtacctctctgagcctccatttcctcacctataagagacctataatcacgtctgctccccagcattcttggtggaaaagaaccttgtatgtgaagtgccacactcagggcctgctgtcataagcgcttgatgaacggaagtggtttcagctgatgccatgatggtggcggtcactgagcatgctgtgtgccagagaacacctcagatgcacctcctcacactgtgaggtatctgagcgcttgccctggcatgtggagtagttgagtgtgaactcccagaactttgcccagagcaagggaaagggcaagggctggagctcttcctctgctggggactctgggtggggttttgggatgggatccagggtccttgtagggactcagttccagcctcttttccctctcctctccctctccagactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacaggtaggtgctgctccaagggtctagtggagggactaggctcaaggggagtccctgtgtgggacccccattatactcagggtgctcaggtcctgggagggcaatgggagaagcctaggaataaagaaaggtgggctacaccaggttcccagcaaacacattcccctgtgtgcctgcagggtggaggtggtgctgcttcatggaaaggcctttaactctcacacgtgggagcagctgggcacactgcagctactgtcacagaggggctaccgggccgtggcccttgaccttccaggtgagcacccccacccctttgtctagggaagccttaagtgtggctgggaggcaactggaccctagggtctggacaggccgtggcaggtcacaacataaggtggcaccatgaaaaag

SEQ ID NO: 105949 - DNA, 1040 bp, Homo sapiens
ctgggattacaggcatgagccaccgcgcccagctgccaggacatgcatttttaaatttagataactactatctcaccctccaaaaacactatatggatttatcttcccatctgtcatgtatgaaagtgcccatttccccatgtctcccccaacactgggtattatttattttttattttattttattttttttttagacagagtctcgcagtcgcccaggctagagtgcagtggcatgatctcggctcactgcaggctccgccccccggggttcatgccattctcctgcctcagcctcctgcgtagctgggactacaggtgcccgccacctcgcctggctaattttttgtatttttagtagagacggagtttcaccgtgttagccaggatggtctcgatctcctaacctcgtgatctgcccgcctcggcctcccaaagtgctgggattacaggcgtgagccaccactctcggccaagatatgcttttctaacaggcatattacattaccagaaaatagcttctgggcagttttaggtagtgtgtgccagtgccagtggtccccaactttttcccccactgtggtgggcaggaagtcctgtgccccttcccagtgcccctcagctggtacctgctgctgttcctaggttttgggaactcggcaccttcaaaggaggcaagcacagaggcagggcgggcagcgctgctggagcgggcgctgcgggacctggaggtacagaatgccgtgttggtgagcccctcgctgagtggccactatgccctgcccttcctgatgcgaggccaccaccagctacatggatttgtgcccatcgcacccacctccacccagaactacacccaggagcaattctgggctgtgaaggtactgggagaaggatctcaaaggtcctggcaccctgtctgtggcttgggggggttcaggactcaagtcttacttggagggacatggccttatccctgaccttggatggaagagttggatggtgttggggaaggcttcctaggaagtggcttgggggtc

SEQ ID NO: 105950 - DNA, 1051 bp, Homo sapiens
agcatctctgagggatatggagtgtgtcggggaggcagcagcccatttctgggtatgctccactctccgggctgcctgggctggtgggaagctgtgggtaggcagaagcagccccaagacactctgtgcctccaggagctgctgtggctttctttgaggagacagcccgccagctgggcctgggctgtcagaaagtagaggtgagcctggggccctaagcggggaagggaggtgggcctgggcacttcctcaccctgctcagaccacctaccctcctgaccatctccaggtggcacctggctatgtggtgaccgtgttgacctggccaggcaccaaccctacactctcctccatcttgctcaactcccacacggatgtggtgcctgtcttcaaggtgtgtaaggggctggggaggtgggcagtgcaggccttggggacagacatgatgcagaccccaggattcaacctcaagttgctcatggtcctggccccagtcctgacactaactctcaacatccttatgacattacaccactcaagcagccttcatccagcagcaagttctgggccagagtggggtggggactggggggtgggaagcaggagacagcaatgggggatggcaatcagctgccttcttcagcccccgtctttcctctcccaccactccacctgtcactccaaccctatggtgggctcctagggcagggccactgttgaccagagtggattaatggctaaatttggggtttgggcccctcttcccatccctgcccccaggaacattggagtcacgacccctttgaggccttcaaggattctgagggctacatctatgccaggggtgcccaggacatgaagtgcgtcagcatccagtgagtgtcctccattcctactcctccacaatgtccccactggtccagtggattgaagcaggacctgagggggtgattggagaaactcaaggccaaggaacaccgtgacctcttggacaggaactactgccatgaccattgcatggatagggagattcagaccagagaggggcagg

SEQ ID NO: 105951 - DNA, 1001 bp, Homo sapiens
ctatcccaccccagccctgtctctcctgccccatgctcagggaagtcagaacaggatagagcagatctggctagatcaggctctgctactggggccatagtttactcttggtactacctgggggtcctagcaaggctgagatgaaagcccagttcctgggcctctgcacacacagatccagggtgctgaggcctctaagatgaactgacctagtctaccagggaccctgcccctctgtggcccctgctgccaacacaagggtgtacaggttttgacaggagccagcagtcaccgttggccctctgcctgcccctcatctagcaggggcccagctggtgctattctggtactgtctcaggatcccagatgtacacccaggaagatgggagtggttcctgaggtccttagtatccctctttaatgggaatggaatccctgataggtcagaactaagtatggtggccactcaaataggaactgtggccctttcttgctaggcacagacatggctggatggtactgaatgggtgtgctgtgtcaaggggcacagagcagtgtggggtagtggggaagtgctaacagccaggctcagtttcctcatctgtgaaatggagatggtaacatgtccccaggaaaaggaaaattcttgctccacgagtgtccttgtgttagtacttcagagacagccctgtccatagactttattatttggaagggggaagaggaggtccttggcactggttgggatggaagccccaggggcaaaggtttaggagttccagggctcagctgtcactgggcagggcaggcacactggcaagggcaggcagcaggcgtgtatatatgtccaccccacggaggaacacagcctcatgcagccgttcatcgtggtcgtgcagcagcacaggtgtgcggttcatgggtgagaagcctagagctgggacccccacctgcaggggtgaggaagagccgttagggaaaagccagcactcaggcccagt

SEQ ID NO: 105952 - DNA, 1696 bp, Homo sapiens
cggaacttttcttcgcggagcctggggaagcttttccagtagtactttccggcgttgttgaccctatttcccgtgctgcaccgcagcccctttctcttccggttctaggcgcttcgggagccgcggcttatggtgagtgttggccgcgcggcatccgatgccatccgcgacttacgggtggcggcggggcgcgggctgcggagaggactggtgaccgaccgtgtgtctgtcgggagcaaaagctgcggggtgggaatggtgcttctaggtcctaggagggggatggcagggaaagccactttattggggaatgcagctttccgggggtaaggagttgatttcagggcatcattacctgggtttgggaggccaggactggcgtttggtcgtgcagagtaagccgagactcgtggaggctgcacattctctgcctgcaggctcattctgaccagaatggggggggcagaggtggcccagcctggcgagcccttaaccctgatctccacttttgtcttccaggtgcagacatggccaagtccaagaaccacaccacacacaaccagtgtaagttttttgggccctgcctacatcccagaccctggcaaggactggttcaggcaaactgggacagagatgaaggggcacgtttccattgtgggcctgaggctgattgatttcacccagtaataactttagggtttataggtttagagatctacttgagatacagagtgttttgcatttagtagtaagggtttcccatatctcaagtgtagctgctgtaggaagtgttggttctcccagacttgccagctgtgatgttgggtggtcttattagaggaaagttctttgttggcttaattccctttttttctcccacagcccgaaaatggcacagaaatggtatcaagaaaccccgatcacaaagatacgaatctcttaagggggtgagtgcactgaatcacatggaagtgtcttttcttggttccaggtgcacagtcaaggcctctcatgtagtttttctctagctttggcttctgcctgagcacagcctaactggcccacccaaagcctgcaattcctttttctaccctaccagacccataataaagctttccttggtctccacagcctgaagtgtaaccctctggtcagggtgtaacctgcctcctgagggcagtttggctatctcccttgcttggcagtggcacttagggtaaggagtggccttgtctgagtgcgtgcagggcacattcccacactgaccagccttatgacctccatctgacccagtgctggagttggggtcagcttctcttcctgtgtcagggggttctaaggattagctgagaaggctggagggtctaggggagagctgagcatgtccccagtctgttccttccctttacttttgctctctgttccgtggagtgaatcacaaactctgagcctcagtttccccatatcccaccttggctataagtcttttggaccagacttggtatttaattgacaccttcttctaaagaggggagggggtgtccctgaggggatgtcaggaaaaaacttggtcgaacccctgctgtaggaagttgaagccccacaaccttggcagacagggcagcaaagcagcttgtaattttgttcttgaaggaggtctgcacagcattacccaggtggcgtattggctccctgg

SEQ ID NO: 105953 - DNA, 1087 bp, Homo sapiens
acccgtgacagcagtcgttaacgcacatggcagtggtaggactagccatgatcacaggcattacagtagttcatgtttgttgacccctcacttggctcaggtccttatgagaccactgtgcataaataggcccattttatagatgaggaaacagacacgggtgtccagtgccttggggctaaagtgtgcagagccctctccacagcagtgctgttgacctctattccaagttgctgccctacccacactgggcttggccaggtccctcaggggtcgggcaagaccagccagccaccatgctgccctctgtgccccagccccacctgcccacccatgtgggaaggctccttgaaggaggcacctccctgacccatgccaatgtgtttcagacgaagcccgctccaagaagtgtggtgtcctggtgcactgcctggcaggcatcagccgctcagtgacggtcactgtggcctatctgatgcagaagatgaacctgtcactcaacgacgcctacgactttgtcaagaggaaaaagtccaacatctcgcccaacttcaacttcatggggcagctgctggactttgagcggacgctggggctaagcagcccgtgcgacaaccacgcgtcgagtgagcagctctacttttccacgcccaccaaccacaacctgttcccactcaatacgctggagtccacgtgaggcctggtgcacggggggcatggcaccaggcccctgctcggctctccacagggctaggtgggagagcccaagcccgccacctctggcctgaggaacccccagatgtcacctgtgcccagaggcccaggctgatcggtgtcggagcgcccctcaccatccttgggggcagggcccgcaggcaaggtctcccactgcagggcttgctggagaggcctcggctcttggacacgtggctttgggcgtccaccagggcctcatcctgtccaggacgctcctttctgctgacagcccagccagtttggctgttttttaaagacacatccacggacctgagtttactttttacttttggcaggtaaatccaagctccctggagcacaaagagtgttt

SEQ ID NO: 105954 - DNA, 1002 bp, Homo sapiens
ctctcccttcctcctgcctttcttcctcctcctccacaaacacatgtttccaattccctctcaggccccctctcccctccccagccccttcccatttcctctctgaggcatccactagcatgtggaactcattaggagaccctcagggctcgtaacccaactctggcccaggcttggggagggggccctgtccgcagcccccatgctgagccacagcggcttccccacatctggcccctgtctggccctgtgcagttacaggctggaaagcacaaggagccagccggtgccggtggaggaagcatggcctggcggccagctcatctcactgctctcctctccagccacgtcccggcgcctggtgagacatcttagccccagcagctgggccagggtggtttctgatcccaccggggcagctggacctgtgtgtgaaaagcagatcccagggccacttgagcaggcccaagggtatggggttctgagtgatgaactcgatggccctcagctttccatctgaaaaatgggaagggaagtccagggaagagaatatggtacgtagaacagccaccaggcaacagagttccacatcctccctggaggacacagtgaaggcccggttccatgggctgttagcggaggttatgcaaaacaaactggtgctattgtcaccaggatttgggaaatgccaggatgaacaaagtaaagacaaccacttccctgaaggattgtcagagcctttaatacactcccatgcagtgcagccactgggccatagagttcatggtgtttccagacatttgaccacatggtcctttttattgcagcatacctggcaggcctgggattctacagaacccactttagaaaatggtacagaaagaacagtgaggaggcagtaaggatgggtcaaaatcccacaacaggaaaagctccctgagtgtcccatcaggaattgttacctgctgggtctgagcaaagggtaggaattgatgggggtga

SEQ ID NO: 105955 - DNA, 1024 bp, Homo sapiens
ttgggtcacctgggttgggcagtccctccttcatccccaccaaggagctttccaggacgttcagcccatcgctgacatcaccctgggtcctgccaaggccctcagctcccctgcgctggactctgctctccagcctgcagggcccttgtgggtccactgccctccccactcccccctcttccttccctcctcacccactggctgccctcaataggatcctcagtaatcccagtcttaaaaatgcagtgcaactctgctgctggctcaggcttctcagaccaccccatgcctgccagaccctctcaacattcttgggggtcctcatactcagcctgtgtaatctggagcccgtcttctgcctctcctgcagggccagtccttgtcttgtgttcttggccttggagcacatctctctcagacccccatctaactcgtcaccaggtactggtgcttcgttctttgtggctatctctggttctgtccactttccttcctggcttctcctgcccccagtccaagccactgtcatcccctctcgttctctcttgcctgcacctcaccttcccacagccatgaacccactcccagactgtccctgtgtagtagccagaggagtctcaaatcccctcagcctagcaccccccagcaccctcctgctctgagggtgaagatgaagctgctaggcatgacttgcagagcccaaccccatctcctgcctcccctgaggccccctcttcttgctccagcacacgtgcctcctatggtccatccctcccgtttcttaaccttggccagctcagggcctttgcacacaccattctttgggtcctgatcctcttcctgcccctcttgcccctccgtcccagcagtgcagcccactgtctatgcgcctgcgtggcatctgcctcgttgaactgtggtgcaccctgtgggctcagccgagtctgcgtattatcatcctgggccaggcacaggccagcgttggggaggtgctttgtgagagtttgagtaagggaagagcgag

SEQ ID NO: 105956 - DNA, 1029 bp, Homo sapiens
acgcagagctagggtaggcagtggggcccggcagccctgctttgttttgatagctcatgagaccccacagcaaagagattccccttttattgtatctgttttagatcttgagaatctgagtgaagtcaaaaccatgctacaggggagattaattcaacatttttcatctctgcaatgaagccaaaggaaagttagacattcagtgcagcacagttgagaccaggggtgttgagtcaatggccagccccaggacgtttgccctggcctgccacaaatgtcctcagtgtggccgggtgactgcgccctctccctgagactcagagcagtggggaccacaccacctctggcccagttatctggctcctgtgttggtggggaggagactggagaaccccagtcccaccagggagacatcatgggggcgcccacatcaaccacaacccgggaagtgagtaaaaggagcttttcatcacaggagaacttaaagaagcagccagaccaccacgtgcatcaatggctcacaccctcccaaacctgaccacaggctgccctatttggggcctcatcaagccccatctgtgcccatggctcccccaacatcccggagctcagccagggcaatggctagaggagtcatgttccccatagtgcatgcctgtgcccagccagacagagcaagttctacatgcatattagctattaatatgaatattgcagtgactatgagaggtgtgttttacaaagaaactgaagccctgagtctggtaacttgcctaaggctgctcggcgagttagtggtcaagtttccctttgaacctaggccatgtagctgaggagccttcgtgcttaccacgtgggaccaaggttccccactaggaatccctcagtggcattttccaagggcccacacccatgaggggaggaaggcaggcatcctagcagcggggccagggcaaggaggctcctagggtaggagagtgggcgggcctcaggtgggcggggttgggcagggaaggcagtattggtggg

SEQ ID NO: 105957 - DNA, 1117 bp, Homo sapiens
ctcaggttttgtctggcttccccattgcctagctcagtgaccttgggcaagtcactttgagtctgtgtgccttactttccaaatctggaacacagagctgataataatacccacttcataggcctcttgggaagctccttgaatagtacctgacaacgccgtgcactgctgatgtgttgggtgctgctcctgttgctgccattgtcgttatccaaggcttgggggccagggggatctgcatgacagcaccagaaatagctctcccaattttccactgcctcatgaagctagacccttccctacccaggagagccattccttggccctcagagcagaggtggcaggttccttccatgcacacacattcactgagcccactctgtgtggtgggccctgtgtgagacccagtcccaccttcaggaagaactcaggactgaatctgccaaggtcagagccaggcctccccagaggagctggcaactggaataactggaaacaagtgggagtccagacaccgggtcaaggccatgggtcctctggtgtggggtaacagaagcagcagcccaggagttcaccctcacctgacgggacactaggcaaagtcgaggcctgacccatgctgagggtctggggtagagtggagatggggacacagagaagttgagacgcgagcaagggcagtgctatcatggctccatcccaggggcgatgagacaaacagcactttggctggcccctgcaaggctcctggtctccggagcaagccagcaagtggggcagcttcccccagccttcccaggccaagaggcctttcagatgaagaggaaaccaaactgcccttgggacttgcacagcatcagaaaccctttaactccagaaatggggttggtgttttacttttttatgaaagccttttttataaaatccatacattatttttcaaaagtgtatttatatggggaaaatagactttggggtgaccttgtgagccgagcaggtgcagtcttcaggcctccccacgtagttgttttagatgaaaagtcctcagagtgtggggatcacatactcatcatagttttcatcctcctggtttttatctgaggcctgccactttcca

SEQ ID NO: 105958 - DNA, 1017 bp, Homo sapiens
gaaccctaaattacagggcaaataaggctgtagtgtatctagtctgcagatatgtgtggtgaattcggtataggcttcttttgagctctgatttgagaaaacgcccgtgcctttcctcttgagaagatggacgtgaggctgagtccacgtgagctcggtgtgttccctgcttccctccccaggggcaggtttagcaaacatggaggtagacagacatggctgcctgtcaacttttcatgaaggcaaattgtcaaaggcctgaggccaggactaagaaacatctgtgtctgtgagtctcctcatccacagttagcaggctgtacagtgaacagtccaatcgaagattcagttgaaaatatttaatcatgggggtgtgtttgtgtccatttcttccagttttgcacagggcagccctgctttggaaatgtagtgacatgccttggttttcagtgagcagtggtcagacatgctgttcacctgggtctgtacaggaagggtgagtgagatagtccagctcttggccccaggtcaccttcttctcccctctcttgcctagaatcaagctttggaccagttcctggatgcttttgtttattacagtttcagtttcaggagcgggctggacaaagggcatggtccagtgttagaaattaaaagaaaagtagaaagttccaccttgagcaggtgttaagaattgtccatttcaacccctaagaggggtgtgttccatctctgctcaagctccagcctgctgaccaggtgtgtgcagaccttgctcctgactgccaagctgtgtacagactcctaagcagcggaggcctgacactccatggactgcatggctgctgcttgggaggccctgcctgggaatctctgcggctctctcaaattccactgggaaactggggctttgggaattgaactgcattgagttatgactctggctttgcatttggaaaatgtaattcccagactgatgatggaccttgtgggcctcacctggggtcttcagccttg

SEQ ID NO: 105959 - DNA, 2078 bp, Homo sapiens
aataccatagactaggtagattataaatatagaaattttatttctcacagttctggaggctgggaagtccaagcaaagcaccaacgggtttagtgtctggtgagggtttgttttctgcttcatagatggctccttctcactgtgtcctcgcgtggtggaaggggctagctagatctctggggtctctttcataagggcactaatccaaacctgatggctccacccatatgacctaatcacctcccaaaggccccacctcctaatactattactttggggttaggatttcaacacaggaattttgggggacactagccctcagaccttgcagcagatttgcttctcatttgggaggacttgggtcgcttaatgagaacacagatttatggtttggcattcactttctgtagaggggagaagtgtgggttcaacggattcttagcaagagcggtgttgtaggtgtttggagcaggagtgaaccccagatttatatgtcttagagaagagcctctcccttctccacttgaccccaatcctggcacctaattttttcaagaccattaaggttggtaggatgcagtgactcacgcctgtaatcttagcactttgggaggctgaggcaagaggctggcttgagcccaggagttcaagaccagcctgggtaaagtagtgagacccccatctcttaaaaaaaaaaaatactattaaagggaactgttggcttcctgcctgctgcaggcaagtcagaagatgcccaggcaagttacccaacttggaaaaggcatggcttcatggagcccaaacccccgacgcctcaagctgcccgtgcccttgggctcagggcatctctgggggtcaagatgtgcctgttaatgtgttgtggctctcactttgctcacaccctttggctgaatagctggcattgcccacagtcctttttatcggtgtgaatgagagcttgatggaaatggcaaagcagaccctcttctaaggggcaccattccacctcgtgtggctattgtggggctttaccggggccaggctttatgggatgacttgggaacagtggggactttctttttcatgtttcctaggacttaccaggtggcccatctctggctcctgggggaaattcattcctgccccctatgccacacagaggaggaactttgagcccagaggtgacctgctggtgaatagcctgggccccagccaagtccttgtctctgggattgaagtgcaggaacgctaataagagacccctgactggaaaagagcaagggggagtctcctcatttctcagtgggaaaaaggagcccagcatcctcacccctgggacagataaccgtgccttcccctgtgtgtgtgcacatgcatgctcatgtgtggacccctgtcagtgctgcttcagggtctcctggtgtctacattcccacaatgctctgtcaagtgcacctcccttgtactcattcatgtaatccccctgcagaccctgttgttccagttctgtggggcgtctccggtttacatgggatgtactggggctgggcacagcatgggggatgccagggatctggctaggcaccttcctggtatgagaaaaggcagcttacaagcatgtctttcctggaaaggattttcaggcagccccactaggaaggtggaaggtggatactagaaacttctggctctgggaaccacttccagaacttagttggcagtaagagctgcgctgccctagtatgctggtctgagcagaggctgggacccagcctgaggtggcgtgtctcctgtaacctcacgcaggttgtctcaattctctgcaccccgatttctccccagcattctgcattgcatcctttgtgcatttttcatttcatgggctcactctgcaaaagaccttcctgcagaagagaggccacagcagcctttgctttgggtggcagaggcctccagataagatgccccctttcatactcgggttgcattttcctccacctttatctcaatagaattcgtggaaagtgctctgggtttcttagtttcagtgggaagagagtggatactaaaaataaaga

SEQ ID NO: 105960 - DNA, 1324 bp, Homo sapiens
ccaacccaagttgtgacaaccaaaaatgtcttctaggccaggcatggtggcccacacctgtaatctcagcactttgagaggctgagactagaggatcgcttgtgcctaggagttcaagaccagcctggtcaacacagcaagatctcgtctctacaaaaaaatttaaaaattagttgagcatggtggcactcccctgtagtcctagtcacttgggaggctgaggcggaaagatcacttgagcccaggagttggaggctatcgtgaactatgatcataccactgcactccagcttggatgacagagtgagactctgtctctgggaaaaaaaaaaaaaaagtcttctgatgctgccaaatgtccctctggtgggcagaattgtccccagcttagaatcactgcaataagtcttgcctcagcggggagcccagaaaagaagctgacctagcagtgggaggagtgtgggaatgtgtctggagatggggctgtcttagcagtgggaggagcacggggatgaggtgggagaggccctgggcatgcggacgaggactattccagcagccttgagtgtgaggactctgttcaactgggccagatttgggcttccaccagcagcagcaatagtggcccaggtgtctcagcctgggtttctaacagaagtcattttgtaggaatctcatttggtcgcagtcttctggaggtgatggtaaacaaccaaaaaaaaaaaaccttttgcctttagcaactacttggttttcttcacttaaaaattggagagtgtttttgcctttcctgactaaaggttttcctggctctgggagaatatctggtcagtggtttggtggctgaccagtgtggctcgacttctcaaagagctcatgggcaccatagccatgccccaagaactcatgaatctaatgatcctctgcctacatcagctctgtctgcaccctgggcctcaggccctgaagccttgtgaaatactcctgggcatttggggaatctaggaagcccatcgggcaggtgtaggtgttgaattcctcaccatgtccccattccagcgtagcagtcgaaagccagaggggcagaccctgcatggaccccttactttacttacccactagcagaccacggcaagggcagccctgtgagcctatgatggtccttctgcccaggaaaaccccctgcccatgaccctttctctgactgcagtacttcagctctcagatcttggaatgaaggttgtccttgagcccactctgaatagagctctgttcactgcagagctattttcaacctctggttgaaattcacagcttattttta

SEQ ID NO: 105961 - DNA, 1022 bp, Homo sapiens
tccacccagaaaggcatttcacactgcagggttgaggccccctgggactcagcagacctctaggtccctgccctctttcctgtgaatccctctctattaggcacttctggtgagccatagccaaggccttttatgctcgctaccctgtttattccttatctcatcagaatgagtgggtaaatatactgctcaattcacagatgagacacctggggcttagtcaccttccccagatgcctggacctgggggcccaccaggctgatgcctctgagcaaagctagaaactacaggtggcagaggactgctggctgcttttccccatttcaagggagggccctgacatctgccgcttgggagtggttaatatctaccagctgggggagaatcccatgttcttgtagctattaggaaaataacttggatgaattgcttcttgttcctttggtcctggctcagcaatggagtatggagcacctttgcttcccagagctgtgggtgggggatcccagcatggcaggatggggcatgagtgggtgaacagctcagcagtgcttagagcaaccacttgttcccatactatctacagactcacgttggagttgtagtcacagctctgcccactggccctcactgtgtgggcctcaaataggggaaaggatgtgggtcctggggtcagagaactgggtttgaaccctggatgtgtggccccaggcaaaacacctggtcttcccaaaccaacatttccacatagtacctgaatacgcccataggcaggctctgatgagagctttgagacccccaccaagtgacttgttaatcctaaaatcattcttggttcagatcagacctctttccttatttgtcataagcccctctgagaccctgagtggatgtaagtcctcttccagacacactttcactgacacacacatgccatgtggtgtcaaccttcaggacttctctaatctgaggactcccaggccaagaggagagctaggtttttagtttgttttgccttgtt

SEQ ID NO: 105962 - DNA, 1064 bp, Homo sapiens
gctgatccatgcattggctgtggagttgctctgtccccacgtagactgcccaggtgtgcccccagcttcacctagaacatgctcttgaccttgagggagagttgtgtaacctgctggggcttctggatacccagcttaagcacctgctcaccaaccactttctgagtcctgctcggtgccagggacttaccacccctgcctgatggagttcatggtctcatgggagatccagatgtgagtcagatagttgcatgtgaatgtgaagagtgaaccgatgggaggcttgtgctgctttggaaggacaaatgaagggggtggccctaattgggaggccaggggaggcttcctggagaaggcagcttccagtaatgagctttaaggtcagggaaagggaagggcaagagtctcccaggcccattggaaacaaggggtaaaaaagttctacggctgggggaatcgacagagctggggtggccggctcttggagagtgagggacaccagaaaagatggtggggttagcctgagatggtagggaaaagagagtcatggacagggccaagctgttgagtgggtgaagtggcaggaccttgagttgcatggaacacagggggcaaaggagaggaacatccatgttggcattggatggctcactctgcaaagacctcatgtgcttaacttagtagcatccgcacagtacctcttacacataggtgctatggtacagatggagaaactgaggctcaatgtggttaagatgcttgctcaggatggatgtggtggctcacggctgtaatctcagcaccttgagaggccgaggcaggtggatcatctgaggtcaggagtttgagaccagcctggttaacatggtgaaaccccatctctactaaaaatacaaaaatcagctggacgtagtggcacacctgtagtctcagctactcaggaggctgaggcaggagaatctcttgaacccaggagacggaggctgcagtgagctgaggtcgcaccactgcactccagtctgggcgacagagtgagactctgtctctcaaaaaacgtcatgggg

SEQ ID NO: 105963 - DNA, 1049 bp, Homo sapiens
gggacgtgcggactcaccggctgctgcagcattatcagtgtgagtggtgaacagcctcctgggcccaagggcagccctggtgggactgtgatggtgttggatgttgtcctgtgctgtagtgcttaaatgggtctgagatggccttgggcaggaaggtgtcctgggtttgttgggattccaggggtgggagtctgtggcatggctggcctggcttggaaccttggccaggagatggagcctggtgctacctggcttccactgagccagtcaatgctcacctccgaagtggcagaatctcacacatactgcagggccagatggggagtcctcactggggctctggtcagggcttcccttgaggaccacttctcaggggcatgccacttgcctttcctggtgatggaggctctgccctccagggccaaggtgacagcccttgacctgtggtaaagggaacagggctgtcagtagaggccagcattggtgggaccgtggccacctctggtcttacagtgtcctccgcagatgtagagtcatagggagggttgacttagctaggggccaggcccaggatggtagcccttggaaggcagggtggcgggcagtgggcatgggctcatgtcaggctccaggtgggagttggagggcgagggcagacttagacatgcccaggatgagttcgctgagagtactgggtagggaactggcctgagagcaagtatgagtgggcagggccatgaggcgccccagttccagggatgggctcagggaagggagctggtgaggggtcattggagaaactgggaattgtgtagctggcaaaacagagatgagcaagactggaccagggccgagaccaggaaggaggcagagctggagttgtttgaagaaccgtggttgttaacctgggactaagcttaaagttcttgggctcgcttccttaagccacacctgaaatgggaaggacatggctggacacaggtgtggggttccgaccccacccacccctgacacacacacacccttcctagctgactcctggtgttcaa

SEQ ID NO: 105964 - DNA, 1043 bp, Homo sapiens
ggaggatctcttgagcccaggaggtagaggctgcagtgagctgagatcacaccactgcactccagcctgggtgacagagcaataccctgtctaaaaaacaaaacaaaaacaaaaacaaaatttagtcacagtttcctgaaaaactcttcagaaggaaaaaagaaaaatgatgtgctaaaagttaactattttcagaaacaaagtataatttaagatatgaccaaataaacagaagtaacattgcctcctaggatgcaatgcatttgttcctgaaaagacaaattagggtattcaaattaaaaaaaaaaaaatcacagcagggcatgtgaccccgggtggttcctgcaggcagatagtaggcactcggggaagagtggctgtggaagaaggtgtgtggtgcccatgtcgtctgttagtctgtgatgtgacttgtgccccacccggttcaggttctcccccgacgggcggctcatcgtgtctgccagtgatgacaagactgttaagctgtgggacaagagcagccgggaatgtgtccactcgtattgtgagcatggcgggtgagtccccagatgctgtcctccacctgtaggcgctcaagcacagagcacagacctgggcatgaggaggcccagtggccttcagtggctggagccgtgggaccagcagccttatcactgctgccccttgtctggtgctttttgcgaggtctggcaacctagcattgtatcttttgctgtgtggatggaagctttggccccatcccacaaatagcaggagtgcttaacctcaagccatgcaattctttggagctgtgtaattatttgtgctcctctttttctccttcactttctggttgtcaggattacaacatgtctgtctggcagcagttgacactcagtcgcccaaactacattttaaagcctcttggtatgttatccatgatgatggctttacaaaattcttgttgggttcttgtagcagatggtggctgttcatattgtgccacatcatcaggagagagaggtgcctacatttgagtagag

SEQ ID NO: 105965 - DNA, 1001 bp, Homo sapiens
cttgtgtctggatggtggggtacagtaagtattaagtttatctttgaggcaataaaagaaagaaataagtggttttcttacatactgtgcaaccagatctgatgcttcactttttccatttcctccctcagaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaaggtaagagatgagttgtgaaccattagtggtagtgaaggggtccttttagttcttttgggccctcagatttgtgtatgagctattattagggcagtatttatggaaacaccttcctcttttagggccagagaggaaggtcttcaagatagacagtcaagggactgtattgcgaaagtgggactttctttctggtgcgtgtgtgggatgtgaccagcttttatagttactacttaatttctgaaaataacctgcagtcttgagctgccaccagctgccttttgtccctttggtctttcccatcatctgctaggataaagatagaaaataatggttttactgcagtaagtgctggtcctagggctcccaagccgtgtgtcttactgatggtcattgaattgcaaccttaactccacaatatataggtgtggctatatctgcagagaactcaaggctccccaaaagcctaaccagcagaaattatgcatatggccaaaattgttttctatgaagaaaattgagattaggaccaggcccagtggctcacacctataatcccagcactttgggaggccgaggcaggtggatcacttgaggccaggagtttaagaccagccaggccaacatggggaaaccccatcccta

SEQ ID NO: 105966 - DNA, 1523 bp, Homo sapiens
agtcttgggagagggaggtcacatcaggctcctgcccaccagctaatcctgtttgagggcttcctggggagaggggcctgggcccaccccgacctggtgctctcccatcttcccttggccctgggcagaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtaggtgagtggccatggcagggctcccaagcctgtggctgggtgggagcagggctggtctgcagtggggcaggcctgctctgggtgcgaaggtcagcaggtttctcaggcctcccaggctcacctcctgccccccaacagtgttcatctactccatgccggggtacaagtgcagcatcaaggagcgaatgctctactccagctgcaagagccgcctcctcgactccgtggagcaggacttccatctggagatcgccaagaaagtaggcgccctccccagggcctcacctccccaggccctatcactccaatctccatgtggggcgctggggtcctgagatgacggcagagcaggaatcgttgctgtcgtgttgatcatagggcatctgaggcccaaggagcaacacgcatggcccaaggctgcccagctgatcggtggctcagaaaagtccaagtcctggctaccatgtcatgtcctttccctgggcctggagacagggaggaggtgaccccagcgagcagagtccaaggcatgcagggcagcaggccctaagctcttgctttcctgggagtggcattccaggtggggaatcaaggggagacctcaggagaccccagggctaggatgtgagagtaaggggtgccccaggagtgggggctaccaggggtggtgtgtgtcagagcccctcccattggggtgaccactgccttgccccatgcagattgagattggcgatggggcagagctgacggcagagttcctctacgacgaggtgcaccccaagcaacacgccttcaagcaggccttcgccaagcccaagggcccagggggcaagcggggccataagcgcctcatccgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacccttccctgttgctgtccctgcatctcgtctgtgtgcccagggtgtccggggaccctgcctggctggcttaagggggctgggtcaggggcctggcatgaacctggcctcccggggagctgagactagggtcccagcacagcccagaaacctttggccacaagaagtggggtcagtcagggctggggcagg

SEQ ID NO: 105967 - DNA, 1011 bp, Homo sapiens
gcgctcaagaaacggcccctggggaagagctggcgcgcccacccacaagcagaccccttcctgggtgcaaacccgtgtacgctgggacccactcctattcggagacccacctggcttggggcgcacagatcgggcgcgcgcgcacgatccgccccacccacagaccaccgtgatcagggcgcacagacacacacgcgcgtcctcccacgcacgctcggtcacacgcaggcccccctctcctgccacagaggaacgcgctggcgtgcgcacggcggatcaatcatcatccttagacccacccggaccgaggcgcaggctgcgcgcacgcgcggccccgagtccccgcctccctgccgcgcctgtcgggggcggggcgccgctgggggcgggtcctgcggcaccgcccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacggtgagggcggatggcgggcgggcagggggcctcggtctgggctctcggaagcgcccccccccggctctcggcccctccctccaccccacaccagccgggagaaagcttcctgttctcttttgcagccgcgggtcgcctggggtgggcacatctgggggagtacggacgtggtgtgcatagctgggagtgggtgtatgtgtacgtacacaactggggtggaagtatctgtgtgcctacctggagatgaatgtggctgtgtgtgcccatctgtatatttttgttcctttccgggagtgggtgtacacgcatgtgcacacgtcttccgtgtacagtcctgcctgtgcacctctggatgtgactcgcttgtgtacatctagggtcattcatgcactggcactagtgactgtttgaatggacactgtaggtcgcataggaccctctttagacatcagtgttt

SEQ ID NO: 105968 - DNA, 1079 bp, Homo sapiens
tcaaaataggaagagaaaccagcccctgcaccaaggaccaatagggtattcaattagatgatgcaggtaaaagcagttagcacacagtaggtgctggataaatgagaggggttatgctgatagtgatggctgttagtaacaatccaaccaacccaatctcatcctcccaatccaaggatctggtgtgatgaccatgggtatacagagatgccatttcctgagatccccggggcaaaatctccacttcttccccagccaaaagccacacactcacacattcctgaaaggcactctccaatgccccgatcaccaagtcttctgccctgatgcccttttcctccacaaactgagggtcactggggcagatgcagcggccattgaggtgcatggggggctgagtggccaccaagccttccaccacggcctccagctgccggcgcaagcaggagtgcagggtgttggcagccaagatggctgctgcaggaccgccgtgcccatcgaacagtgcccagtaatggcctgtcaggaactgcacaggaagggctcagtgtcagcctctgcctgacttccccacttgtcccctgacgcaacctaactaggacctggggcagcagggtaagaacctcagcctgcaggtcgtggccccagcctgtcggagggattccagccaagaactcagactgcactcacctcctctgggcacagggtcagccactcttcttcagccccaaactcacatctccggatgcacagcttcccacaggcggcttgatcctcattgaattcagatttctctgcattgataatcctgaggccgggaaatggtaagcgaccctccagggacacacctatgtccccatgggcacagggacccaagccagcacagggagaagacccctccctctggggcaacagctccccagtgctgtccctaacacacacttagacaaccacgatgtaagcttcctaacttcactggcctcatggctaaggtaaaagtcagggcccagctcctctggagcctacctggtgacccagggctagacggtaagggtaggttgccattcctgcccctgtcc

SEQ ID NO: 105969 - DNA, 1007 bp, Homo sapiens
caaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaagagccttgtgagtcatgaattgctgtacagcttggattaaggatacctattgctaatttttgttacctttgagtggattagttt

SEQ ID NO: 105970 - DNA, 1186 bp, Homo sapiens
ttctgtgcatagatttttggtgtgtttacatagtcgttattctgtatatacaattttatgtcccttttgtacttaacgtataaacattttttccatgttacagtcttaaacagaattttatggctgcagcctcttcgatttgagtttctgtagcatggtttgcctggttcccagagctggagggaggcttgggttgtctcctgttagttctggctcacactgcagcttgctgtaatgctgtgtagacggattgctgggctccctgggactgcctctgactgccccttggtaactaagatttatgggctggtgggaggaacccctagaaccagccttcaaccccaggctgtaatagccatagagccagcaatgactgacggggcaaggcaagcctgagccagcctgaatcttcggagactgtctggcacttacctcaggctgccttgcatcctctactgtttactcaacccttcaccagattgacaacctctagttggaatatgttttgtcctgctagaccctggtttcaggaaggcaagaatactggagtctctctgaggccccagcacccagtctggcagaaggcaattgctttggtaacccatttgcctggaggctgctgctctagctcagcattctcagagctgtagaacctgcttcctgctcttgcctcgccctctctggaccagagaagaaaaccttgggcctgccacattttcacattgctcatgggactctgcaacagtggcggagggaacatcctagcttgtgtgtgacaggccatgcacaggctcttctgacactacgtacgtaggaagagaccccctcctggcctggtgggaggactgctgccgtgttcagctctgctgggagacatgaacaagtaggtaagcatggctgcccttagagcagccactctggtctctgtcctgctcgcaactgaaagacctacttcacccaccccccaggcttcattcagccttgtgacgtgaggaacaacagcaggcatggtagcaagctaggcaagcaggctgtgggggcgagctggctcagcagttgatgtgggtaagagaagcaggcacaggatgctgcccacccttttttttttttttgctcaggcggagtggtgaggtagtggaggctgtggtgaggaaagaggaagtgacactcctacaggctggtagga

SEQ ID NO: 105971 - DNA, 1042 bp, Homo sapiens
tgctaccatgcctgctgttgttcctcacgtcacaaggctgaatgaagcctggggggtgggtgaagtaggtctttcagttgcgagcaggacagagaccagagtggctgctctaagggcagccatgcttacctacttgttcatgtctcccagcagagctgaacacggcagcagtcctcccaccaggccaggagggggtctcttcctacgtacgtagtgtcagaagagcctgtgcatggcctgtcacacacaagctaggatgttccctccgccactgttgcagagtcccatgagcaatgtgaaaatgtggcaggcccaaggttttcttctctggtccagagagggcgaggcaagagcaggaagcaggttctacagctctgagaatgctgagctagagcagcagcctccaggcaaatgggttaccaaagcaattgccttctgccagactgggtgctggggcctcagagagactccagtattcttgccttcctgaaaccagggtctagcaggacaaaacatattccaactagaggttgtcaatctggtgaagggttgagtaaacagtagaggatgcaaggcagcctgaggtaagtgccagacagtctccgaagattcaggctggctcaggcttgccttgccccgtcagtcattgctggctctatggctattacagcctggggttgaaggctggttctaggggttcctcccaccagcccataaatcttagttaccaaggggcagtcagaggcagtcccagggagcccagcaatccgtctacacagcattacagcaagctgcagtgtgagccagaactaacaggagacaacccaagcctccctccagctctgggaaccaggcaaaccatgctacagaaactcaaatcgaagaggctgcagccataaaattctgtttaagactgtaacatggaaaaaatgtttatacgttaagtacaaaagggacataaaattgtatatacagaataacgactatgtaaacacaccaaaaatctatgcacagaaatgtctagggggaacatttaacacca

SEQ ID NO: 105972 - DNA, 2914 bp, Homo sapiens
ttttaaccaagaaaaaaatgttagaaaaaatacagcaaaaccatccagttccttactttttacagcccaggaaggtgggggcctgttggaggtaacctggtggattagcaatgaggacaggttacttattcacccacctcccaggcagcactcctttttttcccttcctttaaaaaaaagggggcggggggtctgctttggtggaaggtggacagtgattattggagaaaaacagaaccattttactttcacatagaggaaagagtgtttctgtctccttagagcatcggggttggttggttaggagagagggctaccagagccactggggttgggcacatttttgctgtggggtgggatgtgaagaaccgttggcagtgaggagatgcttggctttttaaagttgatttatgttctccttctaggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgagcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggag

SEQ ID NO: 105973 - DNA, 1077 bp, Homo sapiens
actttcagaggaacaagtcaaaaagtaattgcttaaaaaaaaaaagtgctagcaattcacagcctattcctgcccgctgaacagaaattgtgatgccttgatttaccccctagcagctacatattcttgagcaagtcataaccctattgtgcctcagtttctggatctgcaaggagtgttgcctgcataaatgtttgtttaggaacttagtaaaatgacatactcctctctctgctctaagaaggccatgagccagctgcagctcatctcactcagcctgggcctgaccagagtcctttcctcttccaagagaaagcaaggaaaagcagcaagcaagcagacataccaggtcaacaggagtgatctatcattggcaacgaggcctcaaacaaactgcaaatgctctggcttcagcaccttatccccaaatgccacaaaccagacatggaagccatgcaagagtgactatcacacacacacacaggcacagacagagtaccaccaagcaaaaagggggctaatactgcagagatggccccaaagtgcagcttgaggaacacagcaagtcatcccaagaccctcacttagctgccaaagaaacagcaaacactatcagctttgcttcagtcttctgaaatgaaaatattaataaggaagactcactaatacttgtggcaaacactattagcagggatgcagggtgtctcctgggctgcaggactccatctgcttcagctgaactcttggaaactacagatgagagatatatgcatacgcacacacatatatgcgtatctgtatgcacacagatgtatttaaatgaaggtgcatacactgtgctaaaatacaaacaacagaaatcaaaggtcatatataaaaacgctaaatatgacatataacacaggcctagaaccagctcttggttgggagctggggaaaggggtggtatcatctgaagactatgtacacaatttgtggtgggcagggaaggcatcagtgtaaacaactcagactcacttcacaatactggcccacaggtaagtgtgatgtatctcatgtacaaaaatagactcccac

SEQ ID NO: 105974 - DNA, 2816 bp, Homo sapiens
tttctccatgttggtcaggctagtctcctgacctcaggtgatcctcctaccttggcctcccaaagttctgggattataggcgtgagccactgcgcccagctggcttaatgtttttaaaagtgttcctagagcttttagcttcaagggatttatttttatttgaattctgtgtctgtaatattgtgcagttagagttgatcagaaattgttgtctggagacctgttttttaaaagcttcattttagttttatgttttttttgtgtgtgttctgtaggtaggctgatatttgtttgtatgcctttcttagttttaattgggaaaagtaaattatatagtggtaaggtcctggattcatttttttttccccattgtaccagcagtctttggttattccacgtatggttgtggcatgtgtgttttagtgtatttcttatttcttttctcttagggcctcatgcatctgcaggggaagccagtttgttcttttgatccagaagggttaattttcgctgcaggtgtcaactctgaaatggtcaagctttatgaccttcgttcttttgataaggtaaatctttgaatctttgagatctttgagctgttttttgttttgttttgtttttgagacagagttttgctcttattgcccaggctggagtgcagtggtgtaatctcagctcactgcaacctctgcctcccaggttcaagtgattctcctgcctcagcctcccaagtagctgggattacacgtgtccgccaccacgcctggctaattttttgtatttagtagagatgggtttcaccatgttggtcaggctggtctcaaactcctcacctctggtgatccacccacctcggcctcccaaagtgctgggattacaggcgtgagccaccgcgcccggccctgtaagagccttttctacaaaaggaaaaatgtggtagatattagagagtggcagagaagtagctcattctctgctttccttagtcaaaaagtaatctaaaggaataggatgggaattggctctagcagaagaaattattaatatgcctggggctactgttttttatcttttgcaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttggggtgagctgacagccttcaagcatggctgtttccatgctcatacttcctatgctaagaattatgttagctggttggtggagaccaacagttactcttgacttactcatgaaggcatgcacttgtattttcttcctgctcatgaacttacctctcttggatttcgtagatgttcatttctcaccaagtgacccaagtttggtatttagatataaaataatttcctaacaataaagttttcttgcccccttgagtatgccttgaatacagagttgagggtgggagtggattgtcaacgatggcaaccacatttggaagcttggtggtgtagtacatgacaaggaaagggtttcatggaaaggaaggtgatgcatgtgctgagtcagtgtttgtaggcagctgtttttattaatggctctgtaagaacaaaagaactgctctgttttgttttagggttatgccaacagcaaagctgtcacactggaggcttcatttactccagactctcagtttattatgattggtgagtttccttttatcccctgtgggggttatttctctggtactatgcatttctttgtttaaattattaactgagacattattatctatttgatagatgttcttagatttctgtatagcacattatgccaaggacatagtgtcttttaactgccctgactggaccaaaatttgagttaaactccacaagcactaccttattagtaatgctaatgtcctggtgtaaccctacattcagtcatcttagtggctgcctgttggtagggtaatggtattcggccccttttttagatgagaaaactgaagttagaacggaagtgacatgcctgtgaacaaatagctagggtcaagataaatttccaaagtgtccttccttcactgcctctcctccctctcaattttgcctgagggatgggtcctaaagcttggcgtatcctcagatctcaatccatgtctcatttccagttgtctttgtattgcgccttgagctgttacattttccgtgaatatcctctttaggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggtatgtgaacagtaagaggtatctgctactcagggacccttcccagttggggtggtgggtgcctcaacaagcacagcaagctgtgttctacataggtacattacaagcatccaagtacatgtttctcaactggtggtttccctatttcatctcctattatttgatctctggctgggctggtcttgcctttcatttttattcttcctagaggtgatcaggaatcatctttgagttccaaggagatcataggccagtttttgctctggaccctaattttaggtccaaactacctgggctatgcttggcaatttttttgctccttaaaatactctgaaccggccttttgtggtttcagttttccattcctgttggtttacgccaaattcccagaaatttctaca

SEQ ID NO: 105975 - DNA, 1206 bp, Homo sapiens
gttgctgttagcataggcttgtggttctctaggtgtggtgcccaaaacagcagcctcacccatcacctgggggctagttagaaactcagattcacagaccccaagtcaggcctactggattagaggctctgggagcagatcctagcagtctgttttaacccaccctccaggtgatgctgatgccacttaggtttgagaatatctgtgtagtcctcacacatcttgataaggaatcatgcttttttgtgtttttttaattgagatacagtctacatactgtaaatgattcctttaaaaatgtacagttcagtggtttttactatatttgcaaagttggacaactatcaccatcatctaacttcagaacatttttatcactccaaagagaaactctgtacccattagtaatcactccctcagcccctaccaactgctgatctacttctgtctttatagatttgcctattctagacattttgtgtaaatggatcagttcatatctgatcttttgtgcctggcttcttttacttagcatggtgttcccaaggttcctccatgttgtcacatgaggcagtactttattactttttattgccaaataatgttccagtgtatagatacagcacattttgtttgtccatccattagttaatggaccatttgggttatttctactttttggctgttatgaatagtgcagatctgaacatatgtgtacatttttgtgtggacatatattttcagttatcttgggtaaatacctaggagtggagtttctgggtcacgtggtaactttttttggaaaaacttttccaaagcaactgtaccatttttacatttccattagcaatgtatgagggttccaatttctctgcatcctcaccaacacttgttatctctcttattatagctatgctagagggtgtggagtagtatttcattgtggttttgatttgcattggaatcatatatttttattttgtagctttaaatttttttttttatactagttgcctttgtttgttccagatatggttgtggtatgtgtgttttattgtgtttcttaaaatggcaattttgggagaacaggtatatatatgtatagataggcagagtggtttagaattcacatccaatttttgctaatatttcgcatcaactcctatttatctcgatgtattgcagggtggtggccttgtccatgtc

SEQ ID NO: 105976 - DNA, 1279 bp, Homo sapiens
atcatctcacattttgcagtaaggttttttttaggccggtggctacatagtggctcatgcctgtaatcccagcacttagggaggcctaggagagtggatcacttgagcacagaagttcgagattagcctgggcaacttgggaaaaccccgtctctacaaaaaatacaaaaattagccaggtgtgatgggacgcgcctgtagtcccagccacttgtaaggctgaggtgggaggattgcttgagccctggaggtctagggtgatcacaccactgcactccaacctgggtgacagagcgaggctccatctcaaaaaaacaaaaaagatttttctaatgtcattccacaaggatagcttatactgctattttggctgtgcctatctcagagcagaatgggcggaagtccttttttccatttttttttttttttaatgagactcttctgcctgtattgatttttagttaagtatgtcatttctacttttcatgcctgtatttcagaagtggttttctaaggaagcagtgtagttaatgattttggaaaagaatgtaaaaccttaggatcctgaggaaacatgtctatgtgatcatccgaatgactggtttatttcttctgttgggatgtttttctgagtgattaaatgaggattctccaaatgtggtgcaagatgaggcaaatgtgtggcacttgtagctttgctgccaagcctctgctgtgaggatgttccctttcctgtctcaagtgcatcctgaagagttcctccagcgctccgtttccttttgcctgattccaggctgaggtagtagtttgtacagtttgagggtctatgataccacccggtacaggagataactgtacaggccactgccttgccaggaacagcgcgccagctgccaagtggggctgagaggatggcgtcaccctgctcatctctgggaaaccaggtaatggggaggaagtctttttcttcttagggcaggtgagtcattgttagcagtagaataactagaaatacttcgtagttgtcattcaagaagtttgaagatgttttcaaggaaaattgtgtagtgttcaagttatggaatatacaaatatccctattcccctattccccctcccaagttaaatgccctcttattagaaagcacccctgtgaacccctgggatgactcgatgctttcaacccctttattcctatgttctgtttgccttcagaatgttctttctatggttttctttctgcattttggtaccattttcccttagctgtttctcaaca

SEQ ID NO: 105977 - DNA, 1025 bp, Homo sapiens
acagtactgaatactgtaggcaattataatatagcgttaagtgtttgtgtatctaaacatagaaaaggtgccgtaaaacagtttaagggatttaaaaaatgaaacatcggttgtagagggcagctctattataatcttatgagaccattaccctatgtgctgtctgttgttgataaaaatgtcatcacatggcacatgattgtattttttctcaaagcttttgaacattgtagtaaagactgaattgaatccccagatttacttttacttcccacctaaccttgccactaggtgttctaaggtggaaagcttcttcagatggctgttgcttgagcgttgttttttcccttttggaagaagttgtttctttccagtgttagaacttaccaaaaatcctcacctttgccacatcattcaagtgcttctctttatgtggagatcccagattttgatgatggagaatgttcatgattttctgtctctattttcttatcagaccaaagagaaccctgtacagtaagaaatatggtgtggacctcatcagatacactcatgcagcaaacacagttgtttacagctctaacaaaatagacggtaagcaagcctttttaggaagttaaggtcatggtttcctttgttaaatagttcatggaatctttgtgactacttctgctttgtgactactttagtttaagtattttcatataatgttagtaatgttaattgcattgttttgactgaaggaatgctggaagcaagccattggcacttttgaaggacttgggactgagtatgaaaagtcttcaattcagagtggggagtggaaaaaggaaacaactaattgtgtttatgatttgtacttcctgacacttaaaagaacgcttttaaagccgggcgtaggggctcgcgcctataatcccaacctttgggaggctgaggtgggcggatcactgaggtcaggagttcaagaccagcctggccgatatggtgaaaccttgtctctactaaaaatacagaagttagct

SEQ ID NO: 105978 - DNA, 1310 bp, Homo sapiens
tttcatacttttttttttctattacactttttggtccactttgaattccaattctgatcatgaaacttttatgttgccacaagtcatctggagacccaccatacctgcatcttttcgcaaaatctaagcacagcactttgcctttttccctgggggtccttgtcagccctcctcaccgcacgcctgtggacttgcagctccttggagccaaaaactagtttagattaaattcgttttacccttagccaccttccccaagaaggcttgctgatgtttggtttaattcggtggaccctggttttttcagacttgattttgtcacctagtaacagatattattattattattattattattattattattatttgagatcttgggtttttctccaccttctccagctgttcctttttcctttttttttttttagactggtgtccttcttttggaacatatctcttcatttgtgaatttgattatctgaagtaatgctagtttggactgagctataatggtatccccccagtttttttccccactggggctgtgagaaagtattatgtaaccggctctggatctgcctgcagtttgtggcagagtggtctgcagtggtggtcttaaggaagagggaattgttagctggacaaatagttatttgagtcagtgttactcattgagtagatggatttctgtcctggtctggtcacttgaatcagtttagaagacgaagtaacatttaaaggtgtggtagtagggtcagcattgtggggtcctggaggagtaatttgaagctggcttgcatgaaatgtatagtgcttatgcacagattagaacctcttcccagaacctgagggtggagatgtatatcctcatttaaaggaaatgaaggttgttatagcatttctttgcagtttgtccccaaatttggcgtaattttgatttgggaaggatgaccttgacatgaagtcctgtctttcttttttttgtttttttttttcgggtgggggacggagtctctctccgtcgcccaggctggagtgtagtggcgcgatcttggctcactgcaacctctgcctcccgggttcaagcgattctcctgcctcaccctcacaaatagctgggattacaggcgcctgccaccataccctaacttttgtatttttagtagagatggggtttcaccatgttgaccagactggtcttgaactcctgacctcaagtgatccacccgccttggccttccaaagtgctaggattataggcatgagctgctgtgcctggccaaatcctgtcttgttaaaagtaaaat

SEQ ID NO: 105979 - DNA, 1375 bp, Homo sapiens
tagctgggcgtggtggcgcgcgcctgagcgagagactccatctccaaaaaaaaaaaaaaaagtaaagaggtcgaagctgtctaagcggacgctgcggtggactagcggtcaagcttgcctgcgagcggctcacctgagtcacccccaaaaccggcctccagcagcatacccgaccctgcagtaccccctcccacgcagcctgcgatcgggacgcctgcaggaggcgccagagtcttcgcgggggttgcaatcccgcgcaagggcccccggctcccaaggcatccgcaaccttccgatcccccgggaaggccctgcacgtctcggccgctccctgccagcagcccgccccgccactacactccgccgcggccgcgctgacgtcaccaccccgcctccccgccttgctccgccgttcccgccccgccccctttcccggcgtgcgccgcggctgaggctcctcgccctcagcttctgcctgtcgccccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaagtgagtgcggcggaggccctgggcccgagtctcagtgcctccctccggtggcccagcacaggtccctcggcctgccctccgtcccgacttcagcccccagcctattttgcacgcgttcctgccagggccgcctccaccccgcagccgtccaggagaccttttatttttttcttcttaaaaaaaaaagataacgatagtcataattttataatattatttgtatgtcttcggtctcctttgagcgctatgcatcacttgccaaaccccaccttgaccttgacctttaaacgcccggtccgcccaccctgggcccaccaggtagcgttttcagctcctcaggctgtcaaaggtgctggtctgctccggcctcgacgcaggactgcaggggctgcttttctgcctccttcggcagcgtcagctctctcttgtgctctctccactgtgacctcgattccgccctggc

SEQ ID NO: 105980 - DNA, 1055 bp, Homo sapiens
ctagttttatgttctgacacccatacacagtcatgcagtcaccaccacattcaagatttggaagagttgcactatcctgtttgtagtcaacaggattattttaaaggttctatcatataagtgattatttgccttaaaagaaagtttatctctaacaaaggaaagcagtatttgaacagaaaataggaaccaagcttcctaaccttaactttctgggcaaggggttaaactcaatgccaacctatgtggcttcacagatctgtatcttgtgtgaagctcctcaaaaggttaattgcctggggtttccaacaatgaagatggggattatttatttttgctttctttagctaaagagaaacaaaaacgaggaaaggctgtgagacatttcagtcgctattaggaaggttattatccagagacctgtgcaatggtaaaaaacaaaatggaaaccctgggacagttggggtctttctagaaagaactagaggctgtatcccaaccccctgggtaaaaggagagccaggatccttatacataaagagaagttgttctctaagggaagaggcaagttcctggctaagtctggggtataattgcctcctgacaaagagcagagcttctggctacaatttgttctggggtctggaaaaagccggtttgagtgaaacctgaatagatggcaactttccaaactgcacacaatggaagaaaaaccctccacgtcccagatcacttgctctgcttccctgtaattcctgtgcctttatttcagaagctagaaagtctgatacagcgtctgcttcgaatagtttagaaggcaacaaggacagatcgagtaccatgttctagaactgtcgggaagtgaacacacccagtaagatgatgccatattttggtccatgttaatctacaaaaataaccacagaaacagctgtaatctactgaatgttgccagccaaaataaatctttgcagggtatttttcaagtattgtacttcctataccttttccagatttcaccgttaagaccaaaccttcctcccaagacttgactt

SEQ ID NO: 105981 - DNA, 1028 bp, Homo sapiens
gagagaaatggaggtgtcccagccactcagaaagcctatagtagagctggaacctcaattcccagcctccttaccctgctcagtccatacttgctgatgaagtcagcttgcaacatttatggtaggcatttattaaagtagatgcaatagtacatatgtagtacagatgagctgtttgggtctttgttgttcctatacccctctacagcttcctgaccttcgccccaaggcttctttagcttttactctgcccagtggggaaaatggctatgggctcagttatgggagcctggcctttgcctacttcagcccttgggctctcaccactgtgggtggtgtgacctaggacttgtttttgttatcttggaaccagaaggcgtgttcttggcagggttgggtctggccaactgtgtgggtagaagggcatccttttctgtcctgcaattgggcttcatggcacatggcctcacatggtgcctggggacttttctaaggttccaccatgagccagactttgccctcactcctgatttgaacctaaacctcttgctgaactggtcctgcatactgagattcctcagattgcttgccctgaggatgtgttctgggtttgacctgataaacctgcagcctcctatagaccctgacttcccaggctcctaatcccagtctcatgagataatgaaatagagaagactggaggtcaatgggctcagggtcagttggtgggacaatcaacagcttcctggcagcagaggtggtaaagaggcaaggaaggagtgccagaaaggggcgttgccccagggtaacagcgcagaagtgcagggggtggaaaaggggtgggatgggagcccactggtagaaattactccctctgtcaatgattaactcccagccaaaggggtgacctgggaggagggcccagctaataggaactttggacttgaggcagagtatccagagggccggcatgtggtctgcagaagaggaggacgtggctgggtggcagggctggtctccaaggacga

SEQ ID NO: 105982 - DNA, 1049 bp, Homo sapiens
ggctaccaggctgtggtgctgagtgcagccatgcaaggtgatgtaaaaagtatggcccagttctacgggctgctggcccatgtggctagaacccgcctcaccccatccatggctggggcttctgtggaggaagatgcacagctccatgagctggcagctgagcttcagatcccagacctgcagctggaggaggctctggagaccatggcatggggaaggggcccagtctgcctgctggctggtggcgagcccacagtacagctgcagggctcgggcaggggtggccggaaccaggaactggccctgcgtgttggagcagagttgagaaggtggccgctggggccgatagatgtgctgtttttgagcggtggcaccgatgggcaggatgggcccacagaggctgctggggcctgggtcacacctgagcttgccagccaggctgcagctgagggcctggacatagccaccttcctagcccacaatgactcacataccttcttctgctgcctccagggtggggcacacctgctgcacacagggatgacaggtaccaatgtcatggacacccacctcttgttcctgcggcctcggtgatggcataggtcacattttgggagttcagaggaggcctacaagggcaaggtcagatggcagagcaaggttggtcctcagggcctctctaagccttagggcccctcctctccttggccttggctgtttggttaactgtcaccttccactcagggcctctgctctatatctattcccttccagccagactggcagatgggggcttccccctacccctgaggatgaggacaagcccctcggccagttcagcgttcccgtgcttctcccttgggcagcctctctcttgagcccctcaccctgtttctttctgtgaagcgagaatgtctgaaaataaataggaccatgccatgggttctcagtgcgccttccctcagagtgaggcctcacgggggagccgctgggaggggagcgtggtacggctgcagccacagtaccagggcctggcaggactcttaaca

SEQ ID NO: 105983 - DNA, 1031 bp, Homo sapiens
ctgtgctcaggggagagcacgtcagggttgtagaagtcctccaagatgttcatgatgcagcgccggtcccagtcatcagtgacacggcccccgtaattgatctcccctgccgtgtacttgaggacctatggggtgggtgggtgagggctcccctaagtgcccagtcccccaggccccagtctgccccaggcccaccttgtaggggatgtcatcatattcgtccaggaacatcttgagctggctgatgcagatgcgcagatctccatccgtgaactcataggggatgttgaagcccaggggcccaaacttatggcgctccagggcgttcccatggaacaagcacagagacagcagcagagacttgaactccatcacctgggggaggtgggaggcaggggaggtgaggagcggggacgggggcaggtagggtaggcctgcaccaagtgtgcctcaccttgtggcaggagttgaggaagtcttcaccaaggctactataggacttcagcaggttggccctgacaccgcgtggcggctcaatggtcatcttggagccgttctgcaggatggacactgggaacttgttgctgggcaggctggtgagccagaggcggaagtccctgtgtacctggtggccatggctccacgtgagcattgagacccatatctggtggccaccctgacaccaggctccctcctgcccagggaccctgaggtgggtcaggcgaggctgcacagacaactggttaagaattgggcttttggctgggcgcggtggctcacgtctgtaatcccagcactttggaaggccaaggcaggcgaatcacgaggtcaggagtttgagaacagcctggccaacatggtgaaatgccatctccactaaaaatacaaaaaattagctgggcatagtggcgggttactaccagctactcgggaggctgaggcagaagaatcgcttgaactcaggaggtggaggttgcagtgaaccgagattgcaccactgcaccccagccccggtgacagagtgagactcc

SEQ ID NO: 105984 - DNA, 1035 bp, Homo sapiens
ctgctctggatccccattcttgatgtatatgggcttggggcttgcagtgaggggtgctgtgtatgggtgactattcttggtttcacagctgatacccaactcttgtgcaactcatgccttgctgagcgtgctcctgaactgcagcagcgtggacctgggacccaccctgagtcgcatgaaggacttcaccaagggtttcagccctgaggtaggctgcagtgccttcatcctggctcacagccaactgggcagatctgaccctgagggccactgggaatgctaccacatgatattgggtactattaggctgtttctttttcaaatgattgtttatgttacatttgactcttaaataaattgtgtaaggccattgtttttagatgcagttgcggggaaaggacacaggcctagggagggaggagagtttccttaagtcagaccatgtcagaaccttctctgtcaggacttttcctctcaggccatgttgcttcctagtgtccactaattaccatgcaaggccagcacagtccatctctttggggctccagagctcttttctgcccccaccagccttttaagaaagttcgtctgtgttccttccgattcctggaatgcctccaggctgctctctgaagctttgccttccacccatagtcctacctgaggagaaattattctgatacggccttattttcttccccgtagagcaaaggatatgcgattggcaatgccccggagttggccaaggcccataatagccatgccaggtgtgtgggagctgtgggagctgatgtggggtgggagtagggggagtatcattttttgggccctgactctgtttttccccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatggtaggcaccatgagctggaggcctgttgggtgtctctgcctac

SEQ ID NO: 105985 - DNA, 1039 bp, Homo sapiens
aaggtagtcaaagggtttttacaaacacagagctcttccctgtttctcttacagaaatatgcccacacatcagcaaagcatttcttcaaatgtccacagtgtaacaatcgaaaagagtttcctcaagaaatgctgagaatgggaattcatattccagacaggtagtgggaaccccaaagcaggaactgagccagggagtgggttgcctagatttctagagaggaggtgagtgagaggatagttcagagaatgagagcagcagaggcactgataagaaggaaggggaggagggagtgcttttcaattatcaaaacagaagggagggggaagaagtttgcgggggaatggggtgcttgttgctgaaaagggcatttggggaatcagaattccctggggggttgagttattggattccagagtggaactaaggaacctgcatgcatgttccattcatcctgcttcaaccctctcccactgccaggccacttggccagccttgttggaagtgttcaggcagcctactgaactcttgctgtgcttagcttgggctcttcctaactcctccctgatggacaaaagtttcaccaacccattatgttcttattcactgtttcttctcccactgcagagatgctgcctgggaactcgagccaggggctttctcagacttatatcagcgctatcagcactgtgatgcccccatctgtctgtatgaacaaggcagagacagctttgaggatgaagggtaggggaaggcttctggctagaaagagctctcatcagtgctatcttagagttagaccttggcacagttattagaagtaagaaattcactcttgtatgcagaccttaggataaacacgattgctaagtctcattcttgaccagcccgactcacttgtgtgcacgtgaacacgtctcccctgcaaggtccgcttcaccttgtgcccagtggagagacattcagagccaattcctttcctaatctacctttcaaggggttacgactgatggcaggcttctgggatcagcactcatc

SEQ ID NO: 105986 - DNA, 1062 bp, Homo sapiens
aattgtattggtatttctaatgctaattggatttaaagaggccaaatcccaggtgcactagtttggtcactgattttggtactactgcagggaggggctgtgcaagtgctgacaagcgcctgccctcaagcttcttgccttggtcttacataggcacagagcctcttagtctgtggttgatgtgcttatgtttttttacagctcgttgcagagagaaagattgataaaaatctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgtaagttcctcatcgggttttcacctgtgcctgcaaacccacaactgccaaacttgaggcagcaaaccaggggagacctcagctttgaggtgggctggggtttgaccctaggttagaagatggaggaacgtcaccctggttaggaatgcattgtggccagaagcatgttagttgacagatttgccgtaaattagactaaatgtggccacagagatgctttcctccaccacaaggcattttgtttagcaaaaatggcctgtgggtgtttaagctaggtttccatccagatggatgaggctggattagaaatagctgacacctgggatagactattgttgagttgttggtgcatagcccaaaactaattaagggattagtctgtgatggtggaatatcaccatcttggggcgtgtcatcagggtccgcgctgccagggtgctaaggttgagggtggacaccttcctgtgatgggagagtgtgtcatagaacagctctgtactccgtccttgaaagaggaacaactttcataggttgccggtgacagaatgcgttgtcagactttaagaagggcacttaggcagtgtgaaaccacaatatttgtgcttttgagacggagtcttgctctgtcacctaggctggagtgcagtggtgcgatctcggctcactacaacctccgcc

SEQ ID NO: 105987 - DNA, 1144 bp, Homo sapiens
tcagccttttctccaggctgggagctctctggggaatgtttctcttaacttttatactgtctgtatcctctctgaaattgttccacatgtgttctgcctcttgtgttgctgacattggatagggtggacccagggaaccctatttggctatggtgtgaatttttttatttttattttttgagacggagtttcgttcttactggccaggctggagtgcagtggtacgatctcggctcactgcaacctccacctcccaggttcaagtgattctcctgcctcagcctcccgagtagctgggattacagatggcccgccaccacacccagctaattttttgtatttttagtagagacggggtttcactatgttggtgaggctggtctcaaacgcttgacctcgtgatccacctgcctcagcctcccaaagtgctgggattacaggcatgagccaccacgcctggccatggtgtggatttttaaaaattgagatataatttacataccataaaattaactttttaatgtgtacaattcagtagtttttagtatattcacaaagttgagcgaccatcaccactatctaattccagaacatttcatcagcccaaaaaggaacctgtacctgttagcaggagcttcccatccctctgtcccccagcccctggcagtcactaatctactttctgtccttatggatttgcctgttctggacatttcatataaatagaatcatacagtgtgtggccttttgtgactggcttctttcatttagccttatcttttcaaggtccgttcatattgtagcatgaatccattggtccttttatgacggagtaatagtgtattatttggatatgccacattatgtttatttattagcagttgatggatgttaggtttgtttccatttttggccattgcaaatgatgctgctatgagcatttgtatgttaatttttgtgtgaacttatgttttcatttttgttggatatatagccaaaagtggaacctgagttatatggtaactatgtttgactttttgagaaactaacaaattgttctccacagttgttgcaccatttgacgtttccatcggcagtgtataggttctaatttccccacattcttgcttaacacttcttgtcc

SEQ ID NO: 105988 - DNA, 1350 bp, Homo sapiens
gggaggctgaggcaggagaatctcttgaacctgggaggcagaggtggcggtgagccgagattacaccactgcactctagcctgggcaacagagcaagactccgtctcaaaaaagaaaaaaaaaaaaaaaagcaggttgtgctgatgcacacctatagtcccagctacttgggaggttgaggcaggaggattacttgggcccaggagttccaagctgcagtgagctatggtcataccattgcactccagcctgagtgacagagcaagaccctgtctctatttaaaaaaaaaaaaaaaaaaagcagttatcgcttttcctcttgtaggatgttgggaggattcaggagccttcagtggctcagggcatgacccagtatgaattaggatccaagcgtgttgtttgtatgactgggggcttggccttgtcctgcccttcatcacatcatttaaaaaggaaatccttcccgcttctttcttgggaccctggggctgagtgttactgttgtgaatctggaagggatgaacacaagaagaaaacaagtgttcactcttttcctgagacacatttgaaacgtgagaggaagtggaaatggtcattcccagggagggttagctctgggtggtccttcatcccaccagggtgataagagcctctcttccagaaaaaacaggacttttctctctgccacaccctctcctaggaacacccagagccagttttgggagctgctggcttcccaaaagcccttagagtaatgcagctctgctggcctcctgggctacagtgcccttggccctatggactggagtcgcagcattaggctgatttcccttctgctttggaggagacatttcaggtatccacataactagaatacttagtttccctttctaagcttcttgcttcattgtaggtttatgccctcctttctttagtttaacttcctagagagatggcactggcacaacagaggggatagatagcggggaatgtgaccccagggactggggtcaggtggactttctaagggcaaattttgtgttctctgcaggagataaatggcatcaccgcggcactggctgaagagctctttgagaaaggtatgtggccacatgtccctgaaatactgagcataagttgtgtagttttatgaggcggccagaggcacaggatggcatagaagtcactctggagcccacctacctcccctgtaggtggccaggtctgaggagctgtggtccttcagtactcttgagtaccatgtcaggggctcagcccagacttgggctgtgttccaaagcgctgtggtgggtgctggaaggtgggtagcacactgctccctcgcacctg

SEQ ID NO: 105989 - DNA, 2385 bp, Homo sapiens
gcagctgtatgccgtcacggagcagctgcagcagggaaagcccacgtgcgccagtggggatgccaagaccgacctcgggcacatcctggacttcacctgtcgccttaagtaccttaaggtaaagctgcagcagctcagtcatggagagccccgcagtcggtgggggtgcaacctgcgggggactggctggcagtttgtgtgaaggagaccatgggggactgttggtggaaggaaggccgcccggttattcttggcactatgcttctggctgtgggcaccagggggcggtcgtgacccagtgtcccgttaaattaagtcctggcctgagcctgctttgttgaagacagaagtggtcaaagttgtcttcaacttgtcagctgctgcagcactccccgatgggcatgcgacactgttcccaatttaagccttatctttggcttcaggtttctggcacagaaggaccttttgggaccagcaacattcaggagcagctcctgccgttcgacctatcaatattcaagtccctgcatcaggtggaggtaaggcccagcgctgcacagcatcctctcgctcccaactcagaggctagagagtgtttgtgatgttgggtgtcctaatttaatcataaggtgctgtgctttcgtgtttggcagtatgtgacaggttctgcgtaggtgaccaggccctctgaaggcggagaaagagaggcctctcctgtccctggctggtctgcacacaccttccctggcgtgagctgcaggggcggttagccagggtggagcaccagcacctggctcattctaggactcctcataggggcagggggcatgtgtacctcaagttcaagtcctgggaagtcatcctgggggtcagacagaactaaatacaagtctgtatttcccaaggccgattggcaaagagctttgaagatgccctgccctctggggcacccacacaagaaacactctgcatctgtcactactggactctttggtttgcgatgccaattttagcatttttgaaaagaaaagtcagtaatgaatacaaaaaaagttttaaagcataattttttgagcatggcttttgtgttctgccctgtggccccatgtctccttgattgaatcttcccaacagccccgtgaagagggcacttttatttccattttacagttggggaaactgaggcttgggcagataaggaagtttggccagggccacacagttaatgagcggaaacctgggatttgaattcagctgagactgcctccagagcctctgctgtgcactgggctgttccgtctacagtggtctagggaaacttgtggtgtgccctgctgccgattgaggacagggaagtgaaggggaaacccgacccagccctgccaagcaggctgaggctctggatctgggtcttgggtgtgcttgggcaggtggcttggggagtgtgctttgacctgtggcctgcccctcctcaccacaagacagctcagttccatggagtgggggctgggtgaacaggaggatccaccccactcgctgtgctgtggaggccccttgttctccccagcagtttccatgacccacactttatgttcacctgccaagccccaggcagcccttacagaggaaatggaatttgtggtccattgtgagtctgaggggccaggcacctttcttactagatacttcagggaatgtttggtcggcactgacactgggaaaaagagacactttggtcttgagtggcctcccatctctgaggatttgggttgcctgtcattgtgcttttgtatgggggtaggaaacacctgcatctggggacttctgacggagcaaggattctgtttctgagatgcagctgttctttgttccagataagtcactgtgatgctaagcacatcagagggctggtcgcatcgaagcccaccttagccacgctgagtgtccgcttctcagcaacctcgatgaaggtaagcttcacctatatcctgcctggggcaatgtctgtggatcagggtcctgggctgtggtctccaccactaaggatgggtgaggacactgctatgtctatcagtattcagaggctggaccttctgtggggtaggcagacactcatggggggcctcccagcacttgacagcccctgggacactttagttcacatctgcataaaaagttcgtgttgttaacaggacattttaaggaacttggcttctttccccaaaaaataaaaaatgtcattggtgtttttgtgttgttttgtttttgttttgagctagagtcttgctctgtggcccagactggagtacagtggtatgatctcagctccctgcaacctctacctcctggggtcaagcgattctcctacctcagcctcccaagtag

SEQ ID NO: 105990 - DNA, 2933 bp, Homo sapiens
aagacagaaggatggcttgagcctgcgaggcagaggtggcagtgaactgagattgcgccactgcactccagcctgggtgacagagcgagactccatctcaaaaaagagaaaaggctagaaaaggcatcaccaggtcaccagggcaaaggccctttgggcttgaaaagcattgctcctaaagcagggccaggacttaattctaagtggctgttatgtggtaaattgttcagctttgaacgatttcacaatcgtttaaagacataggaaccaaaggcatgctttaatgcaagtttacttccacatgctaaatatgctccagcccttccttaaattctgcaacgactgtgttcccagtgagtgttgcgtgagggcccgagtgtggtgctccacacagatgtttttatgcaggaagtccttgttcctgaagcctcagaatttgatgagtgggagcctgaaggcacaaccctagaaggccctgtgactgccgtcatccccacttggcaggcattgaccacgcttgacctgagccacaacagcgtctccgagatcgacgagtctgtggtatgctctcagcagcaggtgccaggggtttctctggccccaccaaaccctgagtttgagtatttaactcagcttttttaggaaggaccacggaaaacctatatctagtgctctgtgcattgcctgccattttaagttaattacaaaatgggggctgggcgtggtgggtcacacctgtaatcccagcactttgggaggccgaggcgggaggatcacttgaggtcaggagttcgagaccagcctgaccaatgtggtgaaaccccatctctactaaaaatacaaaaattagctgggtgtggtggtgcacacctgtaatcccagctactttgggaggcttaggcaggagaatcgcttgaacccgggaggcggatgttgcagtgagctgagatagggccactgcattccagcctgggcgacagagtgagactccgtctcaaaagaagaaaaaaaaatgggatcatttaaaattggtgaggtagtacttagaaccaaataaaacataataatttcatgtaaatttggtaaactataacacactaaatgatgacatttgctccaaagagtggagcagaaaaatcactccttagatgacagatgtgcccatgaaagaatgacacccagagggcatttgggcagtaagagtgtcgttcccgtgtttgcgctgctcagggagtgtgggcagggttgaagaagaacagactctcttctctgtctgggaccttgctgtgtgtcattttcacaagccaagtgttccatgaaaactgagtagtgcccagcactgggggccctgtgtgtgcctttggatgtgctactggctgggcagcgggagatgtcccaccagtggtcctgcagggacggcccgtgggagtccatggtcgggaggaagcgtcctggggtgcccgtccactgtgtcggggaccgtgtttggggtccagccccctacagtaacatcgggtgttcttttctttcacaagaaactgatcccaaagattgagttcctggacctgagtcacaatggattgctggttgtggacaatctgcaggtagtgcctttggagaccagtgctgcccgcacacactcccaaggccccgccctgagatttcaggagactgacgcagccttgggaattggccaggggttgtaagggcaggggttgctgtcttcgctttaggatcccagcaatgcactgagtgattgttgctctagttccaaagaattaggaagcatgagtaaatacaaaccaggcatgatgatgcacctccgtcctgaaggtggacagccatgttttcaacgcccaccccaactgtctgcaggggtgccactgtgctgtggcatgtgcggcagagaagagggacttcccttcctaaaataactgtcagagtgacttgcagaactgggtagtttgggttggaaggcccatcctgccattagtgtcaggcccctatctttggagacttgacctgagccactttacgctgttctccacgccgctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacaggtgagcccaaggacctcacagttttgggatttctgtgccttggtgtgtatcatgttaaagaagaatgttaagattcctttcatttaaaagagaccatgaaacgtgttggcgtgttgctgaagtgttaagagaagggaccaaaggggatggaactcataccttgcagatggaggaggtccggagcataggcagcctcccgtgtctggagcacgtgtctctgctgaacaaccctctgagcatcatccccgactaccggaccaaggtgctggctcagttcggagagagggcctcagaggtgagccccagcacagtcagaagagcccagggagaccttcgggatgcagtcaagtctgcatgggcggtagggggatatatgtccattgttctacccttgcctgcttcagaaagaggtcctgtcccttaggggcttttcagttctgggaagtccactatctccccaggaaaaagctcccttgcatctcctgcccctactgtctgggataacattgtttattctaggaaagggtcagaaataagatccttaaaatattcatatctcctggacaacctgtggccatagtgcctgactgtaaacccaaagggtttgcctttgccagtgtagcccagcctggtgtctgctgcccctcgcggtgtctgtgcacctgccacgatgctgaccagacaccctt

SEQ ID NO: 105991 - DNA, 2903 bp, Homo sapiens
catcagacccagcagctcccctcccactgtggctcccgcatctgcctccctgccccagcccatcctctctaaccaaggtaatcgtgtatgtatcttgcttctagtggagccacacagccctgcctgggccccctggctgggctggggttgggggagaggtgccagcacctgcttccaacagggtcagacacagggagggcagtgccttctgcaggctggtcctcgcggggggacacatggcaggggtgcctggcctgatgccagctgttgcttgcttggtgaggactcccaattgctctgatgcccacatccagctcctctaggagaccgcagggtgtctgacaggccctgaggctgccctctgaacaggctcggggctgttggctcatgggacccattccctcaccggcagcacaagcaggttggctcctggttacaggaagccgggcttgtgactttactgtctggagcccgaatccctgtgcagggaaaagcttgcttttatcactgcctcatctctgtggggtgacccagccccagaacaccatgtttgtggggccaagatgggccatctctgtccctgtggacccatggaagaccaggcccattcgtctgcccactatcttagcgttttcaaagggctttcacctctgaacccaggcatcctcggagatgagtgagtgaagcaggtctcatgagcgtgtctgctggcccggcccccacggaagaggggagggtgtgccgtcccgagtggagccgaggctcgggacacgcaggaaaggacgccgcctgcccgggctcctggagacgcagaacttggtgtgaggtcttgggaaaacagttcaacccgatgttttaagagccagaaaaacattcccaccccttgacctggtaaccccactggtggggattttctcttagagggataagataccgggaaggggaggtgaaatgctcaccactgccaaaacacgggctgcaactgcaacatcggaggatgagagggagagtcggctgtggtgcagaatgctcagcagccctcccagcagggacaggaagactgggcaggaagaggggagaagcattcaagttaaggcaaaaggcccaacgcagagcagcacactgaggtcacacctgtgagatgtggaagagaattcctgagcgtggagcgatggggttaggtgccaggatgattgcccattttgcttctgtcagactcttgactaaggatttctggttgcattttattacataaaagccagggaggttatatcacggtgagaaagcttccctgacgctgcctcctgtagcgcagccaagcgagcctgtggaggtaccatatgactgtaggcctctggggacagggagctgcatctgcttctcaaggccagggacacagccatttctgccagcatctgttgatcagtgagtgagtgagtgggcaggtagagcaggagccagtgaagagcaggccctggatgggtggggatgcaccatgtccccaggctgcagctgcaggcagccccccacattgtcggagaagcctctgcaccagctcagccccctcctcactccccttgtgccctggggacactctgcagaggggcactctgcagtctgtccccgccatcgctggacttctggacatggcctccagatttgcacctcttaaataaaactgcagtggatgtctttgtgtgcacctctctttccttttggtgagaaacagcaaagatcggacccctaaggactctcctgatgtctccgctctatccgctgagtgccctttctgaccacttgtttgtacaggccacggtccaggacgggagcagatagactgtccctgtccctgtccacatttccttggtccaaacagggcttgtgggaggtagtggcaaaaggtgttggtctttttctcactgatttggaggcctccccgtgtgttttttcagccgcgtgttcctgggtcttgcctggatggacagggttttttagcgcgtgggagcagctttgctgacccatgcctgttgcttccagcctgattcccgagaagggagcctgcttgcgaaggaactggcactcgggcctgcctgaagggggcgctgtccagacaacacccagcctcccgtcgtggcaggcgctgtcggagccatggatgattgtgaccaataggggtggtcgccagagttgattgtccagccaggcccaggggctgagaggaggctgtgtggagaggtggttaggagccagggctcggtcagctgagttcgcatgccagcttcctagctgtgggacctcaagcaacttgtagcccctctgaagctgttttctcaactgtgaagtggacgcaccctacttcattgattctaagaggcacgcatttccaccttgtgacttctctgaaactgaggtgcgtctttcagtcagtggcgtctcatagtcgctgtcagccagctggtattcgagatggagtcgtggaaaacccgtggacaccttccgctaggaccaagatggcgccacctgccgcatcttagatttgatgaaatgtggtaaataacgagaggcatgcatgagcgaatgctggggaggcgcttggcactacccagagctccacagaggtggtcgatgagggctgccctttcccacatccttagtagggggttcaagatgacccagactgtgcccctggggagcttggagccatgcgggaggatgagccatgtgctggaggagaacagggtaggatggtgtggggcttttgtagactgtctagagcagagaaggtctgcagtggaggtggtgtctgaggtgaatctcgaaggtgaataggagttgaacgttagcaggcagagggtggattgcaggagagcagcggcctgggcaggtgcccagcgtggcccatc

SEQ ID NO: 105992 - DNA, 1582 bp, Homo sapiens
cgtgggggcgtttgagcttgggcccacctgcctgcctcgcttgtgggcagaggacccaggctgtgtgagttgtcctgtcccggggagcagctgagctggtcgggggtctcgacctgtggggctcagaggactcggggtcatttcactgggctgtggcgatgctgggctgtggaggtaggcctagggctcctgtaggcctcagtgagactggcggccgatgcccagtgttcaccctgctggcggcagtcaggaacatgttcacaaaggctttaccttcaagtggtctagaggtgatctgaggtggagtaacaggtccagataggctacgttcataaaacagcttcagcggggtttaggaacactgtgcatttacgggacgcagtgggtcagagtgctgctgtccgtgggaggtggccccagggcaggtcagtgggcacgtcctgtggtaagtgggactgtggatgtgggctcaggctggactcagcagccctgctggataccaaggcctgcaagggctggccccctggtgaattgtcccgtgccctgtgtatctatgagtcctgcagagatgacaaatcaggggacggggtcatgtctagtcaccgtctgggaaaatgctccaggagtgaacacatttcaggctcttgatggatgtacctccaaactcttctctggatgggtgggccagcttgcatgcctgtgccggcctctgcccagcgaggtcagggccaggccacacagtcagtctgactttggcagaagttgagaggcaacacttgtctcttgtttcagcttgcctttctttgtgtacttctgagagcgagcattcttttcatgttctatccgctggccgttcttctgcggaatgtctgttcacgtcctttgcagtctgttaatgaggtttccaaccttccctcatttttgtaatctgtaagaactttttacagactagcgatataaatccttgtcaaatattgcaaacacttttctcatttcatctggttttaatctatcctggtttttaaaaaatgtgtctgtggaagtttaatttttatgtagtcacatctcagtttttttccattgcatttattctcagaatgcttctccctgccctgagattagataagcagtcatttgttctttcttgagttattttgagatttcagttttaacattttcttctataatccatgtggctgggttttgggatctggctaacccccgccatgccagtagcctgaggggcccagccccacttgttgaacagccgctctccccgccccacccaccctgcctgcctgcccacccgccctggtctctccaggaatcatgttcgttcaggaggaggccctggccagcagcctctcgtccactgacagtctgactcccgagcaccagcccattgcccagggatgttctgattccttggagtccatccctgcgggacaggtaatgccctcttcccgcttctggggaccatacatctgtgggtggactcttctgcttggggttgtgtgcagtaggaagtggcctagctggagctgaggcagatgcttccagggtttggcgtcctctgctttgt

SEQ ID NO: 105993 - DNA, 2005 bp, Homo sapiens
cccacttccctgccccggaggccaccaggggtgacaagtagattcatgccctggagtgttccttctctccggggcttatggcagcaactgaatgacttagaagtccatgggagtgcttctgttgtgggaactcgtgtggtctgggcatagctgtgccaggcacctatggtccaagcccctagaagcatagactctgaccaaactggcgacccagccttccagcaggcagcactggctcccaccagggccctcatcctgggaactgacttggccatgtgggaggcttgggagacccatgggttggtttctcagggtcagggtgtagcagtgggctccagatgtggcaggtgggaggtgggaggggcccctcccagcatgccactgacctggcctctccctgcacagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccaggtgagatcaagcacagctctcaggggccccgggggcatgggtctggcatgtgtgtgatctcagcatctgcggctagtgtgggctgggagttgctgcgagagctgggccccctccccccctgcccctcgccccccccgggcctccctctacatcaccaccccaggtttggtgccaggctgctccttatctc

SEQ ID NO: 105994 - DNA, 2284 bp, Homo sapiens
tggcacggccagtcctgagggcgaggccaagcttggcttcaggtcagcctcaggtccctggacttccctgatgtcggagtcctcagctgagctgctcacagctttgaggacctgggcagtgaggtcctgagttgccctcccctggccatttgtgctgtgtcaccacctcctgtgccacttccagccccaggtagacctcccaccaacagccatctcccacccctctcttcctctctgccttgaagcatacggattcattggtgagccaagaggggcttcccatgtctccttgtggaagctgtgggcatgtccctggtatgtgcaggttgctagggtggtggagctgacaggaggccccccgtcttcaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcagggtaggcacagggcctgctggggctcaggagcttggagtgtgtggttggggcaggcctggggggtcattctctggagccagctgtgtggcttcaggcagcagtcagcgacttggctgcagtgggctgagagttccttgtctgaggaagggagctgtcatgagggaggggtccatggccagatgtgaacgcagaatgcactgagccagggcctggtgactgcttgggaacagccagtgatgagaaggggttaggcagcctttgcccctggggctgcacaggaagccctagccagcgacctggtgactcccctgagctggaagaggctccgactccagagggcattgcctatggggctttgcacgggtggaagccaggccagccaagaggacctgttcctgctggatgtgctgcacacctaggaaccttgtgcttgcctgccaccgcctccctctgtccctttctccatcacacagatttctggcatcagaaaaacaccgactacaacaacagccctttccacatctcccagtgcttcgtgctaaagcttagtgacctgcagtcagtcaatgtggggcttttcgaccagcatttccggctgacgggtgggtgaccctctgtgctttgtcctatttcgggtgaaggccagcatcaccagtgggcttccaccttccgtacgtgggtgggttatcatagacagttatctctgtgctcaagagccacttcttaaccggggtgggaggaagcagcttcaggaactgctgagagagcagaactcacgctccagggctcagagcaggaggtagggtgtgcggcaagcgctggcccggacagaagcagagtgggccctggtctcgggcaggatgtttctgactcacatttcctgaggagagaaagctaagctctttgcctaatgtctctgtctccccttccagaaaaatgcctcagctcttccggcctgaaggaatggcctcctcccgggccccatgattctttcctgtgtgggccctcctggccctggcctctgggctgaggcttgctagggactcggggtggctctaaggggcagggatagggctggggagcgccggcctgtggccctgaccagccccttctcgtgcaggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacaggtacccctgtctagctcaggctgcagacaggctgcctggacagacgtcatgggccccagggtggctctctgtgccccagaaccctctctgcctctatgtctctcttttctcacttagctggccagggttttatgtggggcttttcgatggcagagtctccactccagcagtccctcaaccatctggcagacacatctccagtgcctgctttgggctcctggcctgtgggccccacacttggagcatcctctcctgcctgtctcatgccggggtctctcggttggcttggggcccttggtgctcccagccccaccaggggccggttccaggctatagcccaggtggcatctctctgcagggaagatggagaactacgagctgatccactctagtcgcgtcaagtttacctaccccagtgaggaggagattggggacctgacgttcactgtggcccaaaagatggctgagccagagaag

SEQ ID NO: 105995 - DNA, 1186 bp, Homo sapiens
tccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtctgcatcttctaaaccaagggtcactgggatcccagcagggcttccgtccagggcgtggtcacatgggggagggagggtgccctggagacaggagggtgaggggttgggggaaaggaaggagcagccctccaggagccagatgcttcttggaacatgggaggcatgacagggccatggcctctctggacagtgccatgctgggctgtggctaaaccatgagcgcagggcaaacaagaaactcctcagggcacccctgacacaccagccgctgcccctctgcctgggtgcggggcatgccaccctcttcaggctgtcctgcagg

SEQ ID NO: 105996 - DNA, 1051 bp, Homo sapiens
gggggaagccagcagctggccaggggagcaatgtggaggtggccaatgcccagcctggcctgcaggaaacacccccaccctctcagccctgcccacttctctgcctcccacccttccgcacccaaactctccacagccctcgggcccaggtgcgtcccttcagctctgagggcgctgctctcccctgccttggcatccagcctcagctaaagagggtcatacacctttgtgagaaacacatgactttcttccctggcagctttcaggcagttctttatgcccagtattctgaagctgctttccactgtgtgttggatcctgcctgtcagtcactaggagtctgtcagtctcctgccctttgagactctttctcttggtctggggcctgcctgggcctctgcccctccacttgaacttagttcagcaattggcttctcccacaccacctgtttcccccagcgcttccacttctgaggcttggaatgcacagactgcttcaagaactgtgcttgctgggtgtcaattattctcgcttttggggtgtggactcctaccctggtggctgctgcctgagcactagtctggtgattcctgctctgggccgctcagtttctgccaccctgtgagcttccccagttacatgtgggcctggctgagtgtctccatctttctctggctccaagatgctggtggccccggtgaggtctgccattggtctgccaggtccctctgcactgaggcaggggaggccagcaaggacttcagggctgcagagccttccctgcagtttctaccttacaaacagggatctaatccctaacctggggtacgtgtgagaccacagggagaaggccctcgaggcatgggcaccatgccaggcctgtagggcaccttcctgcagcaggcagaatccccttcccaagtaggaggggaaagtgacaagaaccagggcccagggagggagcagcaaggccatgggaaagggcagccagcatccggctggatttgggctgcctctggggattcgggagggaggactggtggaggacaa

SEQ ID NO: 105997 - DNA, 2888 bp, Homo sapiens
tggcagcccgatcggcagaggggctccccctcccactaatgttcctgagccccagtcccagctctgggcaaggtagaaaagtcagcatccatggcctcaaccccctagtctggccatacagagccagcccctctgggttggagtcctcagtgcccacatggtatcctcacacataatcccagggaggctgagagatgaggccagggggcagggcagggcagctgagaggagcagaggaggcgctgaattgtggggggccagacagtggtgttcctgcacgggttttgagcaagtgggaggctttgctttgtagagcatcccaaaagcagctgttctggggctaggcggtgaggagttgagtgactgctgccagggttctagcatggccttgtgtctgatggggcttagtggtgagggcctggagtagtcacgggctcagtatacctggtgggctataggagatagtgtaatgtaggcaggtgtaaccatgaggaggagctccagccaggggctctgccttaccctaactgcgtgaccctgggcaagtgacttctctctgggcctgtttgaccatctccagcactggaataagaggtgccattgtggggcgtttctgaggctcacagggctaggtccccacagagtgctcaggagccatagctgctgcagggatcatcatccccatcactgcctccctgcatctccttcctctagacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaaggtgagacgggggtccttgccaccaacaaacccagggcttggaggctggccagacccaccttggcctaagctcagggctgagtcgtggggctcccctggccctcttgcctggcagctgccctgggcaggtggctggattgaccccctggggtggccacccagccagcaggtctggcagggctattggcttaggcctggcccctttcccccggcagtacccagaagggattcggaagtatgactacaaccccagctttgccatccgtggcctccactatgacattcagaaggtgagtggctggacctgtataggggctccctccttggcctcctcttggtatggtcattacccctccgtcccatccagctggggttctggcatgggctgaaagaggctggcttggggccacggtgaaactgcctcctcaccatccgtcctgcctccctggcgcccccagagccttctgatgaagattgacgccttccactacgtgcagctggggacagcctacaggtcagtcggctctgccccaaccccacccccgccccaccctacactgctgttctggctcaggactaccttggactgatggtatcttgggcctgctcaggggcctccagcctgtgccagacgaggaggtgattgagctgtatgggggtacccagcacatcccactataccagatgagtggcttctatggcaaggtactccataccccagcagccagcctgccccatggacatgtgcccatgtcccaaggcagatttggggccctcgtctccagcactgaaggggttggggtcccaaagggtgtctgagacaatggccccctccccagggtccctccattaagcagttcatggacatcttctcgctaccggagatggctctgctgtcctgtgtggtggactactttctgggccacagcctggagtttgaccaagcacatctctacaaggacgtgacggtgaggatgctgggcctgccctcggatggcaggaaagactaagtccagccacagtgggacagccccacctgggccctgctgtaccctcattgtcctccactgcccccaggacgccatccgagacgtgcatgtgaagggcctcatgtaccagtggatcgagcaggacatgggtaagtgtggacagaagccctgccgtggccggcctgagcaggtggcaggactgaccctcacagactcatctgccccattagagaagtacatcctgagaggggatgagacgtttgctgtcctgagccgcctggtggcccatgggaaacagctgttcctcatcaccaacagtcctttcagcttcgtgtgagtccagcccctgtggatggagggacagcagggccagggctctgggtggggagggcaggcacggagccgccctcagactacttgccacctgaaactcctccacacagagacaaggggatgcggcacatggtgggtcccgattggcgccagctcttcgatgtggtcattgtccaggcagacaagcccagcttcttcactgaccggcgcaagtatgggcatggtgggggttgcagggccagggaaggggaatagaggccccaccccaatgaggggactgaagcaggaggccaacctggcccttgcccactgcccaatgtgcttggggtgagaacacccccttgctggcatgggtccacttgagcaggtgggcctttacggaggagggatgggggttgcccggcccgtggcccagccacagactggaagtcatgccctttacctgcaccccaggcctttcagaaaactcgatgagaagggctcacttcagtgggaccggatcacccgcttggaaaagggcaagatctatcggcaggtaagggccatctggggagagcagcatgtggtgggggcatggggcctagctagggccccaggctgtgcagaggcagcctctgaagaagcagcacagctccttggccctgagcagcctcacacaggcaatggct

SEQ ID NO: 105998 - DNA, 1127 bp, Homo sapiens
ccagggtgccgctcctccggggaaacacccagtggggctcgccagggccccggagcgcaagggccgggcggcttttcgcgagaagctccggccgttcatcccgggggcctctggggcgccccgacgcccgggggcgggcgggaggtttgttccccggctcggtctgcaggagctcggggctcctcgagcggctgccggagtgctgggcccccgccgacttccttcggggtcccgcctgccgtgaagccgcggtggaaacgcccccaaccccttgttctcggccaacccttagttggggcgggagagtgctgtggacaaagccagcgagcggcgccgggcggaacgggctcctagggacggccggaccaaaggggacaccggttggacttcccagacacacctcgatgtcgccctggaggtccggccccctctcagcccgggcagcgaaggctgggagaagccaagtcacccccgccccctggagcccagactagggctgcaaagggcacttaacctccctgtccctgctctctccctctgagaaatggcgtgaggaggctgaggccccttcttggagggggccggctggggcgcactagtgaggccccagagctgagagtgctggacatctgcctgcttgtctccgtgggtctagtggggccctgcttctgcagcagacagatatggtttgggtcgtgaccctatcactgaccagttgggtggtcccccagcaagtctcaccctctctcaagcatgaaacgcagtcctggggcctctctgtcccagggttgggtgatgactggaaccaggccaagcagggcaggagagcttccggaggaacccccaggggtgacgtggcttttgttgtctgataaaacaaagtagccctgtctggaagattctaactggctagacaggggttttcactccggctttgtggggtggcggagaatcacttcttgaccagtaaaggcaggatggtaaaggcccctgaggaatggtcattttgaagccttgggcatctgtccaccctcgaggtcccaggttgagtttgtgtctgtggaggggcggcccagcgttatttaagaagtctttgctctgggcccggagaagaccctcagagtatc

SEQ ID NO: 105999 - DNA, 2864 bp, Homo sapiens
aatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtgatttggattaaccaggtttggttgttctgttaaagtggtgtcagatgtttcaagcagatttaactcctgcaagccctgatttcatgctgacaaggttgtatgtgactgccaatttaagagaacaaagctccacagatggagatgaaagtcagtgtccagacctctggttcagggctcgggctgcattaacacagagccaaatgtagtcagactgcagactgaagtgccccacgccacgcctcaggctggcagtcaaggaattcct

SEQ ID NO: 106000 - DNA, 2372 bp, Homo sapiens
acattaattatttaggctgccccttttattaaaatttttgaagtctccaaagaaacttctttaaaaaaaaaaaggtcatttattataattatttgattactatgaaattatctgacaggcttccccaaggatcttctgcaaagaatcctaatcctgcaagatgtttagccaaaaaacattttgtggcaaaaccagtttgagaagcattccaaactctctctcttggaaacttatggtgcatattcccgtatgtgtgttgtcaggcccaagggcctcctctgtccttatcaaggggagtgctaaccttttctcctttcatacagcatgcatattcccatattaaaggctttaagaccaccagtaaataagctgttttatattatctggcattttctgaaatttgaccaggtatttatgtagtacctatgaataccctaaagaactaacattttgcagaatattctttggaaaaccctagtcagttccataagaacctagaactttgtggagctttgatatttctgaccttattgaaagttaagacctactacaccactgagctggaggagtgttgaaaatcaagctcacatgaatattgctgagcgagcagcacagcagcagcagcaaggcaaatggagccagtgctggatggctggttatttagagtgtgagcaggagagagatacctgaagacactgtgaaggtaaaaacactggagtaggaatgaagagagggagaggtgatggcgtctggaacatccttccaaattcaaaggggagtctgaaagtgagtgagaacctagtgaggggggagttatatgactcagcagcatctacctgagacataaaatctgaacttttgatgttttctctcattgaattcaaagcccaaagtttagagtttgggtagccagtccaatattcaatccacaggccttatttttttttttccatttcatttttttgctttcccactttactgtgtcacttgtataatgaaaatactagaatttgaagtggaaccctaggtcgatttttttttttttttttactgctagctcaagtaaatagtttgttcaaatggccttcgtttctcatactcattgtacaaagggtctgtaaactaggacagtcttagtgatgataaggctatgcaggcaactctgtcacagccaagaggcctttgattgcttgactttcatattcttaaaggaggactggagctgtagcttcttgattctctgtaaagccatatgacctcgagctattttccccctcctgaaatcagtggtgttgagttccatgttaaagggtttatgtgtggcagttggagtgtgatatcaggagttagggccatagggttgctggttctctctatccttggacaagtgactgcctgtctcccagcctccatttgcctatgtgatgagtggggggatcttctatttatgaatggtgagacaagaaaccctgtatggtgggagctttggaaatacagcatttcaggagttcttcagtaggggttcagtctgctagctcacaaaaagactggaaacatgatcattggagctcccggctctggagatgcagagtagctcagggccggggagtggggaggtagcaggatgtattctacggcccagaactgccacagcaaatgctctttttgcattttgaatgaagtaagagggattctggaattttcattgatttagggtggtttatggtcagtattgaactgctcagcttcaggaaacctggttctttcagtacattgtccattgctacatacgtgtttatttaattctctgcttctgatgattgtagcctgaagtataatgcatttttttcctttggggtttattaaacatgacttctttgcttcattagaatgtagaaattagttgtttccctaaaaccttctgaaggaggcagtcagctacttttcccttacagagttaattttcttcagctgctaaactccatgacactcgtgatgagtcctcaaatcttagtaaaattgggtacaaagaatcaggaaatatatatagtaagtaacaattgtaccaaaaattataatgggccatggaattgcttcatattgaaattataaataatctgtaatgctattaatactagaataatggtagcgcttctcatcttcagggtgcctcgtgagattaaccatggtggttatgctggtgacgtgtttacataaaacctgtgctttctgaatgtgtgttgcagtcttaacattcttgaaatctttgcagaccagttctcaagatgggataggaaagctggactctaggttaccaagtgaaatcggcccgactcctcctgtgttgagactagtcatctactgttccttcc

SEQ ID NO: 106001 - DNA, 1287 bp, Homo sapiens
ttttttttttttttttttgagacagagtcttgctctgtcgcccaggctggagtgcagtggcgccgtcttggcttaatgcaagctccgtctcccgggttcacgccattctcctgcctcagcctcctgagtagctgggactacaggcgcccgccaccacgcctggctaattttttgtatttttttttttagtagaaacggggtttcactgtgtcagccaggatggtctcaatctcctgaccttgtgatccacctgtctcggccccccaaagtgctgggattacaggtgtgagccaccgcgcccggctggcttctgaaattttgagcagttaaccaaatgtaatgttttgatgcaccataagacctttctgtcttacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggtaaatagagcctaggcacaactgtctttcgaagcaagggggtgtttcaggaatgcacgcgcacagacaggttttactcttgttcttaccacttgcacatgaacttttattttggggactgttccaaatggcacccaaccagtattttagatgctagccttgtcctgactgagcagagcactgcccctgacttggcctctgatcctggtgttgtattttcccctgcaaatttctccaaaatattttgctactaaaaattgcatgatttttttctttcattgagccctgtaagcacacatgttgagctagggaattattgtacaatgatgttaaatataattttaattaaaattcgtctgaaaagggcctcttaaaatcagtgatcttgtgttacagctcttggtaagccatatatttaaacttcaggctgagtctttgctaaagtgcttggtttcctaggtcagtcctggcctatactgtgtctgtattcatagctacttctaaggtatttgggtcttttttataaagctcaactgcctttattttccttttattctaattaaatcactttgggcagtgagctgtcattcaagaatttggtggttcttagccatttagagacaaatacttgagattttttgttttttgttgttgggtttttgtttttgtgggttttttttaaatatcagacatggacttagtaaagaaa

SEQ ID NO: 106002 - DNA, 1059 bp, Homo sapiens
taccaaaaaaaaaaaaaacgaagaaacaaagatgtgtagggcacctgcacacgcatgtgcacacatgtgcgcacacacacacaactataagaaaattattgagaaattgaagacataagtaaatgaaagttatccatcatatttatagctggaaaattcaatattaaaaagatgccagttccccccaaattgatctattggttcgttccaattccaatcaaaatccagcaggtcttgataatttttttatactttattaaatgaagttttctaaactttcatcttttccctgtcttttgggggcttggtaggagctccaagtcaggacacagagataccacctccattccaaagccaccaatcacttttactctttggttgtaagcagaattattattttttcctaatgtctatttttccttctataaaatatggaaaattgtaattatcccttttctgaattaaaaggcctttgaattatgtaaataaaagtgctgtgtaagttcaaagcagtgatagtaattgtagctattttaagctttggaaatgtttctgacctgtttttcatatacatgtttagtaagttgttagctatgaacattcctgttaaggtcaagagcaaaatagggatgttctggctgggtgcgatggctcatgcctgtaattccagcactatgagaggccaaggagggcggatcacctgaggtcaggaattcgagaccagcctggtcagcatggtgaaactctgtctctactaaaaatacaaaaattagctgatgtgggcgtggtggtgggtgcctttaatcccagctactggggaggctgaggcaaaagaatcacttgaacttgggaggtggaggttgcagtgagccaagatcgagtcactacactgcagcctagcgacagagtgagactccgtctcaaacaaaaaacaaaaaaagaaaagaaacaaaatagggatgtccttatcacacttatttaacattgttctagaggtactagccagtggagttagaagaaacagaagtctaaaataagaaaagtaaggaggtgaaaatt

SEQ ID NO: 106003 - DNA, 1661 bp, Homo sapiens
cctgttgcacactctcaaagcaccacatatttccttctccttagcgtatatatcacatatcggtgttcattgtgttattgtcaggtttcacccttgtattccctgctcaaatcatagtgcatgaaacatagtagggcctcagatatttgatgaacaagtaaatgacaaaaggatgacagtatggttgaatggcaaacacagcagagtctggtatagggttgggtaggagaggatagtggctaagaacagtagttcattccctgagtcccagctctgttagttgtaggtccttaggtgaatgatttagccctctaggcttcagtttatatctgttcatcattcagtaagcatttattatacctactatttaccaggctctgtggatacattagtgaataaaacagacaaatattctttttcctggggagcttttttctagtgtgaagacaaacaacatcttgaataagtaaagtgtatagtatgttaggtcatgatacgtgccgtagaaaaaatagaggagaacaaggggagaagggggtcccatggtcagagcagggagaatggtttatataggcctcactgagaagtcggcagctgaaccaacacttgaagaaactgagaaagtgaataatgtgaatatccagggagaaaggattccaggcagtgggaacagccagtataaacacctgaggagaaacatgccaggcctgtttgttagtaggagagtgagccattaatgagttagtaagagataagtgccaggggtagggtgcatatcacatagggcctcagagaccattatagggatttgggtttttactgagttaatggagtgccatcgattgtttcaagcacagagtgacatttggtttagatcttaataggattgctctgcctattggttgttgagaatagactgtaaaaagtcaaggcagaagcaaggagatccaccgcctaggatgctgttgcaataatccaggcaagaacaatcatgcttcagaccagggtgattgcaaaagatagtattttgaaggtcaaattaatagtattcttgataaatggagtgtggggtctgagaaagataaaaaagtcaaggatgactcctgtgtgtaagcctgaggaacaggaaggttgcagttaccattaactgaaataagtatgatacttcaggtcaggaatcacgataatatggagcaataataatgtcagctttatgggttagttgtcaagaataatggctttcatcaaattctgaaggggtgaaggggcactagatttttttttttttttttttttttttttgagacattgtctggttctgtcacctaggctggaatgcagtggcatgatcttggctcactgcaacctccacctcctgggctcaagccatcttcccacctcagcctcccaagtagctgggactataggtgcacactgccagggctggctaatttttgtatttttagtggagatggggtttcaccatgttgtccaggctggtcttgaactcctgagctcacgtgattcgcccaccttggcctcccaaagtgctgggattacaggcgtgagcccctgggcccagccagggatattagatcttgaccttcaaaaagattataaaccactgtcttaaaggaatgtctgccactcatgtgatctga

SEQ ID NO: 106004 - DNA, 1026 bp, Homo sapiens
gagactatgtctcaaaaaaacaacaacaacaacaaaaaaagcatgtttatatcacagaggctatgctattcctttccatgttggaataaatcaaaatagtaaaaattttagatctatcagttgttttttgtggtttgttttcttttgtttgagatagggtctcattctgtttcccaggctggagtgcagtggcacgatctcagctcactgcaaactccaattgccaggcccaagcaatcttcctacctcagcctcccaagtagctgtgaatacaggcgcatgtcaccaaagacagctaatttttaaatttttttggaaatgagatctcactgtattgcccaggctggtcttgaactcctggctcaagcagtcctcccaccttgtcctcccagtgtgctggggttatgacataagccactgtgcctggcctaaatcttatcaattgttaatgttaagacattaagggagcccagtaaatgtgatagagaggaagcttgtatagaatttgccccttacactatagtaatgcatgaatgagtctgcttttaaataccgataaatcctctccagtttttttgtttgtttctaaaggcagtgggaattgagagcaggagggagacaggataaaagcatcttgggataatattgttttatgaaaattaactagaaatttcaaatagatacttgataagtcttcgtttatttcaataatctaattgttttgtttcctagcctccttcagagtttctctttatgtttttttgtttgtttgttttaatttacttttttcttgagacagggtcttgctctgtcgcccaggctggagtacaatggcgtgatcctagctcactgtagcctcgacctcctgagctcgagtgatctacccacctcagtctctttgagtagctgggactacaggcatgcgctaccatgcccaactaattttttattttaatttctttcttcagttgagacaaggtctcactatgttgcccaagctggtctcaaactcttgggctcaagcga

SEQ ID NO: 106005 - DNA, 1025 bp, Homo sapiens
aaatgttcatatgttttcaaagagcaattgtaagctaaatggaattatttgtttttataatttaaagggtgtgtatataataagtccattccgtagccaaagaaatacttctaaatctctggtcatttattattttttgttaactgccagaaagtctgtaatcagttcagcttttgtttggttggttggttatttgctttttttttttttttttttgattgattttcagaaaattcacctaactagttttattcttatgccctccccaccccccaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggtatgcagataatagccacacagaaaaaattttacatctcaaaacacctattccagaaaataaatgaataaagtattcaaacttagaaaaagagcaacaacacaaaaccttagccaaacaggaagaaggaaactataacagaaagaaatttacactttcaaaactgtacattataatttaaaagtaaatcaggccaagtgcattggttcacgcctgtaatcccagcattttgggaggccaaggcgggcagatcacgagatcaggagttcgagaccagcctgaccaacatggtgaaacctcatctctactaaaaatacaaaaattagctgggtgtggtggcgcgtgcctgtaattccagctacccaggaggctgaggcaggagaatggcgtgaacctgggaggcggaggctgcagtgagctgagaccacgccactctactccagcctgggcaacagagtgagtctctgtctcaaaaaaacaaaaaa

SEQ ID NO: 106006 - DNA, 1014 bp, Homo sapiens
gaaaaaataagaaaatcagcagggtgtgattgcacttgctgtggtcccagcaacttgagaggctgaggcaggaggatcacttgagcccaagaggttgagggtgtatatatatatatatgaggggggaaaagtagcatgcattttttaggcctcattacactttattatttttgagtattatttctcctgtggataattatattaaactgtagctgtaaaaataagcacagtgctaggttcatgtcatggcagagtggattgatggtgtatttcctaattttgcaaagaatgtgtgatttctgagctggacacagtgacttatacttgtagtcccagctactcaggaggctgaggttggaggaccactttggcccaggaattcaagtccagcctgggcaacgtagtgagacccagtctctttaaaaaaaaaaaaaaaaaaaagtgatttctgttaacaatgattctctttctcttccccttcccccaccccccatttttgaggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggtaagaaactcattaaatcccaaagtctcactcattccctaggaataaaattttaaaacacagaaaataatcgatgtttacaaaattaggaactctgttttaagctattttttaagccgtgtctatatagctatatgaaaagatttgggaagaaattaacctgaacttcgttgtgaaagaccacttgctgcttacactatttggctataatgcagttaggttaagtttttaatattgccaggctaatttttaagtatgatgtttttttaaggataatcattacaaattttcagtttgttttttaggtaataatgtgtgcttttgtgtgtctgtctgatacacacacacaagccct

SEQ ID NO: 106007 - DNA, 1137 bp, Homo sapiens
ttctaagactccattaaatgtgtcatattcgtgtaataacttagtgaaatgaaacacattaagaagcattaaggtggggatgaagtatatcagagattatctctagaattacttgattcgaaacgacatacgtacttctttgtgcctttcgatattatccaaaatgtccatatgatcatatattagtaaggtgatgtttttattctctacatcctttgtgtagttatatattcatttaaattaatgatggttgtaattcaaagatagttttgagtagaggctattaggaatgtgaagatcatactattgctgattcctgccttcgcatgttgcaaatggaattaaatgtattaaatgtattattagtatgtgttgtttgaaccctacatctgacttcagcatccctttggtgagtacctttttcctttatttatttatttttttacctaagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtaagtttgttttaaatcaaaggacagtttagtgagatatgactgtttgacttctccttgctcctcagggaagaaaattttaactcagacatcttaagcctttccataataattgttcaatatgtcaataaatgtaagtaagcacccatcatatgaaaaacataggacctattgggcaagtgtcacagttgagtcaaaagaaatacagcttctaggtcgggcgcggtggctcacgcctgtaatcccagcactttgggaggctgaggcgggcagatcacaaggtcaggaaatcgagaccatcctggctaacacagtgaaaccctgtctctactaaaaagatacaaaaaatgagctgggcctggtggcgggcgcctgtagtcccagctactcgggaggctgaggcaggagaatggcgtgaacccaggaggcggagcttgcaagggagccgagatcacgccactgcactccagcctgggtgacagagtgagactgtctcaaaa

SEQ ID NO: 106008 - DNA, 1417 bp, Homo sapiens
ttgttgagacagcgtcttgctgtgttgcttaggctggtctcaaactcctggccttaagcagtcctcccgcctcggcctcccaaagcattgggattataggcatgagccaccatgcctggccgctttatttcataaatgaggaaggagactcagaaaagttctgggtatgacatacataatcttttttccatctttcactatgttgcctttgctggttccccagaattacacagttatttctgggaaactaaaatgaacattaactctgaggcctgtaaccattatagaatactttcatggctttgctttaggttccgatattcacagggtctcactagcctaggcaaccatgatgtaggaccaaaaggaagaaaatagagcctattatgtaacacatcggtctgctattaagagaaagtaaaaattcaaagaatagatacgagtaagtgttgaacatattgtggagccttggtacaattcttggttctggcagccaccttcccctgccagaatcgattgatgcgtgtgccatatatctccaagagaaaatacatgaggcctttcgtttttcatgagctgtacaagaagtgagccttgaagtaaaggaaaatggtgggcatggggcttaccatggtaaaatgacactttggattttgttctaacaaacttcggaaagatactcttcatagacctgtacagaaataccactatatcaattaaagaagcatttaatagaatttaacatataattgaggtgtttaaaagaaacagcttgtatgtcaatggatactcttgatgctgttataggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagaggttggtttcttttcattttattgaatatgaaaaaatgcactgtcttctaggtgttctcataattagctgtggaaaagagtcctgtttgtatgaatgaaaactcagggtattgactatattagagtagacgcaatgagatggaaatatttttatagttatcaatttggtcatcagacctgggaaagattaaaagttacctgtgacacagctgttatcctagcattccaggaaaagagtcagttaattcacaagtgtgggggcttaatgcctctttatattattggtagatcaaaacctaagcaggccagctagaactagaaagcattctcaacagtgagtccatgaagtttttgccacatcatgcagtagcattgctttcctcatagatactttggacc

SEQ ID NO: 106009 - DNA, 1535 bp, Homo sapiens
tgatactttcaattgagattaaaggcctcaaggtaattattaatgtcctacgttttaacatccgttatctctttttatcccatgatgaaaatctcagttctccaggataccagaggtgatagaatgtcacatagctactcatttgctttattccttcttattcacagctttctcaaccttacagtagtctcccatcaaaaatataattactgaaaacagttaaaaaaaatttttagtacttttttgtctgcaggttatatttcactatagacatgctaattgctagattttacaaattacttggaatcgtcccttgtggttatgctaccatctgtatacaaatttaggttcatttattttattcatttaacattaaatatctctctttaggtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggtatgttttcaaagccatttttattttgaggatatgtgctatttaatacaaaacagatgaaagaatattgctttgatgtactatttccacttacatacatgatttgtagttggtagcatgctattctgaattctaatcagccagaacttcttaagagtgagtatattctgtgggggagagaaggcacaccactaagtcatctagtttaaggccagtgaggaggaagacaaaattgaaaatctcttgaaaagcataaacttaaaatacagcctttcatagaatgtgttttttaaaaagataaatgtttctaattggaaatagtaacagcgtttttcttttaaggtttggcttcagtgcacgaatgctttaaataaaatagctctaaggtgttgtcctgaggttagactgatagaaatttgatcaccattttaagtacctcagagggtttcttttttttttttaatctcaggtttctcaccttaagagcttgctgaagacatta

SEQ ID NO: 106010 - DNA, 1158 bp, Homo sapiens
tttttattttgttttgtttttgtacttggaagtgaggatattataaccgtagagaattgctagttttattgcactttggctgtactcatctttaaacaaaaaatatatctcagttgactatataatttcattttcttttggtatcagagaggatcttatttcaaacattgcatttcatgacatatctaaaaagtttttttggtgttcattaactgctcctgccagaattactgtgttttaactattttggaaattttcctaatatttgcttataacttccagcatggttactgtgtttgtggcatatgtaatcaataaattgtaatcattataaagcaccataaataatttgttttattttgtggtcatccgtatattaagaaaactgaacctattctaatttttccccttttctacctccccctcaacagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtaaggagggccagcggtcctgaagtaggcacattttgcgggagaggggtacttatagaataatgcattttgagagaccagctctagaggcttaacttagattattctttttggtgactaggttaattgatttttcttcattgtttacaatcagaggcagtacattataaagataaacgttcctactttgtaatctgacatcctagatttgaattttgctctgccagtccctgtgtaagtaatttatccttcctgagcctcaatttcttcatctataaattagggctaataatagtacttgcatcagggttgttgtaggatttaaaagagataatgtatactgagcatttagcagagtgcctggtactgaataagcactcaaaggaaagccaatagtattaaaatctttcatcatcatcattactacgatcctcaacgaccatacttctc

SEQ ID NO: 106011 - DNA, 2100 bp, Homo sapiens
agtactctgtacattccctaagcctgctgtgcttggactttcagctctgtttggcagaaggcctttaaaaatgcatgtgttgaaaagtagatctttcacttcttgcattaaactttattcttagccacactgccccttagaagtcaggagtaccaaaggccctctttgagttggttttacttaaataggacaaccagagcaggatgcttctacagcttgcctcagtgcttttaaccagttagcacccattatagtcataaatgctctgctggtattgactcctcaaccctgtagaaccattttttaacctactctttttgtcatgcaggcttttgttaaaattggttattgaaaatgtttaatgactctttcattttgtacatcctgcatgtgattgtatttttctgagtgaatctgatatgtctagctctttaacattcatatattcagaggagtgtttggcacatgagctcaactcctgagatctgctctgttttaggcaaagaagaaagagcttgccaggagagacgatatcgaggacggagacagcatgatctcttcagccacctctgatactggtagtgccaaaagaaaaaggtatatactcttcttatagctggggacatctcagttcctgttaattttgttttagataagtgaagaaaatatatattttttaagctatcaagttgtaagctttaaataaatggtaatgtgttctcttttaaaattcatttgcaattggatgattagctttttttttgtaaaagtgccatgttacttttagatgacccagatgaaaatgactactacatatgtagcttggcaaaacatgttattccgtttgccgtctgggtttttttttttcttttaatgtggcattttaagaatgccacttaaatctaacttgggtaatttctacatggtgaattacaaaaatgcaatttgaattaggaaaggtaaggagaaatttgatactaccactgcagtgaggtatgccattggtcctaccctttgtttgtccttgttcacctcatctttatttgccattttaagcatgtcagattataaaataacaaatcataacttcttatagctcataaaatgttgagctagatttttggggttttttttcctatataacctttctctcaacttccctaaccgtttctccttctcacgggttttgtggaaggggatcttactgtgagattccaaagctgggatcctataaggaattttgcaatattatctctcgccacacaaagtttctctcgcctgatcattgtggaacactgtattgtcctttaatcatgactgcctcaccatctttgcagcaacagtcaatccagggaagataccttcaataaggaataagctaatcactaatagcaaggcttggcagattcaaagttgaatgaagtctttagtaactgttgacacagtctatacatgcattaagagatccactaagaagaatttaaaaagtagtttagaaaagaggagctgtcctgctttccttcttatagatagcattttggagaattttttaagctttaccatggtaactaaattgatcagtataccctgagatgtgagtctcctccattactggcctatgaatttcatccttccaagttcttaattccttgttataccagggacaatggaggaaaagtgtgaaaccagatcaaagacatcaaatcaagaacaagaacaactttgagtgtaaatatgtaactctactgcagcatcacctgtgttttccagatcagtcacctatcaaagataaaaacttatcaggcaaaagaaggtaatggaggcaaaagtgatggtacaattagtgccaacactggatgaaaagaaagatcttaaattagttgagtattaagaaaacagttccaacgaagcattagcccaggccagatactcgaaaattacatacctgtgtggctagtagtctgtgggacactcaaataagctaaagtttttggccaggcacagtggcacatgcctgtaatcccagcattttgggaggccgagccaggtggatcacttgaggtcaggagtttcgagaccagcctggacaacgtggtgaaa

SEQ ID NO: 106012 - DNA, 1087 bp, Homo sapiens
tcataagaccactctttattgtttataaatactttgcactgtcagtactgtctctttaacccttatgaactagaatggccttttattttcagaaatgggtagatcaccatgattgttcattgaggtcacttaaaacctccctaattttcgtcccttcataaggttcacgtatgaactattaggatttttccattagggttttttccaagtagaatgtttgctttgtaattgtcttctttgctaggtctttactaggtcttattattatttcttatagtgttttagtttattcttttggattttcaagtaaactgtcatattaccttaatgtaatggtgcttttgcctccttactttgtatctcaaaagtcatttttaagttcctaatcagtattaccagtaaagataccatgtagtgcttgtcaagattttgcattggactttcaggaagaatgtttcataattttcatgacagaaaattctagcaatttctttgtctttcacagaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggtgtgatttattgtttttgctgagtttgttgtatatatgattaaaataattttgcatgttttgagtgtgttctagtaagatgtgtgatcccccccaccctcagcagtaatattacatcatttggctgggtgcggtggctcacacctgtaatcccagcactttgggaggtcaaggtgagagaatcactagagctcaggagttcaagaccagcttgggcaacatagcgagacccccatctctacaaaaactgcaaaaattagccagtcctgatggcacacgcctgtagtcccagctactcaggaggctgcggtgggagggttgcttaagcctgggaagtggaggttgcagtgagccgagattgcaccactgcactccagcttgggcaaccaagtgagaccctgtctcaaacaaacaaacaatatatataatatatatataaa

SEQ ID NO: 106013 - DNA, 1549 bp, Homo sapiens
ggatcacttgaagataggggtttgagaccagcccggtctacatggtaagactctgtctccaccaaaaaaaaaaaagaaagaaagaaaaaaagatgaatctgctattcatgaaattgtaaagaaggaaaaaaaagaagtttctgctagttttattgttgcacctcagactgcaaaaagttacagccacagtgcatgaaaagtgcttcattaatatggaaaaggaattacatttgtggatggaagacatagacagaaatgtgttccaggtttggcaatgttcaaggtttcaggcatccactgggggtcttggaatgtatcctccacggacagtggggcattactgtattataccattagatctttgtctaaatattacttgactaatcatgaaagaactaggaggcattttaacttatatttaattagtgacaactttatgaagatagatattttggaagcttgtagaaatgttggaggatgcagctttgtgggtattgaatggaagtctgctccaagtagaaagagtgccatagaaggtgcccattgcatgagttgggggcattaagctgtccttttatctgttccttttttaaaccaagtaattttatcttgacaggatgcaaattcaattaaaaaaatattttatatgaaaaaggctgaaattgaacatcatgaaatggctaagtcaagtcttcgaatgaggtaggtttaagaaaatgtctaggctgggcgtggtggctcatgcctgtaatctcagcactttgggaggctgaggtgggcggatcacgaggtcaagagatcgagaccatcctggccaacatggtgaaaccccatctctactaaaaatacaaaaattagccgggcgtggtggcatatgcctgtagtcacagctacttgggaggctgaggcaggagaattgcttgaacccgggaggcagaggttacagtgagctgagaccgcaccactgcactccagcctggtaacagagcgagactcggtctcaaaaaaaaaagaaaatgtctaaaacccttaatgcctttatatttgctgagttttctaggtagtgaaatcaataaacattaacacggtttatgttgcatttcaaggtgatacttacagttgatattataattctgaagatagtagtaactcttagcacctttgctgctgaagggcttcatttaactagaaacattttttaaaactttacatcactatatactttgtacaaatattattgctttgtacaaatatgaatatacatatataatatatggtatatattaatattacacagaatagataatagtatggtatttatatataatattagtagtatgtattcatatttttggtaaggctatttagcaggtatcaggagatccagtctcatcctggcttttccttgtactaggactgtgattttttttttttgagacagagtctcactctgttgcccaaactggattgcagtggcacaatctcggcccactgcaacctccacctcccaggttcaagcaattcttttgccttagcctcccaagtagct

SEQ ID NO: 106014 - DNA, 1060 bp, Homo sapiens
gttttggattgagtgagccttaagatatgacagctctagcacacagtaggtactcagaaaatgttagcctctgtgctggactgatttcatattttaccccaagtggttcatgtaactagggggagttttgcttcacactattaaatccactttaaagaattagtattcatgaagcacttagaactgtgcttggcacatagtaagcactatgtgtttgtaaaataaaacttctaccttatttgactttttaaaaattgtaatttatttttatgagaataatgcagctctggttttgttacctatctcaaaaacttacttataaatgggtacagtaataatttataaaaaagaaaatgactttacatgttgttcatatgtgtactttccaataaagtcttggaatatggtgacaatttagaaatatgtggggttctttttttaaaggttgtactgatgaactctcattaaaaggaactgctatattttgttgtttattgtagaatggaagctacaaaagtattcatgcaatggccaaagatatagatctcctcgcaaaaaatgccaaaacttataatgagcctggctctcaagtattcaaggttagttttgttgttgttgttgttgttgttttccttggtaatagtagataatttaaggtcagtaatttttataaaacaactttattgagatataattcacataccatggactttacccattaaaagtgtttaatttaggctgggcgcagtggctcacgcctgtaatcccggcactttgtgaagcctaggtgggtggatcacgaggtcaggcgttccagaccagcctggccaacatagtgaaaccccatctttactaaaaatacaaaaattagctgggcgtggtggcaggcgcctgtaatcccagccaatcgggaggctgaggtaggagagtcggttgaatccgggaggcagaggttgcagtgagctgagattgcactccagcccgggcgacagtgcaagactctgtctcaaaaagaaaaaaaaaaaagtatttaatgtaatggtttttattatattcatgg

SEQ ID NO: 106015 - DNA, 1061 bp, Homo sapiens
aagcgatcctcttgcctcagcctcctgagtagctgggattacaggtgcctgccaccacgcccggctaatttttgtatttttagtagagatggggtttcaccatgttggccaggctggtcttgaactcctgacctcaggtgatccacctgcctcggcctcccaaagtgctgggattgcaggcgtgagctaccgcacccggccccagcctagaattttttaaaacattaaattttatgctagttgcataataacactcaaaataccaagttttaactcctaagtcatgctgttggatagatcatgaagcttcttaagattaaattctttatggttctgatataataaatgtgctgtacagccatgtctttagtcttgaatctcacaaagctgcttcactggttgtttgaacaacagattgtcaatgtacttccttctcttttcattagctgaatagtttaacttattgagcatgcctggttttttgtcttccagcaatatccagattattatgcaataattaaggagcctatagatctcaagaccattgcccagaggatacaggtatgaagatgaccataagtaaatgattgtggtttagagcagattggcctatgatctttcctagaagcttttagaaaacagagaagctagttgtctctgtaaggggttattagcaaatcatgtaaataaattaaaatagtgttactgattgtagctttggattgcatcttaggacaaaaattaaaacacattggttaccgacatttctgattataaaagatacatttgtgacaaaagatttatttcatttttaatttttaaattttttatttttgtgggtgcatagcaggtgtatgtatttatggggtacatgaaattttgatactggcatacagtgcataataatcacatcagggtagatggggtaacctgttgtttatttttatctgcttccaaatagctttaggatacgttagaataaaagctacccacaacggatgttagagtggaaggtcagtggaattagatactacttttttctctttggccctctctaccct

SEQ ID NO: 106016 - DNA, 1025 bp, Homo sapiens
ggcacctcattaggttcatataggttgttctagggatacaatgcctatgtccagcatcagaacattatggggtattcttgaaatttggagttaaaataagtactgcttagaagttgctttctttggccaggcacagtggctcatgcctgtaatcccagcactttgagaggccgaagtgggcagacatgaggtgaggagttcgagaccagcctggccaacatagtgaaaccccgtctctactaaaaaaataaaatttagctgggcctggtggcgcatgcctataatcccagctactcgggaggctgaggcaggagaattacttaaacccaggaggtggaggttgcagtgagctgaaattgtgccactgtactccagcctctccatctcaaaaaaaaaaaaaaaagttgctgttttgaattagctctacaattttagaagctatgtaatattcagcattttattatttctcttagaaagtacttttttctccacattaccagtcttctccagcttacttgaaggagatcctggagcagcttcttgaagccatagttgtagctacaaatccatcaggacgtctcattagcgaactttttcagaaactgccttctaaagtggtaagtgatgcagttaaaaacaggtacatgtcagtgttttgtttttagtacttcaagaattgtattaattactgataaataaagtaagttcaaaaggaagatgttgggccgggtgtggtggctcatgcctgtaatcccagcactttgggaggccgaggcaggtggatcatctgaggttgggagttcgagaccatcccgatcaacatggagaaaccccatctctactaaaaatacaaaaaattagctgggtgtggtggcgcatgcctataatcccagctactcgggagggtgaggtaggagaattgcttgaaccctggaggcagaggttgcagtgggtgagccaagattgcgccattgcactccagcctgggcaacaagagcgaaactccgtctcaaatttaaaaaaaa

SEQ ID NO: 106017 - DNA, 1115 bp, Homo sapiens
ttcaagtgattctcctgcctcagcctcccaagtagctgggaccacaggtgcgtaccaccacgcccagctaatttttgtatttttagtagagacggggtttcaccatgttggccaggatggtctcgatctcttgacctcatgatccacctgccttggcctcccaaagtgctgggattacaggcatgagccactgtgcccggtcataattacttttaatttagcaaatcatttgtcttctgcctcaagtctttctttaatgagataagacctaaataatttgatttcagaatgtctttaaaacatacacttaattttttggaagcgggatttggacccatatatgttttaatcatgaggatgttaaaatttgtaacaatttttggtctttgctgaaacaggtgctttaaaagtagcaactaatttccaatacattactaaagtgtttttttttttctctttgctaacatacagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggagtaagtgtgtagctggaacttgtgatggatgggctcttggaaggcagagagggcccctgcttgtgattccctctgggctgttgtgggcaactagaattcctgtgcaattgtattggtaactgggaggataaaaggacattcagccagagagccccactccatttttaagggatcctaggatatcctggacaacgtgtgccatgtgtggtaattttcatgaattgtacttacattaatgcatatttcctgctcagttttaaagagaatcttgatattatcaaggattagtccagtattgctacattgagacatcatgtaaggaaaggcagtgttgtgattagaagttggaatgtaatcaccttagtgaggaatatttctgtaggttagaatagttactgttcctagaacctcccaggtgtgtttctgcctctggaattttgcagttgttcttctgcatagaaagtgcttcctttgacttttcccgtgactggctctttttt

SEQ ID NO: 106018 - DNA, 1362 bp, Homo sapiens
agtgtcctttctaggcacatgttctcattgaattctcaattgtctacagatagtccccttagcttgagacactgctggggtcctgcctcagcaaggagcactggactgtgggtcctgtaggcccagatggagaggaccatcttggatattaagttatcagagccctaatgtgtgctgtgagaaggttccttgataccactgacaacatcagtattctttctgctttttctctgatttctcaatattctgatttttttggttgaaaagagttcccatataagtggacctgcacagttcagtggtcaactgtactgtattaacattcacttcctggttttgatggttgagttgtggtccttatttgtgagaaacaaacactaaattatcaggcgtgatggggcatcatgtcagagcttattcaaatggttcagaaaaaaagtactatttttgcaacttttatgtcagaatacaaatttaaaaataatttaaatatattatacgtaataaaagaatggctataacctgtcagctaaggttccaagagagatttaagccttaatcgccatgatgttatttgtaataacttatctcttacacatctagaatggggctgaatacctacccctgtgggagaattgagaaaatagtcacatcgtttttcagtaggtttacttgtctcctggaacttcatttgaagaaagccagaaaaaatactaaacatccatgaaccctaaacccaagaagttattttgggaacttaagaaattgtcattaaaattacttaaggaattaaagaaggaaattacttaattattttaagaaattttgtcattataattacctacaaagtttcttgtgtgttcctcactacccctctcctgcaaggtataaccactaagccaaattttgtatttcttagtcccatggttttttttttccgaagagtttggttgtgtttagatgtatctgatgtccattcatctttgttaagctacgtaagccaagggctcatcttcctcccttgtaattttagtaattgctattgtagcagcatttatgataggcatttgatagtacttggcagaaaaaatttatgtggtcacttactgaagaaagaatctgttttgtaagtttataaagagtattgagacatatctctgttttcacacttttgagcactatgaaaggtaagtcatcttcatttataaaggataccattgacatgggtttagcgttggtgccctaaacattaaacagttagcatataaaagaccatcacaggtgttaatttaggtttttatatcattaacgtatgttttgaaaagggaatgagtgtgcatcttgcttttctttttctttttt

SEQ ID NO: 106019 - DNA, 2133 bp, Homo sapiens
gtgctgactccagaggtggataccttggggcctctgtaccccaggcctgcctgactgcctcatgggctgaaggcttaataccttcagcacactaatgtactgctacatataggttgggaaactctaggccaaatttggagccagaagttgagtcattcaagattgctgatatacaaatgaatatgcttttgttgaatttgtcccatcaaaattggaagtatagcattctggtaagtgaaagactaaaacaaggaagtccagggcttaaaaaaaaaaaaaaacttatagctagttaaactacaacacgttaaaatatcctcctaagtgagccaggagtttggtagcaggtgtccagctgaagacttggtgacagagtctatttaaatgtaagaacatggctgattatttcttatagaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctgtgagtaacttggattacatggtttctgcctgctcttcccacaattcccctatcttccctttaatggtaaaattgttacgatgcaaggcatctccacttttttaagattctcttgattaatagtcttttcttttatgaacattatgtattcagctaagtcttagagtaatagtgtgatcttatgaataatttcagtatgttacatcatatattaattcagcaaataactgtgtgactatcatgtgacaagcactgttctcatggttgggatatagccatgtggaaacaagcccatttttcacatggaacttagattccaggcgggggaagtagaatgtaaacaagtaaacgaataaagaataatgtatccttagctagtaataagtgctaagaagaaaattttgggtgatttgggctgttttggcctgaattcgctggaagagagttccagacagaaccagtgcagaggggttgggtcagggatgagttttgtgtgtcttggttacagagcaggggatggtcaggaaggagaaggaaactggcaagctccacccattcagagtatgtagggcccacacaagcaatgtttggagtttagattttattctctgtgaagtgataaacccttctgtcagatggctttaagcaagagagtgataaactgatttagtttcaaagaagaaaacccttcaattggatgactttaagcaagaaagtgatgaactgatatagtttagaagacaaaatcaccaggagcataaatctgatgaaagataccaaaaagttagtcaactcagttgtttgaaaggagacatattgtcagcatatttcagactttagcatgtttggtaatattgagagtcatcatttttcttctctacttgccttttattgaagagtagaaaataattcttatgtctacactggctttctgttcacttttttagtgatttttttctcctttgctaatgtgtagattgccgtgtgccatgaactctataataccatccgagactataaggatgaacagggcagacttctctgtgagctcttcattagggcaccaaagcgaaggtgagttcgaagcacatcagtacagttgcgggggatttggtccagagtccatgtgtattaaagtgtttggaaattgagctttttgttggcaggaatggcttaaatgatactggggtccaattttagtctttagtctttagtaatcaagctgtagtgaagctttttttaaattaaaaatctgttgagccaggcacagtaacatgcacctataatcccagctacttgattttttgagccaggcacaggagcatgcacttgtaatcccagctacatgggagactaaggcaagagaattgcttgatccaaggagtatgacaccagcctgggcaacataatgagaccccgtctcttaaaaacaaaaacaaaaaaaatgacctatgcggaaagatctcttgaggccaagaatttgagaccagcctgggcaacatagtgagacccatctctacaaaaaattttttgaaaaattagccaggtgtggtggtgctcaccta

SEQ ID NO: 106020 - DNA, 2045 bp, Homo sapiens
agacaacatcaagctgataatcagaggtggaagacttaggactcctattctggtcttaggagcaaaggtcctgttgtttctcccaccttataacattgcccttcttgtcagactttcaaaatacattttaaaatgtgtcccatggataagaaaatacttgaaaattatccttaagttgaaactttttcttatcttaccaaagtaaattaatgattcaaggatattgggatattgtgtcatccgaacgacatacacatgctgataatgtatttttttgtcatttgattttcagtggattatttataaaagtaattttgaactcctgccaaaatggttggcccttttttttttttttttaaccttgtcaaatttttatatggtgtctccaatgcagataggacttttggaaataaatgttctttctctgaattttttttttgtgggggagggtgttttccagaccttttgctcacatgagccattcttggtttgttccagcttgccaacacttggtgtcacatgtgagcctcccacatgtattcactctccattccagctctgtgattgaactctgctcttattgactagggggcagttgggcaggcatgcctcattcctggaattgacagtcattcctaatgtgagtaaaggggaacctcaatgagacatctttaaacatatgaaagcatttggttttaaaatggaagaactgtcaggtactgttagtgcctgagcctttgcagcagtttgtttgataggtacaagagaactgatatgcctgttttctccagttctctttatctttctttagcagttctatttgaatgttttctatctattcgtactcatttttactccttctgacccttcttttctatttcccccttctctgccttgttcttctttttcagttttgaatatactaacactgaatcagcacttctaaagcccttccttctcccactggcttcacttggctttcagacataatgaggagactggcttttcgaggcgctggttgtgctctggtaaagctggtaaattactgattatctacaccctttcccttttctgtccttccttgactttttccttccacctttcttaaatttttgttatcctttccacaaagattccctccttatgttcatcaaattcacttgtgtctttgtcatagattgtttaaaagggattggtccttaatttatcttaatgaattgagtcctgttgatcagctttttataaaatgaacaaaaatcagcaaaacttggctaagttttggctaagccttttgacgattttaactacttttagccaacttcaaactaataatactgtataacaaaccgaagcctagagtaaggaacatcatcgtggtagattttgttttaaacaccatgtggactttagtttggaaaaagagatctgagacttctctttttccttaattgctcaccaggattttcaaatgtgattcttttgctccttctttctgtttcctggagatccccaacctttctttccatactgctggcaaccagtgttctcctgttctaatcattcagctgctggtgtcgtagtgtcctgaaattcagtgtttccatgtgccttacaattatgaggtactctagttctatgaggttcctcataattgtaaggcacatggaaaagcagatgaggtgctgactcaagaagtgaataccttggggcctctgaaccccaggcctgcctgactacctcaggggctgaaggatcaataccttcagtgttgatgagtgaaactgggatctttttttttcttttagctttagaaaaaggcctttgacgggcggatcacgaggtcaagagattgggaccatcctagccaacatggtgaaaccccgtctctactaaaaatacaaaaattagctgggtgtgatggcacacgccttagtcccagatactctggaggctgaggcaggagaatcgcttgaaactgggaggtggagggaggttgcagtgagcagagatcgtgccactgtactccagcctggtgacagagcgag

SEQ ID NO: 106021 - DNA, 1752 bp, Homo sapiens
gcagagggtggggaagactaggctagattttcgtaaggaagcagcgtctgagccaggtttgaggcccaatattttctttccgtggccacgtgcagactggcccaggtgagagctgagaatcgcctcccagactcagtgttcctctcctgccttatgattcgtgctgtttgacacgaagtggttgtcgttttgtgtctcatacgctgttgtgtatgatcccattctaatattgtgagggtaagtgcagggaattttgactccattctggatctactgaatttaattctctgggatttgaaagtagcacgtatgtttgcattaggcatttcgcattagacttaacgttaggtttggtagccaataacacaagaaaaggatataactccatagtgcgttaacccagaactaatcatttgggttaacagatttgtgatgtgtttctttgtagagttaaagaaagcaagtaaacgcatgacctgccataagcggtataaaatccaaaaaaaggtaagtgtagtgcttgagagagctgtaccaaacacattgctaaactgattttgccctgttcctttgcgggaaagtctgggttaatgtgatttggttttgggaaatggcattggatagactgaccatgggcacaagctcttaggcatcaggagtgcagctgtgagaaagtgcagtgatttggtgataagtctctaaatttgttcagcatgttaatctctgcatagagagccttctagttacaatttcttgctgttttatacttacatatgcattactttgtaagattccaattaaagctccattttcctaggacattttataggcataactaaattgcagccagattggtttctcacttgaattctgcttaagtataaagatatttttgtaagcagacaaaatctctttattttaataggttcgagaacatcatcgaaaattaagaaaggaggctaaaaagcggggtcacaagaagcctaggaaagacccaggagttccaaacagtgctccctttaaggaggctcttcttagggaagctgagctaaggaaacagagggtaagttatgttagccagaattttcattgagtggtgtagtgtgttatgtgtgatatttttcagagtaaggtaacaacactagtcactggttcacctatttcccttatggctctgacagcttgaagaactaaaacagcagcagaaacttgacaggcagaaggaactagaaaagaaaagaaaacttgaaactaatcctgatattaagccatcaaatgtggaacctatggaaaaggtatgattaggtctctttatgaatgagagatcaggggttttgattttggtttttttgcttgggcctgagtgcagtggcacaatcacaactcactgcaacctggaccacccaggctcaagcagtcttaccacctcagtctccaagtagctgggactacagaagcacaccatcacgcctggctaattttttttagcagacacgggctttcactatattgccaaggctggtctcaagtgatccacccaactcagcctcccgaagtttctggtattacaggtgtgggctgttgtgcctggctgagagatgagttctgatgcagaaataaaagcacatccacaggctgctgagcttcttgggaggaagacaactgagttcagactccatcttacctatttaacaactgcaagggctgctactcagctgtggaaaatggagttagaggttacagttgctctac

SEQ ID NO: 106022 - DNA, 2911 bp, Homo sapiens
tttcaccaacaaatcatttcgtgactcgactctagcttatgctgtttaatgcctttcctgctatgtttacctgacggaaatagtttctttggttctaaatatttgcacaaaactggttctgcctgtaagcatgatttacaacattaaaaaaaaacgttgacatagtgttgagattgagaaaggtacattggagtaagcagtgtcaggctaaaggtctctaaagtactctgttgaaacctaagtgaaggaggacaacttggtgtagttgctctccagcactcccatccccaacatccattttcccaagctcactcccccatggatagaacctgactgcccctcagcagcttttggcaaggccagaaggacctatcaaactatataattcactatgggaggattcagacagggatatttgcatttttgaaatccatcttgatcagagactgctgagcaagcctatgttttactttcctgtgtgagaaatgatgagggtcaacattcttcataccaaagtgaagacatgagatccaactctgagctcaccctgttgctaaatggataatgccagtactctcttgtggaaggtattaccagaacaagggatgtagttctgatcattttctccttgataatgtagttctggtcattttttccttgataggtgattgaagcctccgatgttgtcctagaggtgttggatgccagagatcctcttggttgcagatgtcctcaggtagaagaggccattgtccagagtggacagaaaaagctggtacttatattaaataaatcaggtgagtaaagagggtaccctttgtcttctgtgtacatgggtgaggtacgaggaaacagtctgatagtcactgaagactgattagatccaactctgatctcagcaaagccagagtacgtgcactttgccagagacagtgctaggcagtggggagccaggtgacttttacaactgactcaactggtttctactattcttttgccattcagtatttaccatcttttaaataaagagtgtaagctgctatacccagcttattgtgtagtatatttcatctaggaagtgatgacagtgtgacaaattccccacacctacacaatgtcgggtattagttcaagagtgaaataaattggaacgtatgtgacaaaatatttaaatgaaatgcataattatgcatctgagtttgagcagcaggaaaaagaaaacccagaacagagaattacaaagcagaaaatgggaatgagatctaaaattgttgttggggttaagaaacaattggctgcttgggaggctgaagtgggcacatcacttgaggccaggagttcgagaaaagcctggccaacacggcgaaaccccatctctactaaaatacaaatattagccgggcatgatgatgggcacttgtagtcccagctactcggaaggctgaggcaggagaattgcttgaacccgggaggcggaggttgcagtgagccgatactgtgccactgcactccagcctgggcaacaacacttcgtctcaaaaatgaagaaacaattggctgctagctaaaggtaaattctggaaacatagctctagggttagtagggttgtaatccagacgttgagtctgtcctgaagttttcaagtgagcaatacaaggggaattgaaatagagaagtgcagatgctgagctctgttaagatacgggcagtatggtaggggagcttaccctgccctgattttctagttaaatccttttgaaaggactgggaaaatgtaaaccagagtaaaatctatagttgccagattttgcaaatgcatctcaacaaaatagccacattggagcaaatgtctttttctttttttctttttgagatggaggcttgctgtgtcacccaggctggagtgcagtggcgccatctcagctcactgcaagctccacctcccgggttcacgccgttctcctgcctcagcctcccgagtagctgggactacaggtgcccaccaccacgcccagctaatttttttgtatttttagtagagacggggttttatcgtgttagccaggatggtcttgatctcctgaactcgtgatccgcctgtctcggcctcccaaagtgctgggattacaggcgtgagccaccgtgcctggccgcaaatgtcttatttctaattgctatcagatctggtaccaaaggagaatttggagagctggctaaattatttgaagaaagaattgccaacagtggtgttcagagcctcaacaaaaccaaaggataaagggaagataaccaaggtatcctttattagtggtaagaaatgtgattctttcagattttggttgaaatatgatgagtgtacaaaatcttgatttaagtgaatgaaaaattacaagatccaactctgatttcagccagagatcatctgaaaggcaatgtagttatcttaagagctgggctctggagcctgattgcttggggtttgttgaaatttatcaggtaagttgccagaataattcaactatttggaattttagcgtgtgaaggcaaagaagaatgctgctccattcagaagtgaagtctgctttgggaaagagggcctttggaaacttcttggaggttttcaggaaacttgcagcaaagccattcgggttggagtaattggtgagtttcagttcattactttttactttttaagtgttgaaatagttaagaagtttagccagctctccaagtgcccaagcagcagtgtatggagttgttgtcaagtaaaaggctcactcaaatactagcttcttgcttataccttactgaaagcacataaccacacacaatttaaagaaaaaaacttacacaactgctgccagattcaggttttttgttgggactgattactgtaggaagctggtttct

SEQ ID NO: 106023 - DNA, 2645 bp, Homo sapiens
tagaacagtcgggtatgctgttacagttttagataaatgtgaagcaaatgatgataaactggatctgactgactgtgctgagtctgttcaatccaaccctgagcttcatgttctgtctcttaacctccaaatagaccaatgcccccatcaattccatcgctcttctttcaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtaaaaggaccccttctcatgagctccttggagccatcttctttcatcataagcattttgagtagaaaaatcttggaagtgttttaaagtactggcatgtcagatgaaggacagctcctttgtttggttttttttttaaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacagggtaagctttcttttctgttggcattttggtgaccactagaataaaccttcttttgacacatcttatttttaatatcagtgcctcattagcttactattgccatccccctacatcttggactcctcctccatattttaatgagagtattgtggtagacatgaaaagcggcttcaatctggaagaactggaaaagaacaatgcacagagcataagaggtgagaattgtgtgtcgctgctgtcttcatcagctgacaggccagtggagctcttacctgtttacatgggcttgctttctttcccagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgtaagtgtgtcctccatgagttaaaactgaagtgagttttctagcattataatacataatggaaggaactgaagataggaaatatttgaggcttgtgatccattagccttaattttgcacatcccgttatatgtacctccaaagagttaatttttcaggtacataactacttggattaaatgagcagacaagggctactaatccagcactatttttctttgtcacacaggaaaacagctcaggcatgtttgctgcagaagagacaggggaggcactgtctgaggagactacagcaggtgaggcaggcaaaaggggttctaacgaagcagcatggtatagaatcacttttactttttgaaaatctctttattttcctgcaatataggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaatgtaagttttatttacagatcaggccacaggttacaaaattaaaaccaacagcagttttgaattatctgtaccagctagctgaactagccatatcagttcttctttccagtcattcagcattgtagtaagaaaacacttggtaaggcagatggagacatatttatagtctatagtctgtctgggaagctgactgccagacagggcagtttgtcatctttacctagctgacacatctttttccatggcttgctaccgataggcattgaagcctagcaactgttacttcccacgcatgctatcttccaggacttcctgagaaatgcttgcttacagttcaaattctgtttcactttatgtttgagatctcggtatatcttcggattaggttgaatttgcctgttgggtctggaatataccatttttcccaaacatcagtatatgaagcagtccttccccatggcttcaaatgtccattccaatggagtaacttggcagcctttacaaactgaggtgaatatcgttttccagcactggaaccttacatttgagacaaaaatagccacatcgttgcgccatgtgaaattgtgcagaaaacttacttaagggaaacaaagaatataccccatccctgaggatagttctttagataccaattctttactagcttatgccactggttaattctacttaccaaggtggcggacattccacataggatcgatggtagagtgctgttgataaaatacgataagcagaggaggtgttgtgatgctaccagccagggttctgctatacagtccctctcttggtgggacagaaaacaaatgtttgttagtgaaaagtactg

SEQ ID NO: 106024 - DNA, 1033 bp, Homo sapiens
tattctttgtttcccttaagtaagttttctgcacaatttcacatggcgcaacgatgtggctatttttgtctcaaatgtaaggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatcttctttttttattccagataactacttccactcacaatgagatgaattgtctttttacagaatttagggattccaagttgcctggttttaatataatacatattcacaaaatttacacagctcatgcataccataacttatacagagaacagtttagcagtctgcttaaaatgttaaaaaaaaaatcataaaaagccattgttctgttacacataatctgtactgaagtcataagcatcatcctcttcaatgattttatccaagataaaagaccttgtagactgttcacctatattgcaggaaaataaagagattttcaaaaagtaaaagtgattctataccatgctgcttcgttagaaccccttttgcctgcctcacctgctgtagtctcctcagac

SEQ ID NO: 106025 - DNA, 1069 bp, Homo sapiens
ctccgcctcctgggttcaagggattgtcctgcctcagccttctgagtagctgggattacaggcatgcgccaccacgcccggctaatttttgtgattttagtggagacggggtttcactgtgttggccagactagtctcaaacgcctgacctcaagtgatccacccacctcggccttccaaagtgctgggattacaggcatgagccaccgcgcccggccagtgcggtcttttttttttgtatccacagttttgtatccttggattcaaccaaccacggactgaaattacagatacagagggctgactgtaatatgccattttacataagggacttgagcatccgtgaatttttgtatacatggggagtcctggagccaatccccgactgatactgaggaccaactgtgttgctaatcaaattgtacacaattatatactcttacgaaaatgtagttaactattacagatccagcgtctgtgtgcaatttcgttttgagaattccttctaaccagatcaggaaagctctcttaccaggaatagccccaggaaagacaatatggattagacgtactccatgataactggcgttttgcatgtaggtaactgtggaagttttaggagcaactggtttctgccttgccagtctacttaagtatgtcagatacttgatagaattgtgtttttcttgtttccagccaagtgtgcctcttgatcccgtaactgctaactggaagtcaagaaactaaaaacattatctcttgtaccattaattaagtgggatttatttgagtgcaagatcgttttctcagtggtggtggaagttgcctcatcgcaggcagatgttggggctttgtccgaacagctcccctctgccagcttctgtagataaggtcagcccataatgtgatagaggcatatgacttagggtatatactgatgtatatacttctctttttttttttttttttttgagacagagtcttactctgttgcccaggctggagtgcagtggcacggtctcagctcactgcaacctccgcctcccgggttcaagggattctcttgcct

SEQ ID NO: 106026 - DNA, 1168 bp, Homo sapiens
ctcggtcgccctcgcctcgcagcctgccacccgcgctcagctgcccgcctcctcagccagccatgctggagcatctgagctcgctgcccacgcagatggtgagggcgcaacccggggacctctgcacgccgttcttgtgcctggcagcttcgaagcccatgttggagcaccgacccggtgctgcgctgttccgggcccggatggttaccgtccaccctctttcccgaattgcctcctgggtccccttctcttctactccgcgagaatctcctgtccattctccgtgagggtgtttcagttcctcccgggaagcccagaatttaatatcttgcccaggcccttaggagagcgggagaccctgatgttggggttaccctgtgccagagttgtgaggtcagggcaggaattgtatgttctcggcggtggaaccaattctttttttcctctgcttcaccccaggattacaagggccagaagctagctgaacagatgtttcagggaattattcttttttctgcagtaagtattggttttacatttaatctccgcccccgcctccctcccaaccctcagtttgagtgtgtttaatatacttcatttgtctctagatagttggatttatctacgggtacgtggctgaacagttcgggtggactgtctatatagttatggccggatttgctttttcatgtttggtaagaaatttgtgggtattagtggcagcttgggttttgtgagtcgggttggtttggttagacctactcagtagtgagacccaaagccaacgtttccctcatccttccaaacagcgtttccctttgctatcattggaaaagtagaatgccaaaatagtgtcagatggtgcgaactatataaaaggacacagcttatttcctttggcggctactctggctaataatcttaaggtcaaagccagcaggagttttcatggtgctcacgttgtcccttcaccttttatttatttatttatttaaattttttgagacggagtttcactcttgttgcccaggctgcagtgcactggggcgatttcggctcactgcaccttctgcctcccgggtttaatagattttcctgcctcagcctcccgagtagctgtgactacaggagcccaccaccacacccagctaatttttgtatttttagt

SEQ ID NO: 106027 - DNA, 1051 bp, Homo sapiens
gcttgagcccaggaattagaggctatagtgagctatggtcacactgcactacatccctatgacagtgcaagaccctgtcacttaaaaaaaaaaaataggccgggtgcagtggctcatgcctgtaatcccagcactttgggaggctgaggtgggtgggtcacgaggtcaggagatcaagaccatcctggctaacacagtgaaaccctgtgtctactaaaaatacaaaaaattagctgggtgtggtggtgggcccctgtagtcccaaatagtcgggaggctgaggcaggagaatggcatgaacctagggggtggagcttgcagtgagctgagatcgtgccactgcactccagcctgggcgacagagcaagactccgtctcaaaaataaaataaataaataaaataaaatacaaaattttaaaaaattgcagtgttcttgctatagtggtaaaagtgtttatttttccctttgtctttgttgttgccttttagctattatgccaggttctgaaaagatcaggagactagttgaagtcttgagaactgatgtaattcgtggcctgggagttcagcttttagagcaggtgtatgatcttttggaggaggaggatgaatttgatagagaggtgagtgtctcattaactgtatcaagatgcttatgttatagaattttttaaacaaccttttgaaatataaatcacacataacaattcactcatctaaagtgtataattcagtggtttttaatgtgtttacaacattgtacagtcattaccacaatcgatattagaacattttcattacgccccaagaagccctgcacctgttagcagtcactccccatggtccgcactgccaaatctgaagtcatgaagatttatttttatattttcttctaagagtttttttggtttcagcccttttaggtcttggacacttttttttttttaaggaaaatttaaactttagcttgggcatggtggctcacgcctgtaatcacagcactttaggaggctgaggtgggtggatcacctgaggtcaggagtaccagac

SEQ ID NO: 106028 - DNA, 1008 bp, Homo sapiens
gggactttgttggcctggcacataggcggtcaacaaatatttgcagaatgaacgaacaatacttgtaacggccttaggacaaacaagtgcacaaaaagaggaagctttccctgactctgttgtggcggggatccggacggtggaacggacgcacagaaagtgcgcggagcctggcggagtcgctctggcctcctggagcctctgctctatggcgggtcctcccggggctgcggaacctctctggccgctcgtggcgtccgctctatggccgtcctttggggacgcaggagcatgcgcagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcaggtctgcaggggtggggcccggcaaggggcgggggcgggcagaagtgcgccgagggcgccgaccggtagattaggtcgggggtggtcgcaagaggctcatctcggatggcgtttcctcagggaaatggtcccagaccaagacgaggcctggcctccctgtaatatgcgcccagaactacttctacttctttgttgtgttaaatttttttccttttaattttcattttctttaattacaattctaagttttatgtaaaaattttcagtctctgcctatctacttctttgttgtactaattggcatgcgtgatctacacacctttctcccaaccccgatactctcatgagagccggtatcatgcattcccaggacttaatacagcgcctagcaagcattattccttgaatgaagggccccaaacgtc

SEQ ID NO: 106029 - DNA, 1071 bp, Homo sapiens
tcagggctgcagcccccaggcagcagtactgggagcccctctcatctccgagaataaactctgaagccagcgaccctgcggacctgaatcatcagggagcctgtcagaggaggggcagtgactctgcgggacaagcaagcaggctatataagtttcagaaggctgggctccactcagatcttttccagcagctgctgcctgccagagaggcgccttcagagacccagcgcttacacaatacccaccatgtcccaggtaggaggacccagcaagggctgtgttgatgccagagggagtggaggtggagtcctggacactttcggctctggcagctgtgtcttgatctgagccccaagcatgaactggaggctctgcagcccttgggagatgggggctcagggaggaccccctgaagaacccctcttctatgtggctttggtggtattccacggtttgttaggaggagtggagagaaatgttgggggtggggggggcctagatagatctttgcatgtgcctgtgtgtgtgtgtgtgtgtgtgcgcatctgtgtgtgtgctgccgatatagctcagtgtgtagagctttgtgcatttgtagctatgggcccggcagccatgcactctgtgtgtggccacacacataggtctgtctgtctctgtgtatggtatatgcatgaagctgtatgtgtgtgcacatgaggctggagggacacagctggatgcatcgctgtacaggggtatagtgtgttgctctgaggagcctggcccaggctgagcgaggaaatacctgcacctgcacccaagcacaggcaggtctcagactcacaggcgcctggggttgaggggtagggtaaacaccgagcctgggtgtcccccaccctggagggacagaccagcctgccaagagagaggactgtccttgctgcctgctctgtgggtgggtggccattttggactgtaattctgtgggcatctggcccttctaccccatttccagccccaaagacacaaagtaaatagtggcgcttttctggaagggggcaatccttgaggaaccgcttgccacccagt

SEQ ID NO: 106030 - DNA, 1049 bp, Homo sapiens
tgttcctgacaggacggtcattccctcatggcatcactgactcagttctaattcctcccctcctgtttcattttggtttgaacaacctgtgcctgcagctgtttcttccaccttcctggagctcacaattggagcttcatgttcagtcttgagctcctaatgtttccagacagggcaggggataggagagccataatctatgaaagctgtgaaacaaaccctgggttatatagatctcagatggtctcatctgaaggctttgcccacttcccagtgagcagagggtttggggaacaaagaggtagctgaagagtggtggtttttccctgtatcctgattttcagaaagggctttagtctctgagctgtggctagtagctggctggctgaccaggggacgggggtctaatagggtgtctgaccataggacacctctcgtgtttggccttccctttcttgtgtgtttgtgtgtgtgtgtgcacgtgcacgtgcacacacatgtacacacacaaatctgtatccccaggagtgcctcctgcagtcactgggggctcttccgtggtgcaccatcccatgagagcagatcagagggctgtggtcaggacttcctcccgagctgccctccctccctgggatgagtttcctctccacctgctccaaggtgccttacgaggtgcagctcttcacctggccacatggcatccatcaccgtgttgagaaatggtgggacgttggctggatattgtgtgctatgaatctgatttgtccaaatctggacctcagccaagccacctgtggtggaaccttgcaagtcaaggtcatgaacaaatttcttgtaactattggaaataaactaatgaggtagaactgtcatatccaaatggaagaggtggttggtactgttacttccttttgctgtcagagggttgttgacaatggcaaggggggatgttagtgagatccaggtggtggtggcttcttggtccactcagcttgcacacatgcaagaggagggtctgtggcccctcagccgtgctggtggcctccttc

SEQ ID NO: 106031 - DNA, 2108 bp, Homo sapiens
atcgcttgagcccaggagcttaagaccagccttggaaacaaagcaagatcccgtctctacaaaaaaaaaaattttttttaattagccaggcacatgacatgcattcttagtcccaggtacttgggaggctgaggcaggaggatcactcaagcctaggagtttgaggatacaataagccgtgttcatgcccctgcactctagtctgaatgacagagtgagaccccatctctaagaaaacaataacagcaatgacaaagcaggacatgcaacactgcctggcatgtctgtcctttaaagaggagactgtgggggacatctgaaagactcgcaagtgaaacaggaatcaggaaacacagcagccacgtgtgcttctcccaacggtggctgcgtgagatctgggttcccagaggaaatggtgtgccagacggggtcacaggtgctttttctcttttctcacgtttctgaactttcttattttagcatctaaagaggcagctgtagctaagttgtgtagcagaaacctagaacactggggcaatgtgaggcgtatgggaggaaaagcattttcctccttgtcagtcacttaaaactgaagagcagatggagtgagcacactgagcgagcggacatccttccatagtaaataagcggtgccgcgcgctccgctggctcccaaacactccagtcctcacagagagatttcctagtggcgctttctgtccaactgtcctcaaacctacttaattacttaatggtttctcacaaataagttcatctgttgttttgagaactgttctcgataaggttaggtgacttaccgaaaggaaaaggattgcaaaactcattaacaacctagcaaggagggattatgcttatgaaatgggttttttggctcaaatgtctcctatcccttaagtgaaagtagaaaggaagacctcagaagaggcgactgatgtgtttctgccacacttctcccagggttttccagaaaagggaatggcctggtgttttgtccattgcagctgcataaagtcattcccttgtgtacagctgacaggcttgggcagggcatgggcctccagcatgggtgcccaaacagggattgctgcagaaacaataaagccaagtgagaagctggagatatctctttggaccaaattatcttctcatagcctggattacggcctttaccccccagcctcccgcccccccgccacccccaaaatgctaccctgtaccccctcttctggccagctgtggtaaggcagctctggcagaacttccagggtgagccccaggcaaccttcccacatcccactctcccctgggtctcccactttggggaggcctatgtggctcccaggagccaccctagggttcttcatatcacaggatcattccctggaggggctggtcttctctccgttcaaaatgtcctggaggcattccaaggcctgcacatcctccagcttgtactactaggtccctcggtttctcaagcatggtgactgaaggggtcccagatggacctttgtcacagccctgggccccggcccatccctcccacctccttgccccaaggacttctctcttcacttccttgtccctggccaaggtgtttggggtgacccatgctggacaggtagagtccaaattcctccagagtcacgtttctgctctcaagaggctgaggtatcagggatggcccggggagttgggtaagggatgggaggtggggaggtgggagacaaacaaagcgactgggtcctgcttcatcatccacaaacatcagtccactcatggacagagaagggaggggcagccccgctgtcactggaaaaatcaacaacggataagaatagcagtcttgcttcatacagcttctgctgccagccggcagaaagaacagcttttctgagctccagcaatgagcacttcctaactttagtgctttttaatcctatcttagaatctcttaaaagaaaggccattttagtatcttcaaataaggaattctctgattttatttaaaatactgcatttgtctgttaaggatgaggtaatcctttggacttttgggggggctcattaagtacctttagagcttt

SEQ ID NO: 106032 - DNA, 2108 bp, Homo sapiens; identical to SEQ ID NO: 106031

SEQ ID NO: 106033 - DNA, 2108 bp, Homo sapiens; identical to SEQ ID NO: 106031

SEQ ID NO: 106034 - DNA, 2108 bp, Homo sapiens; identical to SEQ ID NO: 106031

SEQ ID NO: 106035 - DNA, 1024 bp, Homo sapiens
gggccacagaggacaagagggagggagagcggatggaattcgggatccccactctcctgtcctggtcatgcctcccaaagagctcatggctgtgggctcaagggccactcacttctagatggctgaagattcacaaggcactgacagtttaaaaggggagccaattcatggagctggctatgagtaccttggatatttccagaaatgttaagtaattgtttgtctccgttgaggggagatgagctcagggcagggcttttcttagccccgtacttgatgcctgatgagtcactgacttaagatagtgtccaacacacagcttgtgcctcctatggctccagggaaggcttctgagaagctgcgagtcattgagtcctcagctgcagaacagaaatggaccacagtcgggggaccagcacagcatcatcgtcatttatagaatgggcacccaaaggagttaagtgacgcgcaaagctcacccagccagtgcatggctatgggagcctgggcctgctgcaccaggatacctaaaccctcccaccacccccacaaacagtgctcacaactactttgcagttgagatcccttctagaaggtgtggctcccagctctactatagctgaccagtgctaaggtgaatccactggtcaccactagtctgtcaggtgccactcagtgacctgggagtgaagatcaggtctggttcggatacatcaagcattaacgctaccagctgttccctcacattttgtcttcatccccaagggtggatggaaaggaagaaggcagtgatattgtttcagcctctttctcaatctcttggcctgcctcagcccctgcccctgggtcatcccaccactgcctttgggagccagagtcttcaagccagaatgtctccaaataaagctgtggggaccatcctgagtcttccccaggctgaggaaggatagcttgtctgctcagttacctgttgttttctatttccatcaatttctgttgttttctattgctactgtaacagatt

SEQ ID NO: 106036 - DNA, 1024 bp, Homo sapiens; identical to SEQ ID NO: 106035

SEQ ID NO: 106037 - DNA, 1024 bp, Homo sapiens; identical to SEQ ID NO: 106035

SEQ ID NO: 106038 - DNA, 1024 bp, Homo sapiens; identical to SEQ ID NO: 106035

SEQ ID NO: 106039 - DNA, 1028 bp, Homo sapiens
tgtcaccacgctggagtgcagtggtgcaatctcagctcactgcaacctccacctcccgggttcaagtgattcccctgcctcagccccccgagtagctgggactacaggtgcgcgccaccacgcccagctaatttttttgtattttcagtagagacaggtttcaccgtgttagccagggtggtgtctatctcctgacctcgtgatccacccgcctcggcctcccaaagtgctgggattagaggcgtgagccaccgcgcgcagccagcactggcagttttaaagtgtctttgtccctcactcacctccctcaggtggtcgcactcctgatgagcttcagcacatggtagtgacagctacactggcacatgagggctcccagcccccagaatgggcccaaacaaatgctgggtccatccgcttccctcaggccaccctgcatcagccatgacctctggccccgtggcttctgccgtgaccatgcatgtgccctgtcctcacaggtacctcatcaacttcctcctggacgccactgtgggcatgctgctcatctacgtgggggtgcgcgccgtcagcgtcctggtagagtggcagcagtgggagtccctgcgcttcggcgaatatggtaatatgctgtggatgccggacagggcgtgagggaactgctggaggtctctgctccttgccccatgcggcccaccaggcaaacagatccagaaatggctggggagctgccattgtcttctctgtgtggtagagggggctgttctgggtttgagcacaccctcctgtgggtgtgggtgcctgctttaccaccaaggccctcaccttatggcagggaaggtggcaggaggcaggagacactagacacagagagagggctgaatgtctgctccttctaatggaagacaccagcagtcccacacacaggcccgcagggactcttcgttctgccaagcttcctgtagagctcacatcacctgcctaccaggttaaagagatggggcagctctcatttttcgaaggtgttc

SEQ ID NO: 106040 - DNA, 1027 bp, Homo sapiens
gtttaaatggcagcagctgaaatttctttagggatccagctgcagtactggatttgtgcacgtcttgttaatttcacacataatttagctcattgtgagtgaagttgaatgggagctctttaaaatagaggcaccttgggcttcatcacaaagcagcgattgagcattttattttgaagtaagaaaaaaatttaaaacgtattttaaatatcaatccttgaccttttagggttttcaaaggcagtgttattgaaggctttgaaaggtggctgagatgccaagcctgagttagtgctcaaggccccaggaagagataaccagtgattggaaggttggggtggctttcttcctgtttcagtcttctcgttttcctcaaattggatattgcgctcctgtcaggctaataaccagtgctggtttattttgtacaggtttttagacacttccaaacaagccataggaatgctgttcatccactttgcaaatgtatacctagcagatctcactgaagaggacccttgttcactgtaagtgttccctatttgagtgcaaacatcagctgcccctccattgaaaatataggctggccttgctttctgctgctggtcctgctccctctggcttggggagagggtgctccccttttcctctgtgctcctctgagagaccatcctgtacatgctgtcctggagctcacttacacagctatcagttggcttgtagggctttgcgtgttgacactttccccatgcactggctttctgttcatcaatccaagttctgtcctttgattttctagtgtccttatgtctcccagtttccaagccgcccctggcaaggaaggataatgccctacaggagtgtctctgctctggaaccaggacacaccagggcttctctgtggcgtcagccattcagggtcaaaactgttgttgaccctcattgacctcttccaccttatcattgcaatgtgccttccatgcagcccccagagcaatccatctgtgacctcaatccggccatgata

SEQ ID NO: 106041 - DNA, 1055 bp, Homo sapiens
tccgggaaattccatgaggtttaggtgctcgtatcaggaccaaggccagagaccaaatactagaacaaaaactcctcttagcacctgtgttactcaggagattacaagtgttttaggagctctgtgtcagaaaccaggacagagaccaaatacatatatttcttaaatagactttgatatatacatcaagcatatatttatttcacagattatgatcctgcagtcacaatttttccttcgtgaaatggtggtaaagcttcagaagtaggttctaaagacaaaactccaaaataatacatcacttggaaggatacagtcagctcttcaagacagcactgtgtccacaagaagctgcctgttttaggctgccttgggcttctacatttcctaacaaaatagccattttatccttcagaggaaacgtcagtaatcactgtgataaaattattaagcgtgtacttgttcttaaacgtgttgctggcgaatttgataattctttttattttccccccgttgatttttctcaaaccctgttaactttagaatgtgtgactcccacctcagggctggggcaggacctggtgggagacctagctttggggctctcttgagtcttacatacgttgtcctttggtaactcctcctttgcagtgagtctagggaatgattttccagccaccgtcgctgggttggtctggataatctctgcagtcctgagaccctgcccagctgggcggctgtgagagacagccatgaccaagaggtgcctcgaccacagaggagaatggctacctggtgctggtggtggaggacatactgaaggcacacgctgtctccaccatgctcctgtcacatgggtcggggttagctcctctcagagattaacacccttgttttttcttttttgaaatgcttaccatctagtccaggggctggcacactacagccctcaggcccggtgtgtatgattggaatagctgtgtctatgactgcatcattctctagcggcagggctgaggaattgagacagagatcatatggcgcacaaaacctca

SEQ ID NO: 106042 - DNA, 1055 bp, Homo sapiens; identical to SEQ ID NO: 106041

SEQ ID NO: 106043 - DNA, 1055 bp, Homo sapiens; identical to SEQ ID NO: 106041

SEQ ID NO: 106044 - DNA, 1055 bp, Homo sapiens; identical to SEQ ID NO: 106041

SEQ ID NO: 106045 - DNA, 1086 bp, Homo sapiens
cacccggccagtgattacctatcttaatgggttatgagaattaagtgagatacagtgcttggcactgccgggtgcagggtgggtgctgagtgttagctcactgaggcccaccatggctgactggccgccacgtcacacaaccctggggaggtaggacagttcacaccatgtcatcagttattagaattgggaaaatacagcttaatccaagacttcatgtacaggtcgaactggagggattgaatggctcaccggagactttccagcaggtcagaggctgagccaggactagaacccagaattcctctgtcctaggcctctgccctttcccctccaatgcctactcttactgctgtttctgtgccccctgccatggcacacatttacttatgctcattggtttgtccagggagtttgttctagactatggcatgagaaagggaactcttcccacctacgaactgaccttcctaacattgtgccacttggtcatgacagcccaagagcacaagcctggagccgcagccagtggcaggtggctgaggcatgtgaaggtggagggatgttgcacactcttggtaaacatgggctttcttccttccctctcccagcttcaggctggtctggcagaggcaggcactgggttgcccaaaagcgtgagctgtgttaaagagtgatggcagaagcagccacaggcagggtgtgtcagaggagacctgttatggactcagccagtgtggcctgtgccagtgaacttcaatggccattctcagttttaacctgcattaagacttgagttgactttttatcacaagccttgaaattttggactatgtatatattataaatgtagacactagccacctaccttcagtgtagaataacattcttgaattgtttttccacccacagttgatccttgaacagcgtgggggttagagcagtcaacactccacacagttgaaaacccgcatataacttctgactccccaaaaacttaactgctaatagcctagtgttgactagaagcctgacccaataacataaacagccaattaacacatattttatatatgtattatatat

SEQ ID NO: 106046 - DNA, 1086 bp, Homo sapiens; identical to SEQ ID NO: 106045

SEQ ID NO: 106047 - DNA, 1086 bp, Homo sapiens; identical to SEQ ID NO: 106045

SEQ ID NO: 106048 - DNA, 1086 bp, Homo sapiens; identical to SEQ ID NO: 106045

SEQ ID NO: 106049 - DNA, 1027 bp, Homo sapiens
gggaccccagacaccctgagccacttcctctgtgcctgccggctttttccacccctctttccacacaggttcactttctgattactccgtatctgtggctacttcacctcattttttttctatctgaacaattctgattttctttcttgataattatttttatttaattttatttaaagcattattgttttttgactgttgataacattaaaaatataaatttgaaatgactcatcaatcatttcatgcctacatgagtcacacgctaggtctgcttttctgggcctttgtgaagattttccttgcctgggcagagggtggtgattctaccccaaggctgaggtctagcatctgaggcgaaggcacccccgccctaccccagagcagcagaagcaggcagcacggagtccctttactcgctggtgaggaagggtctgcagggctctgggtggcttcaggttacctgctgagtttcacagagttcatttccctgttggttgccatatgactataaggaaggtcattaataatcttgaggtttacccagaagaattatccttttccttgtgtatgcatagaagcagttggtgagtctcttttagattactccactgctaggaaagctatccattgaatccagagtttttcagcctggcactgttggtactttggatgagataattctttcttgtgggaggctctcctgtgcattgcaaggcatttaacagcatccccagcctgcctctacccactaaatgccagtagaatctctcattgtgacaaccaaaaatgtctcccgacattgccaactgccccctggggggccaaatcgcccctatttaagaaccactgcatcggttcagtttgtgaatttctcagcaaactcatatttgctctagaagaacagattagaaggtcagtgtgttgtttccaaagtataagaacagtggactatcaggatctcttaagtactttggtgccaagcccgctattggatgtttccttgacgaagagctgagactggtcc

SEQ ID NO: 106050 - DNA, 1027 bp, Homo sapiens; identical to SEQ ID NO: 106049

SEQ ID NO: 106051 - DNA, 1027 bp, Homo sapiens; identical to SEQ ID NO: 106049

SEQ ID NO: 106052 - DNA, 1027 bp, Homo sapiens; identical to SEQ ID NO: 106049

SEQ ID NO: 106053 - DNA, 1075 bp, Homo sapiens
gacatcacgctgccccactattagtgttaataaggttgatgacttggtgatggtggatggaagacctctcagtctctccctcgtaaaggtacatcttcccctgggcaattaataagggatctctgcagtgataatactttgagatcatgtgaatactctgtttcccagtagcctttcacccagtgatcacctcctcctggtaaaataacagaatacagtgacagctgaattggagctggagctcacgagtgaaggcgcctgtctttgggtctggaacccagcacaaactcaatcagtgtcgctgtcctttcctccttctggagtgccagcatgggcaaaggaagaacgccccttttttcatgccaagctggtgttgtggccaatgttagcatactggctggctcagagctttcatttttagaaagttttcaggttttctaaatgtttatttatttggtagcatttatccataatggcaatctgctgcttgatttatcatgtaacttcattaatttcgaataaaatcaggacaacaggaagttgtctgaattaggggacaatctgagttgtagaataacttaccaaatgcattttttttaaacttttgaatacctctgttggccacatgttgccctgttggggcctctcatgcttctgctgctttaatatctgtttaaagtcttttgcagttagtatatttgcacaaacatgaagatttgttgaaggggttttacaagtggttaaaaataacaggatccctggctctggatccagcctgacccagcatccatgtctgcttcgctctgccatgtggtgcccctgagcaacttctgcatttctcaaagcttcagttttctccccagtaacatgtggtaataatctgtcttttctggggctatggagatgagaaagaatgtgtttgaggaagctgggttggtgtcaggcacatgttaggccctccttgggggtgtgtcttcatccttgttattacattgtattcatgagttgggctgaaaaatgtttcacaagtgcttaagtaacttattttctgaattaggttaaacattcccctttc

SEQ ID NO: 106054 - DNA, 1075 bp, Homo sapiens; identical to SEQ ID NO: 106053

SEQ ID NO: 106055 - DNA, 1075 bp, Homo sapiens; identical to SEQ ID NO: 106053

SEQ ID NO: 106056 - DNA, 1075 bp, Homo sapiens; identical to SEQ ID NO: 106053

SEQ ID NO: 106057 - DNA, 1008 bp, Homo sapiens
gcagcaggaaggtcagcggctctagagcaccaacaagaaggtatccagagagagcccagattgggctgggagaatgggtgagtgtcaactggacttacaccatgtgttcactgacattctgcagcaggaaggtcagcggctctagagcaccaacaagaaggtatccagagagagcccagattgggctgggagaatgggtgagagaatggggactcagggtcttgttaaaggcagagcacaggttctgagaagttggaaagggttagatgggagtgtgtgtgtgcagggggatgttggagcctggaaaataccaaccatttgtcttttacactctaaaggtagttgtgctccccaagtgaataaggtgggacatgtgcacgtcaggttttcagtgtgaaacctggtatatttccaaatgaaagtgattggattcaggtgaccatttaaattatgtctatgaaaaaagaaaatagacttggggccttgataagcctttagctagggaagtaggaaaaagactcaaatgtctgggttggagggaagactcctgtactcagtctcagattgttttccttattcacttgcttcagaataatccaggctgcaaactattgggacccaccccagaactactgaatcacgatctctgagggtggaattcaggaatgatgataatttctccaggatatagggattttccttagagggaaaaataatttgaccacaggccgtcccagctcctacctccggacctggagctcgtgattcccaggctctcattccggtctgcggtggccggctcacctggcctgtctacctgcgggcgtggcggggttggagaggggagcgggacccgcgaccccgccccgtggcccggccggagccccgcccctcgggggcgggtggggagagctgccgcggccgaggcccgccccaaccttggctgcgccaatcaggcactgcgatctcagacgtcgggttacgcgcggcgcggagtcggcggccggg

SEQ ID NO: 106058 - DNA, 1545 bp, Homo sapiens
ctatctgcctttgttcagcaatgcaggtggctcctagcatttatctatgttatagatatgtgaggtcagggaagggtacttactaacctctggaaaagatgagcttcttgataaatatttattgacttatggtagaagcaaacatagaaaactagttcagaacttagccttaatatgccttttctcctggaagtaaaatattctcactgtgagagagaagacattggaccttagcttccagaggacctggatacactttacttgctctctagtaccaattcagtcacgaatgtggtacctgaatacaatttaaaagctttaggaggccttaggtagggtgggactcagaatcatttccctctctcaagccaaaaagtgtttctgagggacacatagaatatcaggcaatctagatgggaacatttgggaaaactatcacaggcaattatatttacttggcacctatatcaccaaagattgttctatttgagacaccatttactggtttaattgatcaacagtggaacacaccctggatttgaactctgatcctgtatattgaggatgtgccgtgtgtgcacacaccagttcagaagtgttctgtgttatcagtaggaaatctgttggtcttatgaagttaaatgagtagaaggcatcactacaaaaaatgaagtacaaatcttggtggggaccagatgccccctttgcaagcttggatttccttgctcctgggtccactgtaagcaaccatatgtttgtcatggtgctgactcagaaatcgtaggacagagagcctcctgcaaaaccaaaaagaaatgttactttcctgcgattataattcttccttgactttgttcactttagatgttttactagtgagttttgatgactcccaccccttatgtgagaatgtgcatactttggaaacttgaatttatccaaacaagctacctatgacttagagtttgggcataagttttaaattcaatgctcagtcgaactggatctggttccaggcccactccaagggtggtttcaggggtgttttttcagtacttgtcccagaccacacaggtagccttgtttctgagggcagctttatggggaggtgtagaaggtggtgggcagcaaatgcactgcagagtcattttcttgggtatggtgtttaagaagcctgagattttcacaagaaccagcaaaaccaggagtggagagttggggagatagagaagtaggcctaaaactccctcttcttgagtcttttttgacttaatacaccattgggtctgtcctggtgctatggcctatcacaaaggactgttttaagagagaagcaagccacagccttgccagataagtctccaacaccagcagaaaagcacggaccctgatctgtgggaggcaagggtctcccattatttctggaggcaaatggtgccttctagtgaaatggtgccaccatttgctgatgggggtgcctgttctcaggatgtgtggaaactcaggcctgagggtttctacatggtttattcaatctaactgcat

SEQ ID NO: 106059 - DNA, 1018 bp, Homo sapiens
cccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatgattatgtggctctagggttttgaatgtatagtcacactttgatcattttaaaatcgattcttaggagttcctttgtttactacctctgttgataattgagcttacagccatgtatgaggttttttgtatgatgccatttttaagctacataaacactaaaattatgacagaatttggagggggggaaactgtttgctttcttaaaaacattatatggggcacttacaccagttccttaactgacctgatctgagaactctactgttactgttctccatcttgacccagccgaggctgcctgtgttaagtaacatcaccaagactgttagtatttctgtttaattgccctcttcctattcattctcagagggacttcagtgacttttattttgtgtttacttttctctagagttgtttgtctacctctgtttcatttctaaggtctttactttgggtgaaaatcagtaagtgttccatggacccacagcgaagcccatttgtccttctttccaggtgtctccagtgtagaagcacagcacagaaaacatgttttggagggtaacgcagagcatggagtttctgttagcagtgtcctcagtggcaggataaatactgagatgtggttaaggattctggaaacctctttgcctagccacacttagacttttttcagctaatcctttaaattgaatataatctttagtccgaggattcccatttaaacaactcagtattcttttaagtgtgtcttttagcccagctcaagttaacatgaaactccaggtgaattttcacttactattccattgctagctattatagaataa

SEQ ID NO: 106060 - DNA, 1035 bp, Homo sapiens
gttttttgttgttgttgttgttgttgttgttgtttggtttttttgacacagagtcctgctttgttgcctaggctggagtgcagtggcacgatctcggctcactgcaagctctgcctcctgggttcacgccattctcctccctcagcctccttagtagctgggactacaggtgcctgccaccatgcccagctaattttttgtatttttagtagagacggggtttcacagtgttagccaggatggtctcaatctcctgaccttgtgacccgcccacgtcagcctcccaaagtgctgggattacgcgtgagccaccgcatccagccttgttcttttaaaaaaaaaaaaaaaaaaaaaaagtatcatcaagggagtaccttctgttacagattttgcgaacatgccacatttgctttcttcttagatttgaaggaaactaagcctcacactttactgatcttaagaattatctcactattttactgtgttttcttgacccagagtaccatcctcgaggactgtccacgagggcctgaggaatcaggagctgaactccacagagtcaggtataagcacatgtcatcttaaggaaaagaagacttagtttcttttaatggactatatctgaaaataacttaaaacagtacatttgatgtatagtatgtgtcttcatagaggggtctcttaattgtgactttagagttataactgtctaagatgtgtttagtttaataatcatctctaggctgatagttccgtccatttctaataattgtagctattctttactgatcaaccgttgtgtgccaacggctcagaaggccaatgttaccatccttgactttagctaaagaacctgaagttttccaggcagtgttctttcttaagctagatggttgagaggtagaagtttattctttttaaaacccttttttatgatatgcatactttgtatataaatttcacagtttatgtgaaaaaaataaagcaatggaaaaagaaattgtcccagaggcaattaatgcctgataaatgaga

SEQ ID NO: 106061 - DNA, 1038 bp, Homo sapiens
tgctcccagctttacacagattattattggcaagtgtcttagtgcattctagctgctgtaacaaaataccatacactgggaagtttataaataacagaaatttatctctcacagttctggagactgggaagcccaagatccaggcgttggcagattcaggttctggtgagggtgcatttcctggtccatagttggcaccttctcgttgtgtcctcacatggtagaagggactactagctctgtggatctcttttataagagtactaatctgcatcatgaaggttctgcccttgtgacatgatcaccttccaaaggccccatcttctcataccagcacattggtggataagtttcaatgtgaattttggagagtacaaacattcagaccatagcagcaagaatgcatcttcttgtgggctcttggactgagggcctgagctccttgctgggtgttggctggagccttcctttagttcgttgccatgtgggcctctccgtaaggcagctcacaacatgacaactggcttctgtcagagtgaggaagcaagagagcaagagaggttgaggaagatggaagccagagtctttctgcaacctaacctcgaaagtggcaacccagtttccccctttttaaacagctttctggtgttacaattgacgtaccagctatcaccatagtcagattgagaacattttcatcatttcagaaagaaaccctatactcattagcaatcaacccccactccagcatccacgaatctactttctgtctccataggtttgcctgttctagacatttcacataaatgggatcatggtcttgtgtgactggcttctttcatttagtgtactgctctcagagttcatccatgttgtagtgtgtgtccgttctttattcctttatatagctgaataatattccatgctataaatctgacacattttgtttatctatttaacagttgatggacatttgaattgtttccattttttgactattaagaataagttttatagttttctcctataaaactttct

SEQ ID NO: 106062 - DNA, 1315 bp, Homo sapiens
ccaatccatcatcatgtccctgttcagatgcatctgattccagtccaacaccacaggcttccctttgcttatttgtcacttctttttcccatggtgagaaacctggctcttattattcatagtatatttatttaatgttagtatacacataaagtattaatagttccagatttgctaacccagacctttgtgaccatataatgtttcatctaaattagaacacttttgagagggaaaggggggatgttattaattattatttaagagtaattggtggaaacatagacttttagggaaactgggaaatatggctccctgtatatggtacatattgtactaatttattatcattatggtttatttttgtcttctcacttttctagcatcataaatttcctgttggttgatgcagaaatcattcttgtaaacaatgtgttgaaagctattaaaatggtgactagtaatttatatacttaataggaagcattttctgtaatcataatagactgctttggtgaaaatattgagttccttcattgtcagatggaacagagcagcattgctattcgtttgttttatctggattgcttctgtaagttagaattggaatttctcaggctttccttgagatgttattgcatttagtgcttcggaattgtaagtcttaaaaaagaacattggtcaaagaaatactcatttaagatacttgtctggtgcttaataacatttccctgttaaggtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggtaatgaaatacttcctatcaagacgtgacgtgattttactgtaagaaaatttggattgtccacagtcttgaggttttaagtctctcgagcatataggtttacccagcttttctaggttagcattttgagtgaaaatatttataaggaataatacacatttccctgtcttttaaaattattttctttgctacataaagcctcaggtttttatgatgctcatagggaacactagctgcatatcatcctttcagactgtgaggttctctgagtttgagatttgtagatctggttgtttttaagcccgttgggccagactgatgtgctgttgattttc

SEQ ID NO: 106063 - DNA, 1041 bp, Homo sapiens
tttgaagggtttttcgtgtctctatctccttcagttctattctgatcttgattatttctggtctcctgctagctttggggtttgtttgctcttggttctctagttgatttagtcgtgacgttaggagatctttctagcttttggatatattttgaagatagtacctacagaattcttctatggattggatataaggtatggagaaaaagggaggggggcaaggataatgacacttttttttttttattaaggtaaaatatttactaggagtatctttcactctgagagtactaagaaaggatcaagttgaaaatttaagtttgaaatgcttattaagtgtcttcaatgtttgacattagaatactaaatttcagtccaaagtgatagtaatggtttatactcctaccagttttatgtgatccatttgggtgaactctagatttgggtgcctcttcagcaagagatagcatgtcaaactgctgttctgtgaagattcgttgacaatcagtgcactaagggcacctatcatttaaaaaacaaaaacaaaacaaaacaaaaccccacttaattcttttgtgcaaaatcagttgtgaagtaaattctgtaaagttaggtttattaagtttatatttttataccttgagttttctttaattgggattcacctgtttttgttttatttttaattctagatgccggctctggtatggaagaggtagaattaagctgggaagattatctagaagaaacagggtccacagcagttccctatgggtcttttaaacatgtaagcaataactatatttgccttactggtgttatatccctttatttcgaatctctgtattatcattagagaatttaaagttattttaatttgtggtacttgaagtaatttaagagctttttctttcctcctgccacccttagtaagaacacttgccatattctttatttttttatttttttatttttttttgagatggagtctcgctttgtcgcccaggctggagtgcagtggcacgatcttggctcactgca

SEQ ID NO: 106064 - DNA, 1319 bp, Homo sapiens
tctgcaacctccgtcccccagactcaagccatcctcccacctcagcctcccaagtagctgaaactacaggcgtgcgccaccatacccagctagtttttgtatttttagtacaggtgaggttttgccatgttgcccaggctggtcccaaactcctgggctcaaaggaatcctctcacttcagcctcccagagtgttgggattacagtcatgagccaccgcttccagccctaaagctgttttttaaaaaaagaataagcaggttcaaagcttattttggaggaattctctttataattgtaggctaatacagttgatatttatggatctgcataatattctagatagatgagatggaaaattagataaagtaatactctatcctgaatcatattcgttgtgtaagacagcattgaaagctaactcccctgtctccctaggagaccattaggaactggagttttgtgtataggaatcatggtgctaagtatggtaatgtaaatttaaagggtaatgattcatatgcatcttactttgttgtgagttttagatttattatcaagatctcgatagtgtgcgttctctacacatacagacgcacatgagcgcacacatacacatacagactcttcaaaattagaaaaggtatcaattttttcctccagtcctatctattctgccagtatgtttttgtcttatgtcatctctcaaccagtcgagtgccctgtttgatgagtgagtgagcacacttgggcttcaggctgtttaatgtgttctttttcatttttcagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcaggtattggttttattctcagaatttattctctaggatgcacaattatattacttgcctgtgttatattgtctgtttctctaccactgaactggaagctctttgaagtcttaagttgtttttcattgccatcttctgtacctctcagagaacctggcactaggggctactaataatgtttgctgaaaaaataagaaactgttatgaacaaggccgggcgcggtggctcatacctgtaatcataacactttgggaggccgaggtgggcagatcacgaggtcaggagatcgagaccatcctggctaacacggtgaaaccccgtctctactaaacaaaatacaaacaattagctgggtgtggtgacgggtgcctgtag

SEQ ID NO: 106065 - DNA, 1181 bp, Homo sapiens
tcatgcctataatcctagcactttgggaggccaaggagggaggattagttgagacgaggagtttgagaccagcctgggcaacctagcgagaccccatctctacaaaaaattgaaaaattagccaggtgcggtggcacgattgtgtagtcttagctacttgggaggctgaacccaggaggtcgaggctgcagtaagccgtgattgcaccatcttactccagcctctccagggacagggcaaaaccctgtctctaaaggaagaaaaaaaatcccttctcaaacctttatctttagcgctgcctccttcttaagctattatttaattttgttgaggttcttgccagctcttcctttttgagagtgcggctaagaaccaaccacacagatctctgggctgttatatctaggactgtaggcagccccacagggacctacctgtaactgcagtgagcagctgtgggggcacagggagggagggtaaactctgttaacttgtggccatgaacatgcagcttggtaggaattccagctatccttaaagggcctcagcctttttactttgtattctctgttgagttcctctatttgctctttaattgctaaggaagacttactgtcctcactgagtggctacgtgtgagtcgtttgctgtcttgacttatggttttgtgtgtttttagaatctttcctttctagtacaataaaatatttttattattttaaaaattaaactgattttggtagaatgctaggaaagggaccaaaaatttagttcatgttaacttactggagaattttggtgggatagcaggttttgaagagatgaagtgcctttttattacagcttattactttactgttgatacttgtaagctgttacttgagacataagcattactgtggcagtttgtgttttcatgtagtgatgtttatggtgttaatattttttcagataattaattttgcttttaataatttaaaactacactttctgtaaagtgatcagttgcatttgggggtagaactttttctgaagcaatgtgcttacatcacttaacccatccatttgcacgcaatattagctcttcaaaacacagcccaacactgagagaaagcaaaatcagttttcaagtgctgacaataattgttataaagctcccgcaccaaagctgatgtatggtt

SEQ ID NO: 106066 - DNA, 1033 bp, Homo sapiens
taaactgatgtggggcagatagggttgttaagtgtcagtatctgtttatctgggaaacttgggttctgtctgagatggtatttggagaggatcttagatgagagttggaaggtggtttgttggcagttgaaagtgtgggacagtcacacatttggaatgacaacatgagctgggatgagaaatttagcaattactaaaatgcctcaggagtttttcttgctgatattcaatttaaagtgttagccaacaagtactcagatttgaattccaaattattattttttataccctgaagagtttttaaaaaagcatttgaggtggctactatggaatatttgctcagtagtaaggctgcccatgggctgccactggttcttcatttctgttcacattaatttgctccccagactagagtgctttcctgtctctcagttttttctagtgttctttcttaaggatcggttcttctaaaatatgctttttctgtgttaaaaatagtatatggtaattttgaattgtaactttaagataccttttggtctcattttgacttgcgtcataaaataaccctcttggagtggttagatggtgatcacaccaatgcacttagcatattgcctgtctagaacatagtgatatataatgaggatataaatttttattattaaaaatgtttatatgtaacaaacctgcgcatcctgcacatgtatcctggaacttaaatgaaatcaaataaaaaaaaagtataccaaaattagccaggtgtggtggcggacacctgtagtcccagctgcttgggaagctgaggcaggagaattgcttgaacccaggaggtgggggttgcagtgagctgagatgacatcactgcactccagcttgggcaacagagagagactctgtaaacgtatggttgtggtaagttatatacatatagcatgaattgtaccattttaaccacttttacacgtacaggtcagtggcattaagtacattgacattgttgtgtaaccattaccaccatccatctctagaa

SEQ ID NO: 106067 - DNA, 3626 bp, Homo sapiens
cgggcccgccgcgcgcccctccccgcgcgcgccccgcgctccgcccgccgagcccccgcggacccgccccccgggctcgctccgggcggggcgcgaacccgcagctggggccgggcgcgcggccggtcggaacttcggagggcccgggcggtcgctgcgcggtggcggagcgtctagtggccgccgcaaccggtggctccgggccgccgttgtgaagtgagcgggcctctcccgcgccgcggcccgccgggcaccgccgctggaccccgcgccgacccggcagcgccccgacctgccgctcgggaggtccgcgaccgtttcgatttctgttcctaaagtccgattttggacgctgaaaaggaggctgtggaggggcgagcggcgtcctgggaagcaaggcctgctctgtgcggagcagaaacgccttgtgcgaacagaaataaattcccgcggaaaggatgtacgttatgctaagtttttcacaagatgtcagctgttcccgtagggtctaaaactaagccggcaggcacaggtcacccccagagcttgtgctcaaggagtggtggacgcttgggtcaggtgggggtgttcccagcgggtcgcccgaagcagcactggttgatggtcccaagtggtgtttttgagtcctgttagcagtgatctgtgtttgagaaccaagtaaccatcaaagagattcgaaaggaagtaagatggattttgtcaatccctgcgtatgtcttctcttgaaccacattttctaagatgtcattcttaattttattgcatctgggtaaaatgcctgaacgtgtaatcattaatttgtcaactggcgagaggatgaaggaagatgtgtcttcatgtgtacactttgaggcctgttgactagcgttttgaggcatttgttgaattaggccgtaggtagattcggagttaagatttgtttgcgatgtcagaaaagttacggcctggtagaaacggccagagatcaggaaacagttctgttattaccgttgtcattgactaactgccttatcttgggcacatttcttacccattgtagctttgattttccttatttgcaacattaagataaacagatgatgtttgggggtgctttcagttcgaaaattcggtggctttcttaactgaaagattcttagaaatcacagtgtatattttgagaggtactacataaaagtgctcgcaatgtgtgtctttattaaaattcatttggaaaaaacatcttggtagctagatccagaatggttttatatgattatttgaatagatttttaacaatgtatttttatggaggtatgtataacctaccgaaagatcttaagggtacaattcaatgactttttatatatgtatatgccctgataaccacactcagatcaagatatggaacattttcaggccttgtatcctttccattcagtaaacacattccccctccccaaggcaaccacaattctgacttctgtcaccacagatgagttttgcctcaaaacaggacccttttgagggttaaaggggcaatactaacaaactgaggatagcttgtatgtaaacttggagttatggccgtgttggccatgaccctttgcttttataatgattcttagggtttttgtaatccagaataacttaaaattctgtcctgaggaacttcttagaaggtcacttttcagtgggggcaatactttgcaggttacgattggtagttcttgggagtccttatgttcacagacaatggtattaatctatgacttcccatttttagaatataggtactatatatttgtagacaacagatttgaagaatgaatcatgaattttcctaacaagttagagtttaaggtgtcagtagatgaatcagtttcttaatgcctagaatttgctgagaaaattgaatgaaaattggtttcttaaagttaagtgaattaagaatgtgtgcgtaaagctttaacaaccttttcaatgacagcagttgacttatatatacaggatagtcagctggtttatcaaatcatttaaagtgcaacaatgaaagcaaaaacaaaaggttaactaaaaattatgtcaggtgtgattaaaaaaatcagcatgactaagatacctttttttttttattaaccctctttctaggaaggtggacttttaaatattctccactgaagcaaatgctgcaacaatttgcatttccttcaccaatgtcgtcttgtgccttttcttgttcctactgtaaaggagatgggttagatgttgtaagtgaattcttattttgttagttcctaacaaaggcttgtgttttttactgcaaagatatctgtgtgataaaagttgggaatgttctaaggcctgtggtgtagggatccatggggaatagtccacaaagttaaaaggttttcttttgtgaaatgatttcgctgaataattctgtctttcccgtgttaagctagccagccaactgactgaccagcaactaagctggatttggtcactccacccaagattcacagcctcattagccaagagagtaattgatgacttagctattattgatacattgtttctttttgtggctctttttaaatttcttgacttttatgtgatcagattgtttaatttaaaatctattacatttttaagagaagcaactaaagagatacacgagaaacaaaatacacaatgaaagggaatttcctttttttgctgttttgttgtaaactcagatttttccttttaaaaatgattgctggctaggcacagtggctcacgcctataatcccagcactttgggaggctaggcaagaggatcgcttgagaccaggagttcgaggccagcctggatgaaagaaaagggagaccctgtgtctccaaaaaaataaaaaaattagccaggcgcggtggtgggcacctatagtcccagctcttcaggaggctgaggtgggaggatcctttgagcccaggagttcgaggctgcagtgagctatgattgcactgctgcactccagcctgggtaacagagtgacactgtctcaaaaaacaaaccaaccaacccagtatgatttgcctatccataatcttcctgcttctgtagtatacttttgctttcacagtgatacctagactgggtttagctgtggaatggtggtgtagcagcaggtatcatttaactctaaagtctgtagaaaagatgaactatacaaacttcattggctttttattttggcgtcatgttatgttcacattaagtaaatagatacagtccaaaaaccaaaaggccattatttaggcagacattttacatctttaatatttttaatgttacattttttctcttataattttccaaaattttgctttcttggattatttggcttataaccaatattttggaataacataaaataaaagaacttgtaatgagtaaatgatacaacttccttatggcagagtatttttcttttagtatatagcattcgttacctaactgggatattttgtatttgaaaataatatttctgtatatacatagttattaaatgggataaaagtgtgtggggattttggttacttgcgagattttaaaccattagagtttggggagtgggattttg

SEQ ID NO: 106068 - DNA, 1038 bp, Homo sapiens
tggctgcctaactgatatggtggtatgttctgtagcaattgaaaaagcattgaaaaagcaattttgaaacgttctatttcggagccagtaaattttgtcttcatctcatttctgaggggcctgaagagttaaagggccctgggtgctccacctgtgaggccgaatgaacactgggccctgggcgcttaggaaggagggaaggggatgccaggagcagggaggtggtgcctggaggctgcctcactgtgaggctggcaggggccaggctctggggcagctcccagccctctctgcttctcccggcttcaccgtggggtgattctcatttttcctggggcccagacagcaggccagccctcaggctggtgggcagtgagaggaggaggacccagacatggctactgctctcagggtagaggcctaggcacttccactgagggggcagtctctcaccttttacttcccgcccccagccccctccctcctccttgcttctgagtgcaaagcccctgcaggagaaatggaactggcacagattataagacagccactgtagatcacaggtcatacattagccagtagatgggccaccctggcctgagcagcatttgctaggtgtaggccagtcagagtggcacggttcatccctcatcgccccttccccagggagctgcatggggacccgtgacataacagctgacttgtgaaggaatcttctagaccatttccctgtcacatttcttctctccctccaataaatgtgtcccaatgttatgaccctattgactctactgtcacaatgttgacaaaggggtttggcagaggccacctgggttcacagtgctcagtgggaaagagacctgaaaaactggcaactcctggtccttccttcccagcggcctctcacctttaatctgctctgcagtgccccatcacaggttggggccttggaacaggctcgggagctgtcatcgcagtcagtgagcagtgactaattaagacacggctgcattagtcacattggaggtgacaactgag

SEQ ID NO: 106069 - DNA, 1351 bp, Homo sapiens
ctgttgatggtcagttttggctattatgaatcaaactgctacagatgcttttgtgtaagtgtttttgtgaacatgtgtgttcatttctgttggatatatacctaggggtgcaattgctgggtcgtaggttaggtgtttgtttattttattaggtgcttgattatggccctcttaaaaggggggaatcaatcccatttgtaagcctcctgttctctgcttagaagatttttccgaagcttgttagctatagaactgcattactttgttttagaagaaaatactattatgggcactggttctcactttggatttgtgtaattttctgctggtcctgggcccctggcttttgttaaaggtcttttcttcaggacctgctcaactgagattcccttaacatgcagggtcactactgactttgagtccaaaccagcaggcctattcatgctgatgaaaaaagggaacagacttgcttgctagccagataagcttttagttgtccagcaagagatctgtacatttattcataattgttcttttttgtgtgtgtgataaggtcttgttctgtcacccaggctggagtgcagtggcactatcatggctcactgcagctctgacctccccagactcaggtgatcctcccacctcaacctcccgagtagctgggactacaggcatgcccaccacacacagctaacttttgtatttttggtagacacggggtttcatcatgttgcccaggctggtctctaacctctgggctctagcagtctgctggccttgggcctcccaaagtgctaggattacaggtgtgagccaccgtgcccagcctgtcattttgttttttgctgattatttagtcaatgccatagaatgttgggaatccttctagattattaagaccctgggctctagcatgcagtctgcccattgctgataccagcagacctcatagtctggttctggttctctgggtactcagcagcactgagggtacatgtgggccttctgattgggctctggagtctcagtgagttgtttccttgtaggtcctgttttgctgcgttcctactgtctctatgttctcctgcttgccatcaatggagtgacagagtgtttcacatttgctgccatgagcaaagaggaggtcgacaggtgggtaacctagcaggtacacctttaatcatggccttcagccaaaatgaaataacttgtcaagctttttgcttttcgttctgaacatgcatttacagatggctgttttagaggcaacacttagtccaccagtgtggtgctcccctgggatctctgtggcaccagcatggttcagcaagtgctccccactgtagggctg

SEQ ID NO: 106070 - DNA, 1048 bp, Homo sapiens
caacatagtgagactcccttctctatttctatttaaaaaaaaaaaaaagaacaaatatcagaggggaaagtgagtgtttcctaagcaatatttgaaacaatttatcccaagtgaattgaaaactaaccctcccccttacgacctaaggagacacacactttttccttcatttgctaactgacgtgaaaacaaacacactacaaaaaaatagtgatatccatcacgctgttggaagagtgaactgtaaaacagtgaagggagaaggccagacgtgaaggatgaaggttttcttcagctcatgattcatccaacttccttccctcttccctggccccaggaggacgttgctgtggctgctgcagtcttggagtccctgctcaagctggccctgctggccggcctgaccatcactgtttttggctttgcctattctcagctggctctggatatctacggagggaccatgcttagctcaggatccggtacgcacaagagtttttctggattttttctgatttcccaacataaatagaagagtcacgaaattcaagaacttgtgcacacacagttgttatctgtgtcagtgtagggaaaactgtctggtggcaggggctgtgggactgttcccctcgttcaactccagacacacactcaaggtataggcaggggcgttggcgccaggacaatcagcttccccagcctcacttggagaagttattaggacttctccttgctgttggctttcctctcgggcctagaatgtgttttgccaagcgcttccctgtgctccctctggggtgagggaggaaggcagagggcagacggtaatgagtctccacttggtactaaacacatctgaagatagtaaatgccacataaatctcccagcctagtgcataaaagcctctgaaggataacccaaagccatttgcagagaataaaattgatctctgcaaataaaatggtatatttaatccagtgactctcagtttttgaagaagaaaagtattgaatgtgtctaattttgaaacaccaggccgctgaggat

SEQ ID NO: 106071 - DNA, 1080 bp, Homo sapiens
tatcttgactgtatcatcgttggtatcctggttgtgatattgtactatagttttacaaaatgttaccactgggtaaagggtatatatgggatccctctattacttcctatttttttgtcttttttatttattttttattttttgagacagggtctcattctattgcccaggctggagtgcagtggtaccatcacagctcactgcagcctcaacctcctgggcttgggtgatcctcccacctcagcctcccaaataactgggactacaaatgcacaccaccacgcctggctaaatttttccatttttgtagagacagggtttttccgtgtttcccaggctcatctcaaactccctggctcaagcagtccacccaccctggcctcccaaagtgctgggattataggcatgagccaccgtgcctggccactattacttcttataactctgtgtgaatctataattatctcaagataaacaaactttaatgaaaatattaaataattttaatagtgctataaaaattaaaatagaaaaaccaacatgattgttgtttcttcttttttgttttgtaggtgtgtatgatatagtgaataatcttggctcccttgtggccagattaattttccagccaatagaggaaagtttttatatattttttgctaaggtgctggagaggggaaaggatgccacacttcagaagcaggtaatgttggttcttatgtcatctctcaagtgaattctccctttaattgcaagacagacaggagtgtgaagcagtctgtttctcttctgtttgatcaggaattttcttatagatttcattcttctattacattcttcatgatagtgggacccagggctcacctcttctttcgtggccttcttgctttgctcttggctgtcccttccttctcacacctttgttattcgttgtgaccttactctttttgggggggggggcggggatagagtcttgctctgacgcccagcctggagtgcagtggcatgacctcggctcactgcaacctccacctcccaggttcaaacgattctcctgcctcagcctcctgagtagctggg

SEQ ID NO: 106072 - DNA, 1032 bp, Homo sapiens
cacccctgaggaacctttggataagcttgtgcatataatcatggactcttcacagataatttacgctcagattatctgacctccccttaagacttgggactatcatcttcattattaacatttaataatctccacatacttttttaaaaacttatttttagggctgggcgtggtggcttacgcctgtaatcccagcactttgggaggctgaggtgggcagatcacgaggtcaggagatcgagaccatcctggctaacacagtgaaaccccatctctactaaaaatacaaaaaaaattagccgggtgcggtggcgggcgcctgtagtcccagctgctcgggagactgaggcaggagaatggcatgaacccagaaggcagagcttgcagggagccgaaatcgtgccactgtactccagcctgggtgacagagcgagactccgtctcaaaaaaaaaaaaaaaaacctttttagacttgttttatttttatttttttttatttgtaatttaactggcttggagatttgctgtcaataaagtcctcagcactttccaaattgttactctgagattatttgaaatcaacattaggacaaggacatgtctttaactgattacctagtatttctcctttatttgtcagctggaaaagttgatagctggtgagagaaaggaaacaataaagtaatgtgcatttgacattgctaattattttgcttttttgtttataggcgagcgatatgtgatgacatttttgaatgtattgaactttggtgatcagggtaagatgaaattctgtagtgttttaattaaaggtgaacactattaatagatacttcctaatatttttctctgatatatttaatgaaagatgaacctgaagattaaagaaaatcctgaagattgtaaattgtaggtctttgtactgactatgccctccaacatgactttggtgtcaggtattctggtgagaccccggccctctattttgcctcctgagagctctggtgttcattttgggaggtgggaggtgcc

SEQ ID NO: 106073 - DNA, 1041 bp, Homo sapiens
gaggaatttgactcagcaagcatgtattaaacattattatatgttaggcactgtaccaggtgccctgagtgaggcccctaccctcagaacttgcatggtgatggagagataggatctgtactcaactatgctataggacagtgtgtgtctagcgttatcaaaatagaagcacagaggaaggactgctgaattccatctaggaacatcaaggaaggcttcacggaggaagcttcttttgtgctggactttgacacatgggtgggcagaggttaaatgtatatgtgtggtagagatgggcattcgtgaccacagaaggaaagaaaatttgctcagtgcttgttacctgcccatcattgtgttggaattgggaatgtagagatgactggggtacttaggttggctggaaaatgggggaagggagagaaaggaaaaggtggcgggaagttatgaagggaagtaaacctggctgccaggctagggtcaggtggcagtggcctcagtgctatggagcttgggtttaattcaggggcagtggagcctaatgaaaggtttttgaacagcaccatgatcaaactgtctgtattgaggagcttgccgtctcttacagagttatagtgtcttattttttttcattcagtcctcatactggctccatgagacaggacttcttatcccattttgcagatgagaaagccaaggcttagcaaaattaagtatcttgttcacggcgacatttacactaataattcaaggaactgcaggtcgagccccaatctccaagcttgactccaaagcctgaacctgcaatgagaaggataggctagagaaagagtaagaagcaaaaaaagctcattgggagcctgtggcaattgtccaggtgaggagtaaggacagggggaggatggatgaaagtgggaggatggataaagctggggcagcatcaatagccccagagtgactgggataggtggagcaagagggagaggaaggagtgctctgtagggtggaggaggtgacagagggcagtggacaggatggtag

SEQ ID NO: 106074 - DNA, 1520 bp, Homo sapiens
tgcagacaaaacccatctggctgctcctggccagaagccattcttttgtcctggatgggtggagggaggggtgggccctcttatcaccctaccctttcttcccctatctgtagtagctcttgccctggcgaagaggagagagccagcagctcaattgtgctttgtaatcattaatggcacaggtttccggggtttatagaaaacccacagtccttgatgacggcaagtccttggatattaacacagttaggatacatagatctttgcagggtgctgactaggtggaagagccgttcctttggccaaatacacaccttttgagaatgtatcagacatggctgtggtaattgagctagtgtacatctgttatggaaattacattctgcctgccgagaagaattatgttcttccagttaagtgaagtgttgggaacactttgcaggtagatgctgcagtggagttgggtctaagtgactagtgccatttcccagagggtaaggcattgctgaatagaaagtgcagttaatcaagagagttctattacttgactggcctttgagatcaaatttataggcatatcttaattatgcctttattaaaacagtttattttttttctcagcttttctataccacagttctggtgctctgctatgttatttatttcacaaagttactgggttccccagaatcaaccaagcttcaaactcttcctgtctccagaataacagatctgttacccaatattacaagaaatggagtaagtaatacatttttatctcttatcattttaatcataggtgctgcttatccttgagagaaagaaactgcaactggtttattgttataatcataaatagaattttatagctcatatttatggagtgcttgctctatgccaggccagggtttctaaatctttgcactgtggacattttgggctgctcaattctttgttgtaggggctgtcctgtgcattgtaggatgtttagcagcatctctgacctcaaaccactagatgccagtagcaaccacccctcagtggagcaccccaaaatgtctccagacgttgccaaatgtcccctgggggacaaaattgcccccagttgacaaccactgtgctagaccctatgctgaatgctttacctgccttatttaatgcttaacaacaaccctgaaaggctgacactgtctgtttctattttagggttgagaaactaaggcttagtgaataaatacctgtcctaggtgagggtcagagtgaggacagcagcctggaggggctcacatgccagcagagcacaggctccaccattgtgttccactctctctattctgctgtggttttggttttcttcctcagttgacttctagcacacagttgagagttctgagaaagtagggatgaacccaaaatggtctttttttttttttctccttgagacagtgtctcattctgtttcccatagtggcgtgatcatagctcactacagccttgacctcctgggctcaagtgatcct

SEQ ID NO: 106075 - DNA, 1038 bp, Homo sapiens
caccataaataaaaaacagatttgctaataatttattagttcaagtcagaatttagaaggaccgtaaaggtttttcagatttttctagtggttatatttagttgtatactaacattaacttttctctcttcatcttttataatagattacaaaagaatatatatttaatgtaaatcttaaagcataatatactgaaagatccatgaacccaccaccctacccaagaagtaaaacgttactgatacttatgtccagctgtgtgccctgcccccacagccagggtgaccactgccctagattttctgtctatcattccattacatcttgactttttgatgatgtttgtaaactgcaccttaaccacatgtttgcaggtgattgcagagagcctgtcggtaattcttaagagcgttctgacagcttttctcgtgctgtggttgcctcactggggattgtacattttctctttggcccaggtaagaatcatggcttttaactttttatatgatctttgtttctccaactggtttttcttcttgttcccaccgccgtgtggtctgcattcacagtacccatgcctgtgcaggaggtggaagcaccagaagggtggccttagcactgcttctctagctgccaggtccattgtgttccatacactgagaccgtaggtgtttctagggacctggtgagggccacacactggacttcattgtcaaacatcaaaaaccccttttagacattcagtgggcaagcctgtttcaaactgatctttggtcatctgatagtcttgtaaaggagaaaaaaatcagtggggggtggggtgggaatcaaattgtatatgtattattttccctggatttccatcttttttttgcagaataggtggaaactctgccaagcctgttttaaacttagtttgaaatctcacataattcagagggcatgaatcaagtcagagtaggtatgtgttcagttttagcaatttaggcttcatttccatctcattgtttcctagttctagttcatatttctggttct

SEQ ID NO: 106076 - DNA, 2538 bp, Homo sapiens
agtcaggaaggagaagagtgggagtaattcattaaaaactctctctcagatataatcctatgttcttgtcctgctgacagcaaaggaaacagaaattcagtagtttgtgaggatgcgcttcataatggcagggctggagcagccaccttccttccctcctcagtgattttataattgggatatggcaactgggattcgagcttgagtctttgtcatcagtttcttggaggctcttggaaagatgacttctttgtcttttagactcagcttgtttcttctactcgcctcctttctgttcaaggacacccacgcatattttgtcttcacaaatgacacaaagtatatgaaatgatgtgagtgctcagaatagctcagcttctcaggtgtgtcttcatgtcctgataaataagacaatatgttccagacagcatttcatgtctaatacttaccaaacatatactcttggctctggtctcagagcttagtggcaggactcaagctttgagcaaaggaatcatctgtggagttttgcactacatagtgctgaacaggggcccaggaatctgaatttttataagctccttaggtgattttgaaacagggaccattctttgagaaatatgttttcttttcctcttcttcaccttcttcttctttttctttttttgagacgacaggcttttgccctatcacccaggctggtgttcagtggcgccatcatggctcactgcagccttgacctcttgggctcaagcgatgctcccgtatgagcctcctgagcagctgggcctacaggtgtgcaccgccacacctgaataatttttttattttttgtagagatgaggtcttactgtgttgcccaggctggtctcgaactcctgggctcaagtgatcctcccatcttagtctcccaaagtgctgggattgtaggcatgagcctgagaaatataggcacttggccctaagaaatactgttttaaaagcaggaaggaagaggggcaaatcctcctaggggctcagatttttctccccaggcagccttcctgagattggcaggtcctgctttgacagcccttgtctggcctgccctgctcccctgcttaaggtttggttccatctccttatttgcagtgttccacagaggcactgggtagcaggataatccttggacaaccccagagaccttaaccctgggctgtccctactctggcttcacccagacggctgtctattgaggaggggagatctcagctactcctcgctaagatgcaggaaggctcacccaggtgctgcccacctgggaggtacccaggcacgccttgctgatctgggttgcagcagcctctgtaatggttgccagccttgttgcctgtcttgagattcttttggccagagcctccactcggtagaggctcagcttttctcacaggggccatcggtcactcgtgtcagtgtgaccaagaagggtggggttataatcttatcttcttctcctccttatggtcatggccacacctctgcctgtagccatgaaggctgaagccttttgaggccactgcagcagtttctatccttcacgtaactgtaggcacacaccctcaggtgtctttcatttggttcctaactcattagttctcatggatcagaccggtagggggtcctgtaagagcccactgccttccacatcaccaccagtggtttatgaccaagactttatctcctccctgttgctggaaaaatcccagaagttctctctatgaaaaaacttgagaccttattgatttctccctttcatttacagactaacgctgctttactcaaccaccctcttcctggccagagaggccttccgcagagcatgtctcagtgggggcacccagcgagactggagccagaccctcaacctgctgtggctaacgtgagttgtgctttggcaggagacacgtttcaggaaggcaggtgtagtgagcattggaaatgaaacagtaacacgtgcctaaagctgaattgcccccagattcagtttcgtcatgggtttctgggagcaggcatacaacaagacggggacagtgtttgtgtcaaaggaacttcttggctcattttctctctggatatccaggagccaggaagaggttctgggttggggtttctgggccaggtttctagccctggtttcatcctctttggaggtggtttcttgctgtttctgaccaccactgtgggctccacttggcctgtgccatcttttttattcctaatctttttgctctataatatcttttgagcttttaacagccacttagatttagtatttcttgaaagccttttatgggttttattacatttttcttcagttttgttatgtgacttcagttctgagtcttttaggatattcttgaagatcaaatacattagcttaaaattgcaatggcttttctccagctaggtccccacagggagggctggggtttgaggttatttcccagtgctgcccttgcataactccttattgcctcacagaaatgactgtcatgaggg

SEQ ID NO: 106077 - DNA, 1033 bp, Homo sapiens
gcctcccaaagtgctgggattacaggcatgagccaccatgcccagccatatctgcatgtttctaaggagcagctacagagctgtcatcagactcaaaagaccacctttgactccataacggttaagatggtgatttcttggctttggagaccttgctgctctgtgatactttaggtacagtgttacacaatgtccctttttggtcatagctgtccccagagattttcagaccacagtagtccattgatatgcttagatcaaatcttccaaattgcaactcttcacagataactctgagggtgcttgacacagaagtgattttcatttgctgctgggatgcagaagggagtcattcagtgaatgaggtttgcactcttcccagcatccccatttagcaaccctgtttaattacagtcttcttgttctctgtgtctcatgggagaagttctttgcttagatggttttcttgaattgacagattggaaagtctcaggaaatgtccctttcaagcggcaataattggacactctctcccttccccccatgttacattacgttatcttatttttgcagcatcatttaaaaggtatttcaacttctccctggaaagagacaagtattcaataaagaaatacattttctatgttctaattgagaaaactgaagttcagaacgatataaatgtcattattgaaattcctagatattatgaggcagaggagaaaagagaaattagtccccatgatttctggtgagtctgctatacccttaaggctcccacttgctaagcgtatgctatttctaaacaggctggggtgggggagtgtggccagggcccggcaaggtgaaccactaactagaattctctttctgcttcctcaagggcttgactttgtagaaactcagtgagtctattggggcctcttggttgttattaataaattagggagccttccaagtgccttcctgggttctttgactactgcacgggagtgctgagagatcccatggaatgaaatttcaggagaaatgc

SEQ ID NO: 106078 - DNA, 1159 bp, Homo sapiens
gcagaatttctggtatttgtgagtccttcacacagcaggctccctaagtacacaccagcctctctaagtaggaggccccagtgggagagatgggctttgactctggggtcaaatgtagataattggactatggacagtggctggctggtcaccaacaatggtgtttgaaacaaacatttagaggccatatttgggcttataaaaatagttctgggccgtgcatggtggctcacacctgcaatcccagcactttgggaggctgaggacagcggatttcttgagctcaggagttgggagaccagcctgggcaacatggtgatacctgtctgtctctttaaaataaaaaaaatcaatgagttatgtgatgggctcatggctacaggtggagaaaggcagtgcatatgcagcctcctccatccttgactaaggctgacagagggctgggcccaccactgctcaccctgaggcctcgtcttctgactcccctcctttcatttctaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaattggccctgaaatgttttcttttttgatgtgtttgcagccagtgcaggttctggggaagaagcgtggagggtgcgctagggaggctggtgtccttggtcctgggccaggacctgggtgtcccaagtccccttggaatcacctgcaactgccctcaacctccagaactatcgctgcctcccattcatcaccaggtgacatttgactgcaacctgccttctagctgagaggctgagacctacatccctcattgtgacctcagtccacctggccctgagcgggctggggaactgcctcagtctggaagctgaccaggcactctcagggccgccccacctcccccaagtccccacagccttgcagtcaggtctcctgg

SEQ ID NO: 106079 - DNA, 2335 bp, Homo sapiens
ggcccctagggacagggagcttcctctctctggagggcactcagatctccagagttcttccaactggacctgaaattctctctgtggtttccagagactgctctgcagggcgtggggctggggaggtcccaggtactagggaaagaggccttgtgttggctggcagattttggagccttgaagggcagctggtttggaactgatgactgtactcagtgctgcttctggatgagtgatttggggcctggagcctcagcaggcatgaggctgctgccctcggaccccagggaggggttgggaggaccggtctctgcagaagaaggtggtgggggacatattcagaagcccagaaaggatggacaatctatatacaaattgtggctttctccacaaaaggggtcctaggctccccgaccaccctctgcctgcccctttgggctgaccctgtcccacctgcccccaggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggtgagtttagccagggtgtttacacctggagctcccttgacttttgcaccaggaggtatgggagggggatgggccaggattccagcccatggatgggggggtaggggtcttatttctgcatatcctttcccccacaccccaggggaagacgggccctcccagatggccctagaagatctggctatgtttcggtcagtccccacatcaactgtcttttacccaagtgatggcgttgctacagagaaggcagtggaactagccgccaatacaaaggtaggttgcatggctgttctttctcctgctggcagccatcacttcccaagggaaacagaagaggaggccagagctggtcacttgctgccccagggggtgtttcctgaccttgcccctggtgttcgtgtagcttgtggaagttagacaagaaaaaacgaaatacacaccccacttactgccacgtggcagacattgtcaactgattgccagtctgtctctgctgagaatcctggcagccctggccggtccagcggttgacacctctccaccctcctgagttgggttctccaagacaggcaaggatgagctgagccctgtggtccaggcccggagctgcatgccacagacccagtgcgcgtggttcctgcccctctgcctggtgcagtctgtgggagtagcccacctgcagccagtctacctggtggaaagttgccttcggtctgaggctgcaaggtggtgggcagttctcagagtgttcaagtggggtgcgggcggcagagggcaagcaaggcccttttccctgctggagtagccaggatgcagtaactaacgctcccatgggaagggatggcctctctagaaagacctcgtctctgaggttgggtgtgccacatcctgtatcctcagtttatctgtttcggtctcagggtatctgcttcatccggaccagccgcccagaaaatgccatcatctataacaacaatgaggacttccaggtcggacaagccaaggtcagtgcctcgcatgccccaggagcccacagagctgcctggaccctccctgctgtgactcccagcagtcagggcacaccctgccccagggccctgagccttactcaccctctgtgtcacccccaggtggtcctgaagagcaaggatgaccaggtgaccgttatcggggctggggtgaccctgcacgaggccttggccgctgccgaactgctgaagaaaggtgaggagaaggggcctccaaagtcatcaactgagcggccactgcatgctaggtcttggggttctttctttcgttctttctgttctttcttgaagagctcacagctagagagaaagcatttcatttcattaaataatgatagcaattatagccatcctttgagcacttgttctgtctggcatgttgctaagtcctggggctgcagtgcccacagtccctaccctatgactctaaagtcgagacccccccagcatggtggccagatcagtggcctggagcctgccagctgggctggaatcactcagccaggcactagttaaggaagtaagttattcactgtcaccatgcctgttttcctatctgtaaaatggagatactagccccttgccctcagagctctcctgagggttacatgcatgtgacttggtattctattattattactgcgagctcacagtgttggctagtggtttgtaggggagacaggcatt

SEQ ID NO: 106080 - DNA, 1277 bp, Homo sapiens
tgaagtcctggctccaccgctaacttgctttgtggcgtgggtcacgttacttactccaccttcggtgtctcagttgatttgtctgtacaatggggccagctcagcacccaagcatggcgtggtgaggcttcagtgggctaatatgggtagtggttggcatggcactcagtttgagaagtgctatttttattcttatgtcaaaaagagtccccaaaaggatagcttttcaagagaaagggtgctctgccccagctccttcctgtatatttgactccatggttcatttcaaaaacatttccagcaccacatccagcatctgtggagtgatcaaatgtgttccccaaataagaattgggccaaaaaattcatcaagaatctaatagcagacagattccaaacccagtgcgctgaccccagaacagctttcagtaggaaatgagcagatcaggaatgaaagagacaataaaggaactgagctctggattacttaagaggaggaggaaaacctgttcagaggcaaacaaaaggaagtaaaataatgtgaaaaagaaaaggatttaaaaaacccaaactggaaacaggaatgttgcaagctttctactactccagctgaggccgcagttgtggggtggagcctgggcagaccccagctgccaaggcagacctttccctggaaggctcctcggtgttgtggcccctgggaattgccccttactctctgccccctgtccccagttggcatgccatcatcgtggatggacacagcgtggaggagctgtgcaaggcctttggccaggccaagcaccagccaacagccatcattgccaagaccttcaagggccgagggatcacgggtcagtatgcacaagccgccctccccaccttcacccctcgcccagacactgtggctacgtagctctgacccgcacatccagggaaacagcccttgctgctcactgagctcaccaggctccagggaaggggagcgggagatgctgtgactcagtgacccctgtggctgagccaggatttaaactcagatccgtctggcctctgccggtgggggcatgtacaggcaggaggagaggagggacttggagggtctgtgggtgagaggaaggtcgtggagtgaggcagcccccgtgccccaccctggctggtgcctttcagagctgcagctgtgtgtgctctgccagctccggccacctgctccagctgaagggccgacacagagccaggcagggcccggagagaactgttccctccaggaggtgagt

SEQ ID NO: 106081 - DNA, 1063 bp, Homo sapiens
tacagacgcgcaccaccacactcagctaatttttatatatttagtagagacggggtttcatgacgttggccaggatggtcagtctcaaactcctgacctcaggtcatctccctacttcagcctcccagagtgctgggattacaggcgtgagccactgcacacatcctgagagctggttttaatgatcacataatattctgttttatggagatgctataatccatctagccagtcctttgttgttggacacgtaaggtagtttccaaatcgttctacaacaaatgtcgaccttctgtttagggttccctctcttcaaattagttcatgaatggatgtttgcagccccccacccctaactctaacagctcaggcaataccaagcctcagggttagcccaggctcctgtaggccccttccctgttcacaaccccttccttggcatctcctcgggacctcagcacgccctctgacctgagcctgatggccctgtagggcttagccttgtccctagtctcgaagccaaagctgtgctgggcctccagtgctagcctcggttcgacttccctggaagtgggtgtgggcttggggtggcagccagttgccttccctggaatccctttctgggaagtcgagttggcttctctggctcagccccatcatgtggcccctttctggagctgctgtgccagaccagagtccctgcagggtctctgggccccctcaaaacctacaggggaaagaggaggcaaggctgggacaggatagggcctctgaagtgtgggcctgaggctttgtccttctggccatggtaccccacaggggcaccacctcctgtggtggaggccacagaagagcagtatgaggcaggagaggctgcagggagtgctcctggcctgctggcatgtggaagtgctgagtcatgctgacagctccgtggctagctgtcccagcctcttcctgctgcccctgccttggccctgcggcagggaggcctggaggcttggactgctgagcatgcagccgggttgagggccttttcctgcaggagcaggagggcagccat

SEQ ID NO: 106082 - DNA, 1091 bp, Homo sapiens
gccccctcggggtggtggtgtgctgtagcagggttttggatggggaccccctgaccccccccttctgggtggaatcacagccacagatccctgaaatccacctgtgctcaggcctgcctccgtggcgtttggtctctcgggcaggctttagagcttagaagtctgtccaagttgttcccatgccacaaaccagggattagggcagccggctgcctgctggggttttggcttcgtccagcctcacagctgtgccccctgcacctgtcttagtgcctgcctggccttggcagtgggaactttgggctgaaaaccaagaggctgaagagggctgaaaggggagaagtggccttcacttgcttcctcccctgaaatggatgctgcagttggccggctcggccgggccccaggggtcagtgtgaagtaggcacagcccgaagtagaaccgctccccacctgacctcaccccaccatccatctcccggcagggccatgcagctcccatcctctacgcggtctgggctgaagctggtttcctggccgaggcggagctgctgaacctgaggaagatcagctccgacttggacgggcacccggtcccggtaagtgctcctgccagagcctcccatgcctctgcctccacttcctatttcccagacatgtgggacgggggtagggggtgcccactgagaagccaaaggtgttgaaaggcggaggagggcattgagttgaggaaggaaagaagcaggtgttttggggacacgtattcaacccaagctggtgccaaaggggaaggccttctgaggcctcagccagggtgctctgggatgacttcagggagggcctctccccaagctacccttctgcactgggcctccttggctaggtagctacagcttgggaagagaggggactcgataagggagtggctgcaggatgctggcgaaaccctggggaagggacccagtttgttccttggggtgccatctggcatccctgcaaacgttaagacttcatggattaccacaaaaactgtcacatggtctgggtccccacgaggggcaaatgttctgtcaattttttcatgattctct

SEQ ID NO: 106083 - DNA, 1294 bp, Homo sapiens
ggaggtgtaggcgagtggatcacctgaaggtcaggagatcgagaccagcttggccaacatggtgaaaccctgtccctactaaaaatacaaaaaattagctggacgtggtggcgggcgcctgtaatcccagctactcaggaggctgaggcaggagaatcacttgaacccgggaggcagaagttgcggtgagctgagattgcaccattgcactctggcctgggcaacaaaattgaaacttcttctcaaaaaaaaaaaagaatgcctcttgggcaagcagtctgtgccaggctggagaatggtgaaaaaggtgaaagggaaggccaggtacagccgcggtggatattagtcagtctgaaaggcacttggagagaaataagatttacaaatgtagggtgctccaaaagagtggaatgtcaagtgtgtctcctagttctttgttaggcaaagtctgatttcctcaccgccgttacccctccggaaacatactgtggtgtccgagagttacaccatgtttacattgtaatgtcttggagagggaagctcactgaactcaaaaaatatccatttgcaaaagaaaaaaaggatatgtaaaatacagtgactgtgtgtgtgtatgtatatgtttaaaatatgcaaaaaaggagggaaaacttatttttcagaaggaaataacgttgctatgcaacccatattttgaaagttgtgagccaagagtatgtgtgtgtttgcacccaaaagctaatcaaggaagacttgagacacaggtagtcttctgtttcttgtccccagatgtttatcttgaggcccactgttccctctctgcaatgaggcatagagtgaaggctcagtccggaagccctggcccaatctgggctgtagtcacagctaaagtgacagtttgtcagaatgtccccttttctgggggagctcacaggactttgatccagttctttttcttttgagatggagtttcactcttgttgcccaggctggagtgcaatggtgcgatcttggctcaccacaaactccgcctcccaggttcaagcaattctcctgcctcagcctcccaagtagctgggattacaggcatgcaccaccacgcccggctaattttgtatttttaccccgtagagacggggtttctccatgttgaggttggtcttgaactcctgacctcaggtgatccgcccgcctcggcctcccaaagtgctgggattataggcgtgagccaccgctcctggccccttttccttttttctttttttttaagacagggtcttgctgtgtcacccac

SEQ ID NO: 106084 - DNA, 2884 bp, Homo sapiens
ccattgcactccagcctgggcaacaacagcgaaactcagtctcaaaattaagtcctgcagtctcttgggcctggggttggtcggctggggccaagcctggcacccaccagccttgtgaccttgattgcccttgccaagcctcagtttgtccatctctaaaatgggattcgccgtgacaagtccacggaggactgtgtggaggagggagactgagaggctttcgagtcaggagcccagactcgaatcctgagttgttcgttatgttattattattggtgtgtgtggttaactgctaacctcgcagtccgcagcggcccagcgcctaggggaggggagcgggcaggaggcggccccaggcggggcggggctgaaggcctggggtgatccgagccccgcctcctccccctgccccgcctctcccatccccgccccgccccgcccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctgggtgagtgcgcggcgccggccggggacgcggctcgggcggggcggggggcgtctgcggcggccagagtcgccgcgggctctgggtcgcgctgcgagatgcctagacgaggaaggtggcccgggcgccgtcggagggcggagacgcgcgcctcgcagggccccgggctgcaggcggcttccgctgcgccgcacactcgccctacgcccgggctcggccgcgtgggcctctggtcctccgtgcgcctcaggccggctcttccccacgcggatcgccggccgcgcagctgcatggtggcgcgggggatgggctcgcgactcgccaagtaccctctagggtgatgccgggaaggccaccattactgctgttctacagaacgcggccctcttaaccctctccaccacctggctgtgtgggcgccgccgggagtgttcccccttccagatggggaaacggaggctccgagttagtcagctacccaaagttacacacagggagatctgatttgagccccagcagtccgactctagagaccctgtttttaattcctcttgcaggagactcgggggcccggccttctccccacctcagactacgctcccctacccctgtctcctgccacccctgggttgggtccgagtttggagcagggggctgctgagacgccaggcagcggcggggctgattgggggaagaggggaggagggcggtggcacgtgggtgcagaaccctgggatccattgtgaaaaggaggtctaagatttgacctggggcgggaggaggcggagggcaaggagactgagaaggctgagcgccggaaggacggagttccagggccctagcgccgggagtgacgtcctggggcagggccagccaccaggtgctgtatctcccaggcaggagctggcgtgcctaggccccaagatccttccctggccagcccttttggcccagaaggtggacacccaaggagcctcctctgtagcggagacagggataattaatgagggccaccgtgcatgcagctggaggtgtccagtggggtgggtgagggggtcagtcagtgaattacttcagagcctgcttcccgctctgtaaagcggggacagtaatggcacttaaccacgctgggtggtttcaaggactccagtgctctacttggaggctgctttgaggccacagtgccagcagtgctccgggctcatgacagggttgtgagggctgcgtgatggatgatttctcgggaccttcccaaacaagctctgtttcagacagacaagattctggcttctggccaatttcattcaggatatattattaagaagtaaatctgttcacctttctgggtggatacgcattcaccctttgtgcctctaagacaccctgttctcagaagggattagatgtctttcaaagcccttcccccacccactgccttgcacactttggacctgttagctctcctgggtttgtgtcagtcttaccacttatgtggggtatcccctgcctgggcagggacctggcttactctcagctcccctttcaccagcctggcacacggtagctctgcaggccttgtattgcttatttggtactgttggacctgctacctttggccgtttcagggggtctgaggtctagctggagagaggcagcaattacccaactaagtagtattgcacatctgagcatctttcagggctagataaaacatgcagatgtttacagggttcctgagctgccaagtaggtatctggtatgacacagcatcatcgtttgttgcatcctgagaataaccctgtgagatagattgtgttgtattcacattttatagacgggaacactgaggctagtgtgttaagttacttgcccaggctgggaattggtggccattccgtactgtctggttggggctcatgctgtcaggaatgcttcttggcagggcatggtggttcatgcctgtaatcacagcactttgggaggccaaggtgggaggattgcttgagcccaggagttccagaccaacctgggcaacacagtgagaccccatagcttaaaaaaaaaattttttttttgagatggagtcttgctctatcgcccaggctagagtgcagcagcacaatcttggctcactgcaacctctgcctcccaggttcaactgattctcctgccctagcctcctgagtagctgggactacaggcatccgccaccgcaccggctaattt

SEQ ID NO: 106085 - DNA, 1866 bp, Homo sapiens
ccaatgtattcctaggctgtgagtactttcccggcccaaagtgtgaaaatatgtaaagaagctttgttatgctgctattgatctgccatgatttctatttattcttttatggcatgtaatggtgtttagtaatattttaatgtagattttgatttatttcagcaatagtaattttaagatattctttgaatgaaagtgtcttcgtttctatgatacaggtcattttgtagtatttaaccaattaagatgcactgcttacttttctgagcactatttaatgatggggtaaaaacccaattggctcaaccagctagcataaggattagctgtgaataatgctgacagatatgatggttccttaggaacaatcatttaagctttaatggtaactcaatcataagtccatagattatttttttctagctaaaattttagaaaattacttgtgaattacatacttgttttagtttggtcttagtttttagcataaagaatgattggcttttgttgatctaaacatgcttcctggacagggtttctgcttctcattttagtgtcttctattgctgtctacctaattatgtgtgaattgtgcagaattcagggaagcttataagttttcatgctcaattgtgaatagtttgttttcacagatagtatgtaaattaagcaaccaaaaatgaattccttatgcatcatctgggaacgagaaagctatagtgggatacagagtgttgctgacaccgggagatggtgtccagggagccacgtgacttccataaagtggacgcaccagtaggtgtgattgcacctcaagtgtagtctcagtgggcttcggtgaacagacgaatcaagggattcttgaatcgaaattatgcttttgagtatgtaatattatgagagagttaagagagaatatcctaaagagagtctgtgatcatactaattttcacctttaatgctaggaatggatatgatagacagtaaagagcatctatgataaggcttccttagtgtgaaagtaaacttaagtgcccaagtcatggagacttgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttcagttgccttattcctagttcaggcttactatctagaacctcatgctagcttaggttgcatgtttacattgctgcagtgtctttactggaagcttagttggatcgaaatggacaccgagatggagatgcttctggctagatttcgcagaaccccaggagacctgcatttagaccactctgtccatttgtgtgcccacccccacccccagggtctaagtgtagactccaagaggagcagcccagagcttggaggagaggtgtgtctggggcaccactggtgggtggtgctgctcttctttttgttgtagttaatgcggtgtcttttaatggactctcaggcctcccagacagccttgttcctttaaggcagaagctcttcttcattgtgtacctcctgggattcatgaggtgtgagatttggcctgcttgactttgaattcaagtttttcaagtgactctcagtgtcagaagaagcatttcatgctgtccacatgtggtatgtccacagctcaccttcaaaggcttagatgtagccatcacagagagtggtattttattaagaacccaagtcccagcctgaccaacatggtgaaaccccatctctactaaaaatacaaaaattagccgggcgtggt

SEQ ID NO: 106086 - DNA, 1288 bp, Homo sapiens
gaaaaacaaataaataagattaaaagaatatgtgataaagtaataccattatctttttcttaaaaaggtgataaaaataacagttgtggccaacactgttgtctaaaattaggtgctcaatgttctagaaattttattgcatgttatttacattggagtacagagcaaacattttgaggttggtttttcttcttctttttaaaaaataacatttttgataacctcagatgctgttttgtgagccaaataatagcaaatttttttcacaagatatatttttttcttttaactttttaaagaatcagatgggtgactcaaatatctccagccctgggttacagccaagcactcagctctccaatctgggaagcaccgagactctagaagaaatgccctccgggtcacaggataaggtttgtacagctaaagctctagctttgtcctaagtaacaaagagtaacattcagtaaggattctaatgagtgcaagtttgatttgtcagttgtgtcaaggttcaaatgtgcagcaacataatgacatcctcctaggtcatgatccgagtaactgtttaatctggattttgcagtagcctgctacctggtttcccatcttttgctccctggttgcttcttacctattcttaacccaacagccagagtaatccttgcaaaacataagtcagatcatggcactcctctgcttaaaaccctccagcagtgtccgagctcactcaaatcatagccaggatcatgacagtggcccacgaggccctaccttatctggcccctctaccccaggcctcatctgtcactctgcattgctcacctggctccagtcccattggctctcttgtctttccccaaatgtgccagatatgttcctgcctcgagacaggcctttgcacttgttcccttggcctgtaatactttcctcccagatagggcttgctccctttactccctcaagcctcatatgtcctccataagtcaggccttctctgactaccctatttaaaataacccttggctaggcacagtggctcacacctataacgccagcactttggaaggttgaggcaggcagatcgcttgagcccaggagtttgaaaccagcctggccaattgacgaaaccctgtctctactaaaaatacaaaaattagctgggtgtggtggcacgtgcctgtaatgccagctactcaggaggctgcagcaccagaatggcttgaaccctggaggcagaggttgcagtgagccgagattgcaccagtgcactccagtctgagcaaca

SEQ ID NO: 106087 - DNA, 1033 bp, Homo sapiens
gtgacactgttagttcaaatgttttaaaaatacatatattgctttctggctcattgtaggcgctgcttagtattctggtagagcctttaccaagtgccttcttggtaactttgtaaatccatgaacatttcagaatttccaaagcagattcttttcattatgattcactaattactggctttttcctcctcaggtagtgttgtcagataaaagcactttttatctttttttttttattgtggtgttatctaaattgtaaagatttgtaaagttaaccatgcctgtatcatttatcttttagataattatgttaaatattcaatacttcaaatgttttttcttttgagaactcacaaaggaaatcattgtttgtacttaagtgacagaaatatgttaacatgtaatatgtaggttttcaccttctgtttacacaatgaagttatctgtgtaggtaaaaattgaaacagagtaaccgctagtctaagcgaagctcctctggagtgtgcagaataaacctccagactgggcccttcaggttcagtgtgctggaggatccaggcaggtctgagtcacttacaaagtcactgcttccaggcatgctcagcttctgctttttcttttcttttttttttttcctgagacggagttttgctcttgtcacccaggctggagtacagtggcgcaatctcggctcactgcaacctccaccacccaggttcaagtgattcttctgcctcagcctcctgagctgggattacaggcacacgccaccatgcccggctaatttttgtattgttagtagaaatgggatttcaccatgttggccaggctggtcttgaactcctgacttcaggtgatccacctgcctcggcctcccaaagtgctgggattacagacgtgagccaccacgcccggcctttgtttttgttgttgttgtttttttgttgttgttttgttttgtttttttgaggtggaatcttgctctgttgcccagactggagtgcactggcacaatctcagctcaccgcaacct

SEQ ID NO: 106088 - DNA, 1511 bp, Homo sapiens
agagaaaattcttacactgactaagggcttaggcttggtgattctcttaaatctttgtggggtagtggtggtggtggtggtggttgttttcaaaagacaaggtctcactgtgttgcccaggctggtcttgaactcctgggctcaagcaattctcccgcctcagcctcccgaagtgctagcatgggccaccatgtccagcctcttgaatcttttgggaacagtgtatttttattctgtgcaagggccttttggcagtcacaagaccccagtgggattgcaatgaattatggggaggttataaattctggagttattgagtagcagtggtatttctagcaccttatttctgatcctcaacttacaggttgagaaaacaagaggctcagagctgtttaggaatctgctcgagattcgcaaaggtaataagtgacagatggagaatttgggagtaggtctttcgggcttcaaggccaatgttctttccactctactgtaacaataaaattacttcatcaatccatattctagagtagtgctatccactaaaactttgcaattagggaaaatgatagttccgtgtcagcactgtcccatatagtagcctgcaatgtggctagggcaaatgaagaacacttctttttagtttatttaatttaatatattagaatttacatggctgtatgtgctggcagctgccatactggacagtggaagtctcagcatgagctcatgtgctaacatgctctttgttgtgccatacctgaatcaaacaactacttgggaagctttggcttagatttttatgcgtcctatttagtcattcctttttgaaacttacaaatgatttctagatacaaaagctgcagaatatatccctgagggtggctttgccatggtaacattcttttggcatggaatttagtttgcagataagaattctattctgggctttgccttactgactataaccttggctaaatcatttaaaccactgatttgacctatttatcttaaaaggccatcatgaaagtaaggtattttgttaggcatttacaaatacaaaatatcatagactgtgtctccattctagactcaacaaatgatctcattagtgaaagaatcctagggacatcagtgttatccacacctggcctatccagattctcttataacacaggcctgtgatatgcttcttcctatcccttctgatagtaccatgcatgagctgcaggctctttgtgtctctttacaagtattattttcaaatgttgtaggggccattactagaaagcctgaggtatacattggaaaaatatatatattaaaaatgagaagtcttggccaggtatggtggctcacgcctgtatcccagcactttgggaggccaaggcgggtggatcacctgcggtcaggagttcaagaccagcctggccaacacggcgaaaccccatctctactaaaaatacaaaaaaattagccggacatggtggtgcacgcctgtagtcccagct

SEQ ID NO: 106089 - DNA, 1080 bp, Homo sapiens
gcatggggcttacatcctagtggggggaggacaataaatactaaaaataagtggtatggataaaagaggaaggttagagatattgagcttgggagcattaaaaaggatagttcaagtaggcctcatgaaaaaggtgacatctgaacaaaggcttggaggagatgagatagctgtgcagcttctggggcagtaatccaggaagaggtttttaggtagaagcacacacgcagagagagtggcaaggagcccggtgtggctggagagtaggagctggagaagagccataggaaatgaagtcagagtggggagtatatcaggtggggccttggtggcctcagtaaggactttggcctttactctgagagactgtctttggagacttctcgtcagaggaggagtatgatctgacttaaattttttgtttacagatgtaagtgctgataatattgtataatgttctaatgcattcttttttgaaatgaaaataaagtacatagtagataacatttctacagattaaatggtaactacatatttttttttcttctattaaatctaaggtcagcttccccttaccatggttttaccattgtgaatcgactaaatatgcacaatctagttgaaccagtgaataaagatttggaatttcagctccatgaaccatttcttctgtatagaaatgcaagctgtgagtatatctgttttattatagttattacatttaaaattgagtgactttagtttctatcaatccattatttaggaagtttcaaattacaaaacaaaatatggtctctacttaatgattataaatgagtctgttggaaagatcaaaccttttaaactgggctctgaggccagaggtggtggctcatgcctgtaatcccagcactttgggaggccgaggagggcagatcacttgaggtcaggagttcgagaccagccaggccaacatggtgaaaccccgtatctactaaaaatacagaaaaaaattagccgggcttggtggcaggcgcctgtaatcacttgaacctgggaggtggaggttgcagtgagctgagatcgcgccactgtactcca

SEQ ID NO: 106090 - DNA, 1036 bp, Homo sapiens
ttaccagcctagcaaagcaatttcaaaataataatgattgagtctaaaatggatgcctgcgtctctcttcctacccccatattagaaagaaaaagaaagatatatatttggggaaaagacaatacatagactggctctgtaaaataatgttattgagaggtcgatccctctgttctttcattactacatgagtggttgtcttttatgactggttctgtcctctttcccaacccacagaagttctggattatgtacagtgtcttatttgagagttctttagaaagcttggattattcatgatggcgtattttttatttttgacttattcaaaaattcattatctttaagattggtttgcaaattgcaacttttttgttaggcagcttttggggcctaaagacaactgacagtatatgatagtcatggggtacttgttttcctggattcctctaaggtcttaactcttacaagggcaggttccttcccttgttttctaaagcttagggagtcagcaggagttattactgatatctggtcttttcccttttttttttgtattgagttgcttcataaggattgcctttctccattgatgccaatttaaaagaatttgtcaaatactcttctaaattttgatacaaagctttgagatctcgtctaaatgcactcatttttttcttcttttaagtgtaattctttgatatttgtacaccaagctcttttttcttagacactttctttgttccctgctattcatctttctgcttttaaaaaggaagggatcggccgggtgcagtggctcacgcctgtaatcccagcactttgggaggccgaggtgggcggatcacgaggtcaggagatcaagaccatcctggctaacacggtgaaaccctgtctctactaaaaatacaaaaaattagctgggcatggtggcaggcacctgtagtcccagctacttgagaggctgaggcaggagaatatcgtgaacccaggaggcggagcttgcagtgagccgaggtcgtgccactgcactcca

SEQ ID NO: 106091 - DNA, 1039 bp, Homo sapiens
gaaatgatatagaatgtaatcttctgtgtgcatcacaagtttgtcctttttatggctgtatagtagtccattgtatggatataccacaatttgtttatccctgtacctgctgttggacattagagtctaaacattggaaacattgttttggctatgaaaaataaccaggttttggctattacaaataaagtggctatgaacattttatataggtgtttgtgtacacacatatatgcttttattacccttgggaaaaatagcaaagactgcagttgctgggccatattgtatgtaggtggggttttggccctcattatttttgatgctccctggtgatacacctgtgaacgtattatgttacagggcaaaagggactgactgtgcagatggaattaagcttgctgatcaactgactttaagataggaaaattaccctggaagtgggcaagcccagggttatcacatggacccttaaaatcagaaagggagggcataagccaatcagagagacatggtagaaggagaggtcagacttaaagagtgagaactcaacctgctgactttgaagacagggaaaggaggccatgagccaggcattgctgatgtcttctagaaggtgagaaggacccccagctgtgacagcaagagtggggacctgtcttatgtaactaaattctgccagcaacccgaattagtctgaaagtggattctcccccagagaataagagtccagacttatagttttagcttttgcatgtagctctatgattcattttgagataattttatataaggtatctgtgaagtaagagttgaagttcactccttaacctgaatatccagttgttctagcatcatttgttgaaaaactatgcttgttgaataactttggctcctttgtgaaataaattatgtatgtgtgtttatttcggaactttctattctttcctattggactgtatgtctcttcatacaccaatcccactatgtcttgattaatgtagctttatggtgtatctggaaatcaggtagtataagt

SEQ ID NO: 106092 - DNA, 1045 bp, Homo sapiens
agagtcctgaaggtgattaggagctaaccagagggaggagggaatctcagggaagaagaacagtgtggaagacacttgtgccaacagaggatgtgaagtgttggaggcccagccagtagattaggatgtctggagttaaggaaggggactgaagatcttagcaggggccatatcatgagggtcgtgtaagccacagagtctgacctcttgtgaaggcagtggatcacgttgaaaggctttactatagtaagagccaacattcctcgaatgcttcctgtggcccagctctgagttacatgtataactcatttaattctcacagtaactgtgagttaggagcttcattcagagcaaggaagtggcagtctgaatttgcagacagatccgtgaattcagagcctgggcccggattctatagcaacatttcttcagtcacataaatgctcaataactgtatgttaatttgtagtggacaatttttgtttcatttatttaaacaaatatttgttgagctatgtactataactcaggtcaagggaacataataaacaatgagtttgtgtttaggtagagagcggtaattggatacttctcaaagaactttattgaattattttgatacctttgagtcagcttcttagtttagcttgttatgtgtatgttgtttaactttgttacctgcatattatttacaaagtcacacatctatgttttatatctgcagcaaatccagagcaacttcatcattgtcatacatccaggttcaacaactttaaggattggtcgagccacagacactcttcctgccagcattcctcacgtcattgcccgaagacacaaacaacaagggcagcccctatacaaggacagttggctcctaagggagggactaaatgtaagtcaaaaacgacctggagagaaagcctaaggttgtttccctgggagggcttagacacaagtacaccagaatcttaaagaaacatcttcatagctttgctgtgttttaaaacattaataatgtcactaatttttcatcagagctagt

SEQ ID NO: 106093 - DNA, 1033 bp, Homo sapiens
attcagtaaatgtggaccacataccatggatatttactctgctacagccagtgggctgcctctgttccttgaacgtggccatttcattcccttctcaaggcctctgcacttagctattctttcagcgtggagacctaatggctgcttcctttgacttcccgcccccagttctcaagccatgtgtcatctctttggaaagattcctaatcaccttccagaaaatgaaaattacatgctgaaaatctattttgagtttaacaactttggttaagattttatgttctaatacttagaactgacaaagatctaattttatgttgattttggagagagcattttccccagaaaagttcataataggacaagacaacatccttcacctcatttgggatttgtgcagcacaatcataaaggatcatttctgcaaaaatattagggcagggccgttaattttcccaagggcctttcttaatctagaccatgccaccatcatctctcacctgctctacgctagtttccttctaaatgaaatctcaggttcagtcttttaccatccttaggcagttttacaaactgtagcaagatcgatcttaaaacggagatcatctcgttcccttgcctaaaaccttttggacactaaaatttagtgacttcctattgctcttaaaatccagttccttgtcatggcctgcaggcccaaggtgacttgtcctcttgattgctcctctcactgtacttccagccacatctccccacccagattatgctctggcaacattgttgttttagtttatgaacacccccacccagattatgctctggcaacattgttgttttagtttgtgaacaccccgggttttactgatacctccaggactctgcccatacttgtccctctacctggaaccctcttcctcggactccttgcacatccagctcattttatcctttagccctctgcttagttgtcaccacttctgggtgcccttccctggccactcatctccgtgtttattttcttcatagtaattca

SEQ ID NO: 106094 - DNA, 1104 bp, Homo sapiens
attggggaagagccctgactgtggagttaaacaggcttggttaggagatgcattagttctgtgtatcggttatctattgtgaacatgatgctgtggaataaaactcaccagcacctccatggcatacacagcatttgttattcacacttcaggggtgtctaggcagctctgttgatcttgagtgagcttcctcacatatctgggggtgatggggtgtctggactctgggctacatagctcatcctccagcaggctagcctgagcatgctctcaagtgaatataggcccagccacataaatactttttaagcctgtttgcagcacatttgctaacatctcagtgaccaaagcaagtcacatggccaaacccagagttgaagtggatgtacacattacatgagaaagagcttggaaacatggaggagtgaagaattggggtcatttttgtaatctattatactgtgtgggcttgggaaagttaactgaactctttgagccccacttttcccttctcttggaaaaggtctcctgatctctagccatcaagtgtgtgtgaggatcaaataagagaatttgattagacgggtatgattcatggttgtttaagcttacaaaattgctgtgaaactgatattaaccacgtttccaggctaagggaagtaaatggatacccctttggttggtttcttcatttgaagattagatactgtattagtcacggttctccagggaaacagaatcaacagggtgtatatctatatgagaaatttattttaagaaattggctcatgtgattggtgggtccaaaatcccatggggcaggccagcaggcgactatggaagagttgcaattcaagttcaaaggcagaattcctggcggaattcctttttgctcagtagaggtcaatcttcattattaatagacctttaactgattggatgaggcccactcatattatggagggcaatctgctttactcaaaattgacctatttaaatgttaatttcatccaacaccctcacacaaacatccagaataatgtttgatcaaatatctgggcaccgtggcccagccaagttgatgcacaaaattaatcaacacaa

SEQ ID NO: 106095 - DNA, 1034 bp, Homo sapiens
ttggggaaggctctgttctactggctttgaagctatgatgaagaatgcagctgctgggcaccaccacatgaagagagcctgcctaagggtggccgcagaagagaacagacaagagacagaaagtgagattggaataatctgctggcattgtgtaagcccctaggttcaatcacactggaagccagatctaccccggatatttcagtcaccagagcaaataaattctctcttatttttgattaagtcattttgggttgtttttttttccttttgtcacttgttgccaaaagggtattaacttacataggcagtaaagatgaggaaggtttgaataaaaacaaaacgaaagtagctgcaggttcaatggcatgctcagtatcatgagctccttttggagtcaattttctattttttataagtcatcaatttttatccaccaaatttcagaatgagtgaatgaataaaggccatgaaggccagtgccatgaggagagtgagctatgcttcagccaaaatacaagagtagctggtgaaaggtctttggggtacaacatcacctgatctacagttacatgttattttctatataatatttgaaaacatgatgtattagaacaaattattacaactctaacttacataatgagtatgtatcacagtatgggatgtacaaataaatgcaatactcataaagtacttgatggatttctttgacaatcagcagtggtctagcttgaattcttcctgaatgctgaggctcaattatcattgcaggaatcattgtgctattatagttaggctcagtttggaagctttagtaattgttaagagaagaaaaacaaccttcataaaacagaaaatagtatgtgcatttcaatattgagttttccttagttcatacaaattggcatccttctttactcagccaaattcagaatgaatgattgaatgaataaatgaatgaataacaaagttacataatttacaaccaaaaacccaattctagttggttgaacaataagagagtaatagcc

SEQ ID NO: 106096 - DNA, 1716 bp, Homo sapiens
ggactataggaattcgattcatttaaaaaacttctgctgtttttaacagaatttaaagatattcagagattagttgtgtgtttgttttaactactcgctgtggtttagagagaggtctcagggtgtcaagcttcactttaaatatctctttataggatctcccaaagactttgagattttagattggctcctaccctagaagactggcattaaaaagatagaccaagatctaagtgttggctgggacagagcaaactgtctgtttaagctcccaaatgcagttgttttagcagtctaataaattaagggtaacagtaataataggaattaacaatggctaattaaaatgcggtaagttgccaattatgtaatggggtctaaaccccggagtaaatggagatatttgcagatgcgaagttgcgctgtgcacggtggtaggggaccagggtgttttgataatgaaagtaccctggatgtgtgtgtgtggaattctggagcctggttgccaaactgcaagctctttactgctagcttgaaaaatggggagctctagacactgtaaagaattgcagtttttttcttttagggaagtgtccctctcagccatttaatatcactaagatgtctaagaaagaagaaggattccaggtggtttctgaatgacaggcttgttatatgcagcagagcctagccctgcatggcatatccccacatcctgggggctctgcgatctacgtttctctgggtagggtctgccctgtgcctgtctttagcactggtcatcctcagcacccagtgcagggcgcagcatccagagactgcatgaagtcgacaagtgagatagaccaacaggcaacttttcaatagggagacccctgtctgctttcaattatggaagagtgtccacttttatctttttcagtattgcttcgtcattgcctctcttctctccgggatggctgttggagcttttcattttagccttcacgtctcttaatatcgctttcatattttctctttatctttctgcactgcattttgaggggtttcatcagtttgtctttttttcacctactttctcttcaggtgggcctaatctcactgtttttacttgcttatatattttttaaaacctgtattatatttttcacttctagaatttctattatggttgttattgttgttgttatttaaataggtcttttttcctggttctctgttcgggatggggcagccctcttccctgctatcctcattcctgcagccttgacttctgcccttgacctggtgttaaaccctagccctaagccctgtatgcagtactgctactcctgggactttcttgaaggcgctggtccctgggtgtaactgttatgaatttgttggctaacttccttccagtctgtgacctccactacactcgaggtgaccttggcctctagttcccgagcacagggactgatgctgagagtggcttggtacatccacggatagtggggacaaaggcaggccttttgggaacaatgctgctctctttcccactgccgggagagcaggaggcttagctgcagctgataagctaggtctgcccagctctgcccacacaagttcactggcaggggagcaatgtttgtgtccagtctctcactcttcctctgtagggtttggtgcatgttaccattccatgggctgacacaggaatgtggggaagggggg

SEQ ID NO: 106097 - DNA, 1019 bp, Homo sapiens
ctctaccagttaatttggttgggttttactttgctgtggctgagtgctctgcacttgctgtggttggtggttgggaaagtgggccctgggcgatcacttcctctctgtgggtttccactgggatggcagaaactgcttatcatgccacaggctggaaaataaatcctggaagcaccatatagctcaagagacaatttgaaaataacaatcagagtcatgaatagaagccgatgcacaaattcagttaacaagcagaggaactaatctatcagacattgggtggaaagcctatttctgagtttatttcacagcacattatgacatttctttaaatcacaacttgtccccatgtaaaagatataatctacatattcctgtgggaaataatcagagacaaagctttactgtatttgtcgtttctgaagttgacctcattccccccccaaaatatttttcatgttgtgaaatgtaatttgcttgaccccaacaaaattggaataaaaaccatcacaattaccggtggttaagaaagtggaattgagtttgggagaattgaggcataaagaaaattttttttttttttttttctattcagaaaatatattgaaagaaatgcagagagacttcaaaattccatagtagtttgcacctaattctggttgatagggttttagtgtttggagtggtaagcagctgtggggtttgtggtggcctgccctcttgcaggctgagagggaactggggcctgtgaagaagaggtgacctgtttagtgtcacatagctgattggtggcagggttagatctgcatcctggcccatatacttgggtgctttttgccaacgcgcctttttcctttctaaaacttttactttcaggaagcccatagattaaaaaaaaaatctgtgtattgtgttctctcaatttctaggttcacatttgcctgagtttaataagagcctggctgggtacggtagctcacgcttgtaatcccagcactttgggaggctgaggcgggtgg

SEQ ID NO: 106098 - DNA, 1054 bp, Homo sapiens
tgagctaaagtaacccctgcttgagggaaatgagggctgaaatttattgaagcaattcttggacttcgtggttataaatcccaatcttttcatttctacttggccagggtattgaccagcaagcttttatgtaagaacttagttcctagcgggacccagtgtggggagtcatatttgcttggatagtcatagctgaaaggattaagaagaggcttcccatgagaccagctcactgatactgtgtgtggcatctctgactgtgaaagggcttgggtgttccatccattaattaaggtgcataactctcctccatggtagatagtcttaccttaagaccatttagggacagggccaaagtcgagcacaaaggcagaaagtggtcctgtggctctccagacaagtttattccttgctatcccatccttccatgtcctttgagatctagagcccaggaggtaggacggcagggtcatcaccatgtggtgctagttgaatatgctgtgtgaggtggaacagactggcaagctgggcttctcgggacgtaggattggcaaattgctgggatgaggggtgcttcttgcctagcttcaggaggaagttgtctggagttctgacagtttggagaggtctgctgggagttccttcccactggattgggcaccattcaccagaggcctgatctcagcagtcagatcccacacacaggcctatcttccccatcagctacaattcaaacgtgttgtgccttcaccttagattgtttacaaaaggagttgttttcttatgtcattaaagttaatgagtacacataattttctactttttaaactttaagcatcaccacccattctcataaatgctgtttgcccagttgtcttagtctatttgggctgctgtaacaaaatgccacagactgagtagcttataaacaacagaaatttatttgtcccagttctgaaagtccgagatcaagggagggcctgtttcctagttcattgatggagctttctagttgtgtcctcactgtggaaggaatgagctagctcttcagggc

SEQ ID NO: 106099 - DNA, 1058 bp, Homo sapiens
tcaaaggttttacctccaaataccagcaacatatgaacttgtaaattacatttccaacacatgagcttcgggggacacatttaaatcataacagtctccttcccctcacgtctcctactattctccgtagtgctcaacaaggctgtggccatgctggtattcttttttttttccttaaacatgccaagccctttcagctcaggagtttgactctcacaatccctctgccttgagtgctctttccccacttctttgcacacctggctcatcactctagtttcagctcagatatcatctccattagaggagcttgccataaccaggcaatctaaagtcttttgcccagtaactctgtatcatgtgactccgtctcatttcctccagttcagcttgtctgaactctgaattcatttcctgtttgttccctctttctcttcactagaatgtaaacatcatgagaatgagggaatagtctgttttattccctgctatatctttgacacctatgtcctggcgcatagtagatgctcagttttatttctattaagaataaatgtctagatagcctactcattcctctgagccatggcaccatttaagtaagttaaacaatttattttagcatctctcttcagcttctctattatacagggcaagtggaatggaatattcacatggatgctttgattcttatttaatccttacaaaacctttaggaaccgagaatactcaagcccgtcttctctccacatctggtgtccagttttattttttggcacccagattccttcttggcgcttgttaccatggggaggaactaaatttgtcattatgtgtttactatcttcttcctctaccagacccttagtcttggtcctaggactgcttttattaattgctgaatgctcccagcctggcagagtgcttggcatgcagtggttgctcaaggtgttggggataatcctgaggcctaaaccccttattctgcctggtctggacatgggattttgcagccacagaatctccctatctgaacaaatatatgcttccccatgggt

SEQ ID NO: 106100 - DNA, 1039 bp, Homo sapiens
ggtcaggagttcgtgaccagcctggccaacatggtgaaaccctgtctctactaaaaatataaaaattagccgggtgtgttggtgggtgcctgtaatcccagctacttgggaggctgaggcaggagaattgcttgaacccaggaggcagaggttgcagtgagccaagatcgcgccactgcactccagcctgggtgacagcgtgagactccggctcaaaaaaaaaaaaaagtttttaagagatgtgttgcccaggctgttctcaaactcctgggctctagtgatcctcccacctcagtctcctgagtagctggggctacaggtatgtaccaccacacctcgctcacttgcaagttttgacataaataatgctgcagtgaatcttcttatatatttataatggatcaaccaaccaagcacctactacaggcaaactgttcctttaaggaccgtatatgtactcacttgtattatccttgtaacacctccgtggtggatgttagtattatccccattttacaagagaggagactgagaggaggaagttgagtagcttctctgaggtcacatgaggagtgagagagagccccagtcataatgaccccagagtccgcattctttactgccgccttgctttcagtgtcctggagtgtgtttccttaatgtgaattccagaacacagaagacagttcagaggctcagaagcaatcttcaaggttctttatgcatatgaaagcatttctgtccagataaggttgtgccaattcacagctgctccagcgacagtggtgtgcaagtgcttattttctgaaatccttgcaaaaaaaaaaaaaaaaaaaactagtaacagcattgtcaatttgagagggggacatattattttagcatgcatttctttgtgaatcacagaattttagaggagaaaaggacataaatatctttaggttctgcttctacaattgacaaagtagccctggtgcctggaattaggggagcattgggagtggaaggaggagggggccatgcagcatgctgccttgac

SEQ ID NO: 106101 - DNA, 1128 bp, Homo sapiens
agagccactgaagaatactagttcccactcacactgaagaagagggagagggaggaggtgttcagggcctggtttggagaaaatccagagaagaacagcacatgggccaagactggatggataaggtgagagcccttgggcctggggccctagagagcaagctccagtgagcatatcagccccatgaaggcgggaaccccagcaggatacccagcacatggtagatgctcaataaatacttattgcaaggtaagggaatgaatatagattacaatcaaaacactgttttcactttgttcttgcacagaggaagaaaaaacataggaagtaacccaatctcaattcctcttcttcccccagtaacggaggacatccgggagaggtaggctgaagtggcagaggtgaaggggaggtgtgaattgcaggacacaggctagaccacgctttcatcctctagacttccccagcagggcacccagtcgggctgggaaaactgggctgcaaagctacattgtgctcagggtccagcccctgaaaatgaaaagagctccaggaaagggaagacctgtaaccaccactgcagagcatgagaaatcagtctgtctgttacagtccaataggttcttctaaaaagcccaagaaaagggcagaagtctgatgagatggcattgggtcccctgcttaggagcagagtatgcaggctgctggagggatgggcagggttgctgaatttggatttgtcagatgtctcaacctatttttcaaatgttgagcttgataaaacacaaaatgcattttgccaggcacttttccccttaattacatgtgtatattttaaggaaaatttaatccatatgtttctgattcgtttacacggaaatcattaaaatattgttttccaagagctatttgatgtgcaagaaggctcacaaaccttataaaaagctgtttaaaattttttcctttccctttgtttcttttcccttcacgtgtgtgtgtgtttgtgtgtgtgtgtgtgtgtgtttgagagagagggagagagagcacacgcacataagtgaacaagagtgactgaccccaggatgtcagaaacaaattccaacttgaaatggattttcttctcaggat

SEQ ID NO: 106102 - DNA, 1145 bp, Homo sapiens
caggtgtcattcaaaggtttttaccatgaagaacccacccaaactttggcgttcacactggcaccatcttgccagcaaatcttctgcccagctcaatgactgggggctcctactgcttctgaggggacccaaggagaggcagagcagcatcttaaaacaatcagcatgccctaagatttgtctctacgatccattttgattccgtgatcattttgggggtcctaagcagtgtggccaattagacacatcatgaatgggtttcaccatctgagtgctgatggcatgcctggggcgttgttgggtgttagggcgtggtaagagaaagaaagccactccttagcaaggaaatcatgggtggatattttccatgagctcattcttcctgttcctctccctcctggtgactccccctgccagtttccccagcggacaaaagtggggatgcctttggggagaaaataatccatttcaatagaaaaagcaaggggagtctcacgataactgcgcaggcgcggaccagagagctcttttctgaggatccggcaagatggcagaagtagagcagaagaagcagaccttccgcaggttcacctaccgtggcgtggacctggaccagctgctggacatgtcctacaagcggctgatgccgctgtacagtgcgcgccagcagcggcggctgaaccggggcctgcggcggaagcagcactccctgctgaagtgcctgcgcaaggccaagaaggaggcgctgcccatggagaagccggaagtggtgaagacgcacctgcgtgacgtgatcatcctgcccgagatggtgggcagcatggtgggcgtctacaacggcaagaccttcaaccaggtggagatcaagcccgagatgatcgaccactacctgggcgagttctccatcacctacaagcccataaagcacggcgggcccggcatcggggccagccactcctcccgcttcatccctctcaagcagtggctcagctaataaaggcgcacatggttccagtcaaaaaaaaaaaaaaaaaaaaaaaaagaaagaaaaagaaaggggttcggaatgcagtgactggaaagcaaagcgaggccgtggtgccaccatgggtgtgggcttttgggtcactcatacatgcatgtgt

SEQ ID NO: 106103 - DNA, 1087 bp, Homo sapiens
atataccataggaagttcaatgaatggagtccatcatagagtgaaagtcaagctactccatccagagccagaatactcagtggctaagacatttccccccaagctaagagaccactctgcctccttgctgggtgcaacaatttcatttgagatataaggaagaagaaatttggaatttgagagaagtgtagttttggatttgaaacttagcagcaaaagacttttgactcgccctgctttcagttgctattgaatgtgcctgtgcagacagagtatttacatccatctcagggcagcctgcagttcagagtctgaaatcaaatgattatttctgaaagtattttattttaaaagcctttgagtgacaaatgatttagcaagttttcaacacgatgtttcatgtggttttggttgccaaagagtgacttacggccaagcctgggcactctaacccaagtgagcctacatggatctaggccatcacattttttttatgatgtttaataaagtttagcactttttttttttctgagtggtttatgatagtcctgatggtagcatctcagcaggctgggaaggagtaccatgctgatatattagagggaaatgcagaggtggaacgtggattcactgacccctctagacaagtgcacggcaaagggcagaaaggggacactctgcctgtggcctggacctctctcctctcttcccagcaggcttccagtacccgtcagccactatgttcttaacttagaggtgggttaaagcttttctgaatacagctatctggttattattatgaaatacctattttattcaatatccatttgtttctaatatttatgttggatattttatatacatcacttattctttccttaaacaactattttaattagaattaagtttggcttcgcatgacagaaaatgctaaaataattgtgaaacttctttttttcttatatgatataaatctggtgggaggcagtccatgtctgggtgatgggtgttacaatgtcatcagggtcccaggttcctttaacctgctgctctcccatcctagagaaaggggtcagcaaactatggc

SEQ ID NO: 106104 - DNA, 1050 bp, Homo sapiens
actgagtcagtgccccgagccaaggctgctgagtggcagagctgagcctcagacccatgccgtcagactccagaccctgagcattaacacctcatgtctagtcactggccaaggccagcctgttcttcccacagggcacctctcccatccaccacttcctctctgtcctctcagcaccagtctggggtggtttccctgactcagaactttcccatcccatccaccctgcatgccccagccatgttcaccttcctgaaacaccacgttctctgtgtccctcccgtggcgacacattgtcagttcctctttatttccaaccatattaggttcaactacctcagactcgtcctcacattcctcccgcatgggcccccctgcgcagttttatgaattttccaccattcccagataatgaggtatcatttttcctcttctaaaaatagtgttcattccttttttcacatctctgtgcttattgcttgccattatctaaaatgcccaatatctgcctacatcctacctgttggattcagcccagatatgctcctttaggaaacctcctctgaaattctgaatatgccataaacccctctctcttgagctgttggagtcctaacccaattttctttggaattcccttctcttgatcaccgttggcagattctcctttggcaatcatacatgaagcaagactggaaattccctatagactgttagaaatgcaaaatgcttgttacccagtgctgcaaagaaatagcacttgaacataaatttaattctctcagcaagtcaatttttactttctgcagaaagggtgccccttgcagatggaacaatggcgagagcacacctggacaggggaggggaagtagttcttattcctgatgcaggaccctactgctgtgtcgttcctctattggctagggttggactgctcagtctaagctaattctgattggctattttaaacagagcaggggtatgaaccagagtggcagggtgaatagtttggtgggaaggacagttaggaatagataactaaaggggact

SEQ ID NO: 106105 - DNA, 1079 bp, Homo sapiens
taggatttcaacacatgaattctgagggggcacaactcaatccataacaagattctatgaatcatttaaaggtttcttccagccctgaaattccttgcggaatggctgagatctgagtagcttggggcaaccaaataatggaaccctgagaacagtggaaagagcgctgcttgaagagtcaggaaatgtgctacttgaggaaagtgtcttgatttttttgacttttaaaatcagtttacttgattatgtgtcttctctgtcctgtggggctgatgacggctaccttctacaccttcaccgcgcaccctcttcccaaaattattctgcagactgcagaagaatgtggctgtaaagacaccttgaagctttcaaggctctgtctcagtgtgttattattatccccattatttataaggaataaggcgaaatgttgactcccgtgtggggattcagtgtctgttaacaaggcctcatttctccatcactgcttgcctctctccatcaaatgcagacctactgctaaagttttcaaaagctccctgcgttgcgagatttgagcaaacttgatcttccaggttaaacttaaatattgtttccattttgaagcctgtcatgtgggtgtaccacaaagagcgtttggtttccccacaacctcgcctgaagctctgggccgcggtatgtaggcagtaacagaatactaggaagaaagagagagcctgaaatggatccttggctctcagcctgtgcagagacaaagcaggatgtaagtaaaaccattacttctacctcctgatcaaaggcgagatggtaacccagcccctcctccccaccacccagcaagcaattaacaccgcctggcgtctcctctgcagcgatggcggttcgtgagctcgggctcaggagtggttgaaagtgggggtgccctctgtgcccaggttgaaaaatgtgcgcatttgcgaacagaatgtatgacgaaatggggaaaacacagaaaccaagcttgttgacagcttactcttttcatctacatttgatgcagagtgagatcagaatttgccagtggaacttagaaggtttgt

SEQ ID NO: 106106 - DNA, 2019 bp, Homo sapiens
tcctcatctggaaaatggggaaagcgatttcttacattttcctccctcatggagttcttgtgaagatcaaacgtaatagtggtgtaaaatgcgagctcagtgctagtacatagtaaggcactccataaatactagccttgttgtttttattttcttccctaccactacctactctacattgatcacctctcacaggcttgccacgtcaatatctctgtaattatttatcaagtatctactatgtgttataaagctttaaaagtttacttgctccatgtctcctgaatcaggttgagcattgagtgctgggctttgcattggcacacacggccaagggaacaaatggaaccattctccctggagacttcatgctatgcaccaaaaaccacctggctgggatgggttggatatagctctcgaagagtcaagcaaactgtccagccaataaaaaatatatgcctgcaagttcaaaagccctccatccacagtgccaataaactagcccagttaatagcccattggaattaggtacatgaagaagcttaaaacttttcagccattacaagaaatacaatcatgttttgaagtaggggaaacttcaacagaggccacaaccaagtgaaattacaaagaaaatgtgaaagttgtcttttccctagatctttgtactctcttatcttggccgagccagaatagttacttaaaatattggaaacagcttgttgagaaagcaatgttgcatcttccttgcctggagaaaagcatgtacacacttgcaggctttggtgtattcttagagaggcttcaaggaattgtgcaagcagggtatgttctagcagattatgggttctttgtgtttcatgtttcatggctgccagcagctggcatctttcagaaatcacatgaaaagtgggcagagctccttgtgcaaacttccgagccaaaggttaaggagactttgtgtgtaactcttaatcttgttgggaaattttagggtgaaaaatataattatacctgaaatgccaacaaccaaggccaaaggaatgtctcctctttggagggttctttgttgataagatgaaaaactaagctcttgtgctcctgcctacaaattattcagattatttgaaaagaaatgaaagaagacactgggagggataaccgttgcatactatgctatgtagcacttaactaatacttacctgtttagcagttagttcaataaatatttattgagtacctgctatgtgcacctcaacagaagctaaatattcaagttcctgctctccttgagtagttttactcaagttaagtatattcttactcatctctcaatgtgaggttctggtcataagaagaattcaaggactctggaggttagcacagggtaactttatattgcataatctataattgccatcaattctgtatagatatagattagcatgggcgattcaacaggctggcattgagagctgtgtggtgtggcctgaacaccagtcccagaggtcaagaggggcaacacacaaaggcactaaaaagaagataggaaagtgatactaccacattggaatgaggtgttgtcatcagccggcagaccccaatggagtcctgtgagacttgtagccatggaatccaagtcatgacgatgagcataacttgtcctggagtggagcacaaccgttaaggaaggcttcctttgtccatgtgtaactctacttagtctttctctgccccaccatgtgggtcttaggttgccccattttacagaggagaggctaaattacatcttggtcacacaactcagaggtagaagaacccagactgtaacccagttgtcattccccatcacattccgtgttctttgttcagtattatgtggccaccgctagctatctgatatagcaaggggttattcagacccagctccttaaaccacatgccaaagtctctccccagatgagtttatgagccagctaactcatggttgggaaatcaaatagtgagatacatatatat

SEQ ID NO: 106107 - DNA, 1021 bp, Homo sapiens
aggtttctatacaaagtggtggtttctatgcaaagtgcaggttttctttcacaccgcctgtacaggggtagctactgctgcttttaatgcaatttagattttgtataactgaggatctgatatatctctttcttgtgccattggctactaagactttcatttattcattcattcatttattattcactcatttgtccattctttcaccaaacggttaagttctcagttagatgctaggaaaccagtgacgaataagattgccatggttgctcccctgtggatcttgccatctagtcaagggacagaatataaataattagacatctcaatagaaaccttgcacgttttggtcatggctttgatggaaaccagaaagatactgagattaacttgaggaacctacttaaggaaggatgttcagcaagcatctctccaaggaagtaagttttaagccaagtcttaaaaggggagagtcaggaggtatccatgccaaggcgtgcatttgggaggtggtcccgggaggcatgcaaaagctggaggtgggaaggagtttataagctgaagaggcttgaagaccataactctgggtagagcacaaaacagtgagatgaggatggagaagaaggaagggaccagaaaacgtagggccttttatggcgaggtagagagtttagattttaagcctaagaaaactgagcagacatcagaggagtttaagcagggacatgacatgatttgatttatgttgtagaacaaccctggctgctgtgtagaggatgaattgtcgtggcaggaagagcagaagtagaggctgttccatgatctgtgagagaattgatggcactgacccagggcagcagtagtggagatgcagacaagtggataaattggagataagactaggaaggtgaagccaggaggacttggatggggaggtaagacaaaggacaaaattgagaatgcctccagatttctaccttgggtgtcaaagctggagcaggccattattggtggtggtggg

SEQ ID NO: 106108 - DNA, 1041 bp, Homo sapiens
aacatttacagatgtaacataatagctttaaggatgtgacagagcttttttcaccaaagttaatgtcatggtgctttctttattaagtttcaacttgactaacagtgaaaattcctgaattaggaacaaagggatccctataggtactgtaattatgccctgaatctctttgactgatcttctggctcctgatggaatcttccttggtttttgttctgcacagacccagaacagaatgaagttgatggcagacaactatgatgatgaccatcaccattaccaccaccaccaccatcaccaccaccatcgatctcctgggaggtcgcaacattccaatcacaggccctctccggaccaggtcagtttcatcgctgcttacctccaagaccccttttaccctttagatattttaagataaaataaataatcctcaagaaataataaacatcataaagtgatacgttctttgaactgaaactaatagctttggtatttatttccatcagtcaaggaatctaaatgtttttctttctccttcctctttaaggttttgtcttttcttgtttatgttatgcattttctttcctcccctcctttcttctttcatagatatgtagtctattgctggctcggtatctcatggcgggttactttggaatgtctctttcagagttttaagagaaagcactttgtttccatgagcttggcaaccagagaagccttgagttcgctgagcactttcctagaaaattctttagtgatgcaaattaatggtgaggtaaaacaacaaggagagaaatccgttttgcctgcgttttagccagtgaagtcaaggagtctggtttatttgatttggaccctatctcctcccttgactaagtaacgcatgtgaaaagatggattgacaaaaacaaaaaccgcctgtggttttacagcaatatttacattcacccaccaaatgcaaaaactatttacaatgtttagtattaaaactcttgaaggtgaattttatggaaattaggaaattaaatgcaaactagc

SEQ ID NO: 106109 - DNA, 1065 bp, Homo sapiens
atgtgtgcagagaccttgcttttcatcattgtttttctattcacattttagaatgtgaggaaccaacagtttttgagctcttattgtatacttggcattgggctagggattttaaatatattatctcatttaatcctcatgacaaccctaaaaaccagatgttaataattctgttttacagatgaggaaacttgggttcaggaactatgcagagatgccacagctggtaaggggtggaaccagagcccaaatgggactcacattgaagcttttccatgctcttcccaggagctatccctgaattggtgcaatacttcagttaggtcttagcccctgtaaacttgaggctaaaaagcagaataaagaaggctttattctgtgaccctgagcaaccactccccacccctcctgacccttctcgcctggcccctgctggctcccgccatgacctgaggccaccatgtgcaggctgggaagggcgacttatctcttcctgcatcaccagacatcaccggttgccactaggggagaaggctgcaggctcaatcaagtgtgctgtcattttggttttcttgcaagaaatgttggcacttacctcctgcagcctttgtgtttcattctcaaggtatctgttggaaagcctttttctctttagttttacattttctttttcatcatttaacatataaaaccaggtttttcctggtccctttctctctctccctccgttccttcctctcatcatataattaaaagtcctttcagcctgtcttcaccttatcatttcaaatacattgaaaaaagatcccacttcctgcccttgtgtcctcctgatgctggatttcaaaatgaaagaaaagccccttttcacttcctttttgcttcatactgccccttgaaaagctgtgttaaagtgatattgattttgtcattgatcaccattgtggtgcacaccaggtctgtcctttcctggcttcagaacttcttctttttcagctttttcaaataatagtatcaggatttttttcctgaaaattaaggaaaaggatttttcaccctctcctc

SEQ ID NO: 106110 - DNA, 1054 bp, Homo sapiens
tttttctgtctctcatgtctttatcatcatcaagcaagcaaggaaaaaggaaacagaaaattgaagacaaagaaggcctttcccctgaagttgggtagttggaaagctgattaaggagattaaaggcaggaggacatgtgtggggacatttgatgctagctgggctcctgcttctgctgtggaaagactcccacaaggctgttgtctctcctaaaatgtccattgaattaaaatttgttctttagttagacctgggagtgagaatcagtgttgttgtaagcagtgaactgtaacaatttaaagtttaatgaggcaagaaccaaattgggcttgtgttttatgtctctaatacttgtaaaacgtgccattctcttaaccatgttaaaataaatattagtaattaggtaatattaatggtttgttattttgatgaaggactttctttttaaatggaaaataaaggaaattgactggaaaggcatattatgttccccctggctggccaaggctaaggaaagcctgcctgggtcacccaaaagggccaggccatcctgtttacctggtgggtaatctggtgggttctcccaggctgacagccaaggctctgaaggagatccgagcctctgaaggcctggctctgcaaagccaaacctgcagaatgaatacaaatgcctccttttgtaaaccaggtctttgggaaaccactggaacacctagagagcaggacccagagaacaagaccagggaaacaggagagccaaggaaagggggaagattgcagcatcataacattgatgggagaccacgaagtcggggggtccctgagtgctttgtatcctgctccaggcaacagctcagggaagttcatttccccagtgtctaaatgcacacacagacttgagcttgggctgcagaatccatcttagcttgttagttgaaccgatgttgacataatgcctcactgcctgagatcccatgagctttcttcccaaccctgttaggtggtccttggaccactaagaactatgtggttatggcccattgtctcctcttt

SEQ ID NO: 106111 - DNA, 1625 bp, Homo sapiens
aggacttggctcatttttaatcagatttgcaaaggaaaagataattgttctactgtatgctggcatattgcaagctatgtgtgacatactatgtagagtttaattcaaatgacgaattgaaaaaaaatcccacatctaaaacagatgtacaggcatgatccataagtggtagtcaattcacaaattaagaaaataagtgaaaggataaatgcacatttcaagatctaagtctttgttcaatatgttaaacacatggccaatttcaaagtccctgtaaccaccgagttggaacacaacccactcagaagtagctggcatcttacaggaaaggattagaattccttatgaccttgatgtgttaaagaagttatcagtaacaattatttgaactcagcggggcaggagaaaagacaaactgtgagctgaagatggtgcagagctggctttgtatagatctagtcaagagaatcgaccccaagtagaggcattgctgaaaagtcaaaggcacttccgggcagcatgaatgagaagatgtggacagcacaagcctcaagaggcagcccttgctggcttttcattggcatgagcagagcaccctgcattgccatgtgaggtcctcagtgtgggggagagttgaggttgaggaatgcagggcattggagagttggacaaagagggaagatagtggcatagtaaggaccatgataaccacctattgcccatggatgcagaaagaagaaacaggctcaaaattacagcaagggatggaggttagctaaaagaaggaactgagagaagtgatggcagaaaccttgaaaccttatgagttcaacagcatctgttttctgaaataatttgaaatgggacttagtgagaaatcaaaggatggtgctggttaatttgtcaaacccatatttgccgtctcaacactcaaaggctaagcaggaagattaagacaaagacttctgatctggacctatttttaggttttccttgtgtaccctgaattatcttgccttcgggtaattctttcagtcattccctttgggtcaaatgtccttcaaggcctatatctaatgatgtcttttgcaagaagtctttcctgaagctggaagtatcctttgccctttccgagccctccacagtattgaaccatgatgtccttccttccttcgtgaggctttctatcatgcatcttcggttatgcctttaaatgtctttcttatctcctctgctctccttaaggccagaattaccacacatattagggggtaagtaatataatggatgcataaatgagcaaccgtttgttttgttggcatttgtggaaactctagctttggcagcaacttccatccagcacatgcaaagaactaactcctgacaaactccaagagacaaaggcatgtctcccagttggcttcatgtagatggtaattgaagcacaatttgaaaattaagatttcagctacattatagtgatttgtgcagacttattaagaagaatacacaaaacctagaaaaatggggtgggtgtgggattagtagatgacaaaacataaaggaagaagaaagatctctaaactgttcacgttaagagacgtactcaaaacactggccaaacc

SEQ ID NO: 106112 - DNA, 1035 bp, Homo sapiens
gtaattagaatgttcacctggcttttttgatcagcaaataaccatcaacctcaacacattcaaaaggggatgttaatgactggttaaatctatttgcttagaaggctaaaccaggagttctcacctttttgtgtttatagcattctttcaatttgtattattaaaaatatttgcagagtaccttgaacgaattaaattgcatctacatcaggaagctaaggcaggagaatcccttaaacctgggaggcggagtttgcagtgagcagagattgcgctgcactccagcctagatgacagaggaagaccctgtctcaaaataaaataaaataaaataagtaaataaattgcatccacagttatcttagcacaaatattgctatttggaccaatctatatactccccagggctcagggttatagcatcaccaggcatggttcacccgttgtcaggaaacacaataatttctgctggtgctgacttgacatttgtcttccctctctcatttcttagttgctaaaaatgacactgtactctacacccagaatccaccagctctctattccctggaagacatggtggtccttaatggaatagagcctcatttgtggctattgaagtgctgccaaggacttggtttcaacttcttagctttgggaaattcatgcacattcatttgttctacattttgggaaataataaatggaaaagttgtccgggatccagattgcattgaggtgcttaattttattcacctttccattactattgttggtcattgcatattcaccttcacatttcattgctacattccatagacaacaaatggaaatcaaaaggaagttctttaaacaaatgtttattgaaggcctattgtgaactgagcacaggggctggtgattaggtgtaagaagggaagtgatctgctctcttaattttagcagaaaaataaacatttgtcaacaataaaattatatattaataagataatggcttttaaatgcctagctttgagagctaggcacacagtgactttt

SEQ ID NO: 106113 - DNA, 1158 bp, Homo sapiens
ctaattctgactgttctgtagtggcttcctggagcactgcattcacagtcattttgaggccaagtacactagagctgtcctggattgattgttctttcctgctatggcacaagaggacagaatgaagacaagtgtgctggtgtttgccatccacccaactttgtaatttgccagtattgcttcagttaaagtagcttttattgctgttcacaaccacctttatactcatgagataccaaggactctgtgaagctctgcggtttttgtagcaatatgtcctccctccctcccttcctcccttccttcctctcttcctccttccttccctccctccctccttccctccctctgtctttccttccttcctttctccttccttcttttgttttgttttgtttttaattttttttaacttcaacttccccagaaagaaaaatgttcagaatccaacatgtaaaagaggtgtagagataggaataatgatgttataaataataataattaaaacaaaaacaacaaacacaataatgatactaatactagcaaatatagtagtttttcagttttcataactttatattaactttagtgtaatatcaccacagatgaaatattaatttctcagcagagggtaaaatacttttgagagatggctgaaattatcacaggacttaaaggatgattatacattaataatggttctaatgttagaaaaaattcagaagtaactatgtccattgaaaaaaacagccatgatattatctcaaataaaaattattagtgacttttagatggatatttgtgtactgaagaatagtgatattttaaatagttatgcagacatccagatatacaaacatatgcacacacaaactctttgtggcaagtctggaaaatttggacattgtgttgtacccttggaggttcagatcataatcattagataaagaaatctgttaaactgtatattgtatttttcaattactttgaccatataaccgttttatttgttagtaattaaaaccctaaggagttactgtcacatgttggaaaatgccagcccaagactcaggtataaaatggaggaggagtatttttcagggtaattgactgctcttcctcagcctggatctgaaattgttaacactgagaactaag

SEQ ID NO: 106114 - DNA, 1037 bp, Homo sapiens
ccatgttctgtgcaaagggcccaagaccctgggctctctctgttgtcatatcttctccttattaggctgagctcccatggccaacaatggtgtgacacccatgtgatccaaaggattctttttttttttttctcatgcagttttgttgtggtcaactctaatgagagtagatgggatttttggattttttaaaagttaggtgggcaggaaaagcaaaaaatatgtatttataataaaaactattttttaaaactctagatgagagaggtgaggaacaagtatctaaaaccaaagctctggagtccagttattaacatgcctcacataatgataatgggaaccaaactaaataaagccctggtgatcttcaagtttgtgggttgggcacgcaagccagaaaaaattttgttatttccttggaatgcgttgtgtgtcattctccagtgcattccctctagttgtgtgtgtgtgtacatgtttaaataaagacaatgacaaaataattgattgtaaagagttgtagcaaacaccattatctgaagtgtagtttaagtggagagaggctggaccatagagaatgctgagaataaagcctggactctggggaggccacgtaggagcctgctccaggccagtacccactgttgtcctgttaccatgtgcattctcatcctgccaccaactcccagcatgggcttaaaaaaatcattatctagtattttttcttagagatggaagtaagttttcttcccaaggtcagagcttttccaagaatgtgccagcagtctctgcagtctctgaatttcaaacaacatctgatggggtctggattttgagcatggacttctgtctggctctccaggctatttgatgggatccagtcttgctctgtcaatcagacttggaaggcaaatacaagtcccaggggaagtcaggctagaaggcaggacaggaacttgacaggaagagaccaaatgttgccctttggttctctcgtgtgtgtgtgtgtgtgtgtgtgtgtgtgtgtgtgtgtgtgt

SEQ ID NO: 106115 - DNA, 1039 bp, Homo sapiens
agataaatttgcccaaggcacacagctaatgtgggggagggctgagatgccaaccttggccttctaccaacaaggcctggggcttttataacctctaagctctcctaactagaaggctttgggtacatagtcgatttgcctagtaatttgctaatccagttcaaagttttgaacaaaagaccttagaatgaatagcaaaaaggataaaagagagagagagaaatgaaaaaaaaattaggataactttagagtaattaaaacaggtccctatatcatgggctgttaaaggcttaaatgatgctaagttctggactttctccatcttagaatatttttcacaggttctctgttttggaggatttgccatgtttccacatgttatgtttgctttggggttgtctaggggcattctaaggagcatttctgctacttggcaccaggagctcttcaggaggagtgacaatgagctatgtgcatatcttggggtgcaaccagctgcgctggcttccatgagatccgtagtaaggaaggcaaggtagatctgaatctcatccgaggagtggaggttcctcaagaatgatggatctgcctttgatgtctagcagtttccaaatagcacagaaatgatacagatacatgccaaaagggggaaaagcaacttttgatctagttagaactaattaaactttcaaaatgcatgaaagaaacttgagtgctggccagttgtttgctatggatgggttttgtcaacgagcacagttgaaaatagcgtagctacagcaaacccctacctttctatttgggggaaattagttttttggtttttgcttctaaaatgtcagggatttcccccgttgcagactgaaataacccgtgtagtctcttttacccccgtttatccagggatattaagagtgatatttttctttaatgtcttctcagaaggctctctcttcagtcccttccttgctgtcatactgtgtttagtctcatgtatgctttttgttagtgtgtggactaaaaaaggtaatctaattaa

SEQ ID NO: 106116 - DNA, 1048 bp, Homo sapiens
ttaattaaatagtagaaagcagtgggcagataggtgcttcttcccttttttggggcaggaggacagcaggatggggagatggtgggaggaagggggcctgaggagaactagttggagaaggcctttgaagttggcttccttatcttaaaacaaaataagggacacactgtcttccggccaaaaacatgcactgtatgtatagttttaatagagaaaaatgtcagtcaaaagggacttcagcctggtggtttttaatggaaatacaaacattttctgagctagagaagtatagtctttcagcctaaataatcataatcagcagttaaataatctaaatgcttgtgaatcatagagtttaaataattccaagcaccatacttcatgttatctctatcttcacagcagccgcatgggggctagggaaggtcacccattaagaaaagggaaaagaaatattcaggccttccaacctcctaaaacatggtaagtcagaggaggcagtcttggccctttcttccaatccaagagcagcaacatattgaaagaattctgaccagtacctgatctaatactgtagggggcgttgccagatttaaccccttgatgcaagggacagggcagccacatcacacaaagaaacactaaggagccgagagtacagaggaatcacacatcaaatcctgaaggaagaattatttatgtaatctcagcactttgggaggctgaggccagtggatcacttgggctcaggagttcgagaccagcatgggcaatatggcaaaaccctgtctctacaaaaaatacaaaaagttagccaggcatggtgttgtgtacctgtggtcccagctactcgggaggctgagatgggaggatctcttgagcctgggaggttgaggctgcagtgaactgtgattgcatcactgcactcctgcctgagtgacagagtgagaccctgtctcaaaaaaaaaaaaaagaaaaaataaaaattaaaaaaagagaaaagaaagaaaagaaaaagaattatcggtgcagtgaggagaaccctgag

SEQ ID NO: 106117 - DNA, 1045 bp, Homo sapiens
tgtctccttttttgttcatatttggaaacgggagctgcttttgttagactagagaagttgcatctggggagaaaatgctcttcccatgctcacctttggcttttaaaaggtcagctctgttgccaaacactgtaagttaaaccttagcaggaatgaccgtgaaaacgggctgagtcacacattgaaatggcaatgtggattattaactgtcatgcttttctttctgtctaaattgaaggagaagatgccacgaggccagctggctctgtccacacctcggtggtctagggtgttgaggagttcacatggccatcttgttcagaaatgtgtttccccccagacgctttctttcttcactgaagagtagagtgagttatactttattagactcatccagatgagaacatgttcatgatggtttctgcagcattaggaattcctgctttttttggttgggtctgctagagttgtaaaaggaagctttctggacattaagtttgtagcaaaaaggggtagaatgaggttggcaagggaagaaacaattttgatgtaataaaaataggattgttcaaagctgagatgagggctcttcttactatttggtattcagatgaaatttagtttggaagtcacatcagcgaatattatatttcttcagaacctctgctgtattttcgatcagggggcatcttgattttgctttacttgtgcagcaatcagaaaagccatagatggtttcaacttgtgtgtgtgtgtttattctatttttacctatggtactctggccattaaaatatgatctgtatccattttggaactttaaagaaatgattttggatgagggcaaaaatgttgtgccacctattccacacagttcctttcttgtcagtgctcacttgcactggcacttaatttgttgctgtacatgagaacatttctccatcacctctgaaaatgtctcataggcaaggcttttagaacctgaatttttaaacacgaaacaggattatggattaatctcaggcaagaaagtccccgagggcta

SEQ ID NO: 106118 - DNA, 1025 bp, Homo sapiens
tgtgttccttaaacatttatctcctttattcgttaacttatttgctttcatcaaatagtgatggtatgtctgctctgtatcaggcactgggatgtaactggcactacacccagaagcagcatcgtgagagacagaagcagatccgtagtatttataatatgatatctgtgcaagtggtataatgtaattcacactgttctacaccttggcttttttttcttggcaaactattttggagatcttcccatatctatacctaaaggctttctactctttttcacctctgcatactatttaattgagtctgtctccttttgaaggacttttaggttgtttctagtcttttcctctcatgcagtctgctataattaataactttgaatagacttgatttcaagtgtatgtgaatatatctgtaggataaattcctaaatgtggaattgctagggtactatgcttataatttttctagattttaccactcgtcctctacagaggctaaaccatttacagacccatcaacaatgtgtaagaatgcctctttttccataaactctgccagtgcaatgcgcttttcaaactttatctttgttaatatggtaggtggaaaatgacccttaagtgcagttttgatttgcttttattttattacaagtgacaatagacatgtttaaatgtgtttatactttgtcatattcttttattggtctttttcttatatatttgtaagagctttttatatattaggaaaatgatacgtttgtctttgatctgacatttgtcacttttcttttatttggctaatggtggtttttgttatgcaggttttctttacaaaattattttacatagtcaaatgtattcagtcatctcttttatgtcttctgaattttgtatcatacttagaagccccttccacactacaagactataagaacaattgtcctgtggtttcttttagtaattttatgatttgtgtcttagtctgttcaggctgctataacaaaatataaactggggagctt

SEQ ID NO: 106119 - DNA, 1049 bp, Homo sapiens
cttcttttatatttgacttgctcttgggagcggatgcattaaagtcagtattttctttcgtatttgtctcaatgtctgcatagtctgacagcaataaatgtaaacggaaggttcagggtgtctgttttgctatgacatgtaaagaccaccttgggacttacatcattagcatgactttgagacgtgaaacatgcatttactgaccacaccatttggtcacatttgattctacggcaattagatcctactcgttctgtaagctggccaactttaatttcctgaccagagctgactattgttaccttagtaagattatatttaccctttctgtctactgcacactttattgctatgtatagaatcaatgtgttcaaattgaaggcattgctagtagaaatttcagtgttttactcactcacattctttctctttcagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggtaagtgaagtctaagaaaaagaatcatgcttatttaaaaatgaatttataaaatggaacaggaagagacgtttttaaaaagaaacaaaccccttatctgttgctgtctgctgataaaagaattaattaaatactcttaactttattgctaagaagtctatcaaatctgtctgtaaacctgaaaaattatctcagatttcctgtttaagaaaaacttgaaaaatagatcaaaatagtagcagaagttaaaaatattataaaaaccagccattactctctgggcaaatctcaactatcagcaaagaaaaatagaaatgttttcaacaaatcacagaatccggaagccacattagatattaataaacttttgctactttcagatgtaggtcatttttttgtaccagaactttgcaaaaagcttttctgacattgttaactttctagaagttcaccaaaattgtcaagtcccatct

SEQ ID NO: 106120 - DNA, 1029 bp, Homo sapiens
taagtacacactttccagtgcatggaaaataaaccccccaaacagaagacctcagctggcacaggctccctcctgccatgttgaatttgggtgtttgagtaacgtgctgatcacaaccatcctcgctctccattttgtttctggagaaatattctcatggctagggttgttttttatctcttctgggcttgggaagatgcgacagggcactgatagatcacacatggcgagaaggtgctataaatgttaagccttaaagtctagattacattccaacatcaggtagagacataaaagttaaaatgtttgggtatatggaatatttttctctgcctcttcactcaacaccaaataattttaagagcccttgactctctctctcatgattacagagtgtctttttctaaactctctccagcaccactcactacctcccatattgtaatttatttatatcacagtttggatattaggcatttcctttagtccagatatagaccatccagctttgataggtaggatgcagggcaaatgggacctcagtcatgtgtttcttctcagaatcacactgagtcctagtaagcccatgtgcaaatatctacaattgattgtaacccctttataaccactgctataatccagagtgttcagcatgttctgccaatattccagtaatccaccaaatacctatatttgtgcataaactcaaaaatcatattttttcaccagatataatgaaaacctacagagaagagtggttttatgccaggctggtagatgaaggtaactttaaacaaaaatgggccacatgagaatctgtggcccatctgtagggcatcatctttagtgcacctgtcatgaattttcatttaggaagaggaagatccccaggacgtgagtatccctccacctttccaggccctgtatctttctggctattatgtgagaaggggcacagctatcagctatttgaagaatctgccgttctcctccccagtcacagaatgtccactctctcttgtaatgcag

SEQ ID NO: 106121 - DNA, 1011 bp, Homo sapiens
gcattcatttttcttcactgtattattcaaaaagcaactgcttgtacccatattttgtcaataataccaggattaccgataaagttagtgtaattgtgttgctgtgtgttgttgggtaggagagaatttgagaagcaaggcagtctgcttacccaaaccagcagtcaggtttcttgatggtttctctccagagaaaatgaatgaggagccaggtcagaaaggcttttcttctcactatcttatactgatggaggctatattccttgtcctctttcctttctcattcccctccctgtattttacctctctcaaattaatgtagtccaaattagacctatacatatttcatgaaaaagacagtggtgacattatgtggatagcttccgtcccatgttcaataattaaaatgaccaaataaagagttggtgctttgaagtagaaaaaaattattctccgtgtgcagagaaagtgagatgattttctaagtcttctgctttgaagttgggagtatgagattactgattttatcagctggaaacggctgaggaattttcttttgccttttttttccttttaagatctctttgtacatggaaacagaggagaaacttatctaattacgtctgtctcttagggggagcaatttaggttgaaattgctctaattgttggattgtgggcagaggatttttggcagcagtgtagaatactttaaagtgatttccccactctttgggatagcagaggtaaataagagtctttctacctgctgtgtggtgtgttagtgggtgagtattcagaagatgagatatgttgtgtttcattatgccctacaatgaaaaatctgaatttaaattcatatgaaataatctgtacaccaaacctgtgaaacacaatttacctatacaacaaacccacacatgtatccgtgaacctaaaataaaaggttaaaaaaaaaaaagatatggtgctcatcctcaaaggaggttacatgtgatagctccttgcaatt

SEQ ID NO: 106122 - DNA, 1025 bp, Homo sapiens
ttatttttacatatgcataattattaaatttacgaatagcccaaataggtcttttgagactgtgagatgcttttatctgttcctctgtttaaatcattttgcttctgaaaataataagtacaccaattaaaaaaatttgttttcttttttctttttctaccacttgctcttaaatatgcctgttctcttgttctaggttttaattttgtttgttgctttatgaaatgcagcagagttagagtaatgcagacctctgtgagaaagcagtgggagaggagagaaaaatgtgtaaatgatttttatcagttgtgaaatatgtgcatactccttgctgagtttgcaaattatagggaggaaattatatttatccagtgtttacttcatcacaacgtgtgtgcgtgtgtgtgtgtgtatgcaagcatgtatacacaaggaaaaaacacaaaactattcatacttctgtcaactttccatctctaactagatgttgagattgtgctgaaaacgtggatcaaggagtggagatatgaggggactgtccagtggatttgaatgtaaccagggactgcctcaaagtttagaataagtttccctgcgcagtccttcctctggtttctttcttgcagtccctccctctcagagagttaagccgaggttcggcaagcacagtactagggtgacctgcagacagtgcccaaatcattctgaaaatgaagaccagaggcacagatatgagtgaactcaagaagtttgggggaaattattgttttggcttaaacttttccctcgactctgttattccacaatgggagattgttcaagccacttctacagctgaaaatgtcatgaaatttgtaaactctgcccctcatcatggactctgtccaggtgaataaaacatttatatgatcttcagcaagtcatgacctttattagcccacgtttgtctgagagaccatcaatccttgagttagatttaacttttaatggctagttacttttaatggttccagaagtggtcaggt

SEQ ID NO: 106123 - DNA, 1035 bp, Homo sapiens
atgagtctttagggttttccaggtatacagttatgtatcagcaagcagcgacagtttgacttcttctttaccaatttggatgccctttatttctttctcttgtatgattgctctggctgaaaaattatattaaatttaagttctacctaatgagataaattttatggaatagggtttagctttggaagtctagcaactattgtaatatctatagtgttttcatcccctaagaaccaacttttgcccccttggtggtgatatcactcctattcagaaagtatagtttaagcttttagtttcttgtttcaacttctgtaaaatggagctaggaacttctaatttgtagggttgctgtgaagattaaaagtgtcagtatatgtaactttcttgtcatatggtagatattcaaatgtagatacaggttgtcttctattaaatgttaattgaatatcagggatgactaaagttggtcaaataattttatgtttatattacagtttttaaaacatgcagatctgaaagatgagacataaacaaaataacacttactgaaaaggcccagcagtttatccaagatttctgcatttaatggagatttttggctttgacagtttacttagcttaattcaattttgagtcttcagttgtggaatttcctaaggaatgcctgatagtgtaacttaagcacaaagtaaaagcccacacctacagtgtggatgcattattcattttatagcataaaatgtagtatttagtacaaagcacacctatatggattccctcaagaatatgccatcaggcaataattaaattatgtaaaaatagtttatccctattatatatgcattctccaggcttaaaagcagattttgagtcataaatattaaactctgccatttttggcctgttcccttcttttcaattagatgggctcaacaaattgtttttcccgtggataataatttttattaaaggaaacacaaatgcacatctccatagcaactgactagaatcccttgccaagttctcttcttt

SEQ ID NO: 106124 - DNA, 1433 bp, Homo sapiens
cccgcttagttgaaattaatgtttgctgtgtgatgcactgtaagtcttcttaatgtcatgttgtagctgggtgttttgtcctactaatgggatttgaaattttggaaagcagaatctcatctcttactttttaaagtgtccacaccagtttttagttctctgcaccctgcaggtactctatgaatgcatacccaaggcagtgactgcttgggcaaaataaaactttagttgaggaaaatgcagagttccattcatcctgtaggcaccagatggctggtcatactcatatggattgtttatgatccacatccatgggatccatccatgccgagccacaccagttgttagatagttgaatttgacttctgcgaagatgcgagaattcctgctatacaaatgataaatcctcaaatgtgtgctgggttttctggatggcttcaggacactaagtagggaagacaaagagaaagcctgtacctgttctactggtgttgactttgaacaatttcagaaaagccaaatggtctagtagttaagagctaagggtctgacatcagtggaatcgggttcaagacatcattctgccacttagcagcagcgtggccttagacaagacacttatcttgtctgagtatttcttcatctttaaaatgggggtcattgtgaggattgagttaatctggaaacatgattggaatagtggatggctaactgtaaacctcaatatgtgttatcttttattattattataataaaatgaaactaaaaagtttagaacagtggttgtcaacaggggaagattgtgccccccacaggagatgtggcaatgactggagacagttttgattgtcacaaggtggatgtgtgtgtgggaaggggcactgctggcagcttgtgggtggaggccagggatgctgctaaacatcctacaatgcacagggcaggcccctcgacaacacggttatctggtctctaatgtcaatgatgtcgaggttgggaaatccttatttagagcctaataaacacagtcaagtcaagataaattagccaagaaaagctgaaatattaaatcaccctggcatattatgggatgacaattcatgaagatgagttttttttttttttttttttttaaagaatctgaggaaaaactgatgattagggaagaaatatcactaaggaaggataaaagaagtcgcttttaggaaataggccactttaggacataaaagctggtggactaatcttgaaaaagccatgaaaaatcccctttatttggggattaagctgctaaaaggtatgtatctactgccatgtctggagctatctcataaaggagcattcaggtagggaaggaaattttgttgcttttaaaatacaactaagggccgggagtggtggctcacacctgtaatcccagcactttaggaggc

SEQ ID NO: 106125 - DNA, 1086 bp, Homo sapiens
agggaaggtgtttgccagggcaatggagggctggttgtgctccagggctaaagggctcaagtagccagcttaacctaggttattatacattctgccaggcctgccttggcccttttctcacgtttgttttctttgctttccttcttgccactttttccaggagatgtgagcaaatgaaatcctatttattttacaaatgtaaaaagatattttgtttaatatggcatttgaaacatccgtctgcctctctctgcctgtttactctgataaatcctagtaacataggcataggtgggtgaggagccaggggtcgtgcagtatattctctgggggaaaagaatgttaaatttcaacagaaaggattattcaaataagtaatcctttctttgttgttattgaattctttagtctagcgttatattgtggcttctgaaaacaacagaatttgtgaaggtaacaagggcaagactttgtgaagaaaggaaatttatgatttaaaaaactgaactttacaataaggaatggtaatttaatttagacaagtctgctttgtgtcctgtcctttgctgtttgttcagtgaacattctggtgcacttactagaagccagacacgtttggtcctctatgagcttacagtcttttaggggagcaagtcatattaactaaaaattaaaatttgataattggataattatttattttagagatgaagtctcactttttgccgaggctggaatgcagtaaggtgatcatagctcactgcagccttaaactcttgggctcaagagatcctcctgcttcagccttctgagtagctggaattacagatctatggcaccacacctggctaattttttttttttaattttgaagcaatcctcctacttttgcctccgaaagcatagagattacaggcataacccattgtgcctagcctaaaatttgataattatcgattaagtgcttattttggtgtaggcattggggacacaatggtaagcaggacttgtggagtttcattctaatggggaaatgttgggtgtggagcttcttacacagcctggtgtgtgtgtgtgtgtttgtgt

SEQ ID NO: 106126 - DNA, 1029 bp, Homo sapiens
tgcatttcatatccttcttttactccctcttgttgagtatgtgcagtgggtagagtgtgcagtgtagagtcagactgctcgagttgaaatccaagcatcaccacctgcttgaagtgtgaccttagggaaattaactttctatgcctcagtttcatcataagtaaatggggattacagttgtaccttctcttagggttgctgtgagcattaaatggagtgagctatgtaaagcccttggctcagtgcctggcacagagaaggtgttcagtatatattatttcaccagtgaatagaagctacaccaggttattttggttttttttcatctctatatggttggctttgacttaaattcatgagagatgagctatcttcataagtaataacacaagaaggtctctcctgagtagtcagataggataagtgcatttaccctgaactgtccagtatggtatacttaatagccaatatggtatactcaatactcagtagccacctgtagctattgagtatttgaactgtgggctatctgaattgaccgctttaagtatgacatacacatgggatttaaaagatttaatacaacaaaaaagaatgtaaagtatcagtgatttttaatattcattacatgttgcgaaaacactgtttttggtatattgggttaaataaaatacgttattgaaatggatttcacctatttgtttttatatttttaaaatgtggctactagaaaatataaaattgcacatgtggcttgcattacacttccattggactgtgcagggctaacttaagaggccagggttctcgaatggaggtacatctgccaaatcacagtgcctctgttgcagtggaggtgtcccttaactgtttctggcacactgctggtatagtcatgacaaggcaggaatgggagcctgtctctgaactcaattcatctggcttatttggtgacattctaaacttgggacatatgaatgattttgggctcttttgggaacttggaattatatggaaaaaatgttttct

SEQ ID NO: 106127 - DNA, 1194 bp, Homo sapiens
tatgtgaggattactttgtaaagtgctgagagaagagcccagcacggaggaaggcaactccacacgtttgtctttactattatgaagtgctgggaagctgctggggttacagtgctgagttgagggctatcctctgactgaaggtatcccgagtctcacaagggctggtggggtgaggtggacattatttcttcactgacacaaaaatacatcattataaaatgtgtgacgctttgaaggatgttcaaggtgctataagccatatacatgcagggacctcctttggctttgtgctagggacactggttgagaaggcttccctgtggaggtgacatttgagctgcagcatgaagacagagtaggacttagcaaggccaagggagtagctggtggtgggggaatagtgtgtgcatctgaagtgacgggcagtatgatgggagtacagggaaacaggtttagggtgtatctacctgctgtcgtgttccaggggggtccctgggcccatcatcagagattctgattcaattgctaggacctgttctgggcatcaggatttttacaagctccccatgtgactctaatgtgcagtcagggtggaaattactgctcttggcttgttagaaatgcagactctcacccctccacctagacttagtgaatcagacctgcattttcacaacatccccaggtgatgtgtgtgtgtacaataagtgtgagaagttctggtttgtggatagactcacccaaagttggtcaaaagaataggtttctgattcttgtcccagaaatgctgatgcagaaggtccagtgtggggtctagaaatcagcattcataagaaataccctctgtggttctgaagtggttgattgagaccagacttaagagcatgttctcaagaatgtcagaatggaaattagagaggacgtgagaaggaagtggacttggacttaaacctcagaatgcttctgacctgatgaagtctggggcctccctcctgtgaatccatctgcagaattctaatactttttgatcttctaagctttaaataaaacttggaaaaaggacagtgttcacaataggaatactaatagtctattaaatttgggggtgggtgaaagttgttgggagtagcgagattagcggtttgggttcctctggaatagtctttaccagctcttgagacgagttgtttt

SEQ ID NO: 106128 - DNA, 1081 bp, Homo sapiens
cagaggttttttttttttttttttctgtctagctttagtttggtataattggtatgcaaacaaacaatgcaatggtttttttcccagttaaagcataaattttaattttagcattttaaagtcattgtttccccacacagtcatgattttcctaaaattgaaatagtctaatacaggaacgctaaccttgggactctatatattcccaggaggatgactgacttggctggcaattagtttgattatatttttttaaatataaaacaaacaaacaaaaacaaaaccctgcacataattaatgcatacaatttggtgagcctggacacatgcatacacgcatacactctgagcagagtgttgatacaatgcgaagccctaggttgccgggaggatgggctactttgaggtcacgtgccgcctctggcccagtgagcgagcaggcatggtgcctcacgggagccgcaggcctccaggaacacaggagcgtgtgtgagatgactggtaggtgttttggtcactggattgatgacaacatgggtagaagagatcctggatatggagatgtgatttgatccttgcccgtcacacctgctttgtcttgaccactcccaactcctggccacgccagcctcgtgcgttcctcaggcgcgcgtgcagagctgtgccttagggcctttgcaactgccctgcctgcgttgctgctgctcctgggggacagcgggcttactgccctctcaggctttagccagatggcacccactcggggagcccttctctcctgacgctgtctgaaggagcctgccagcccttaccttaccacctcgtttagttctttcgccacacttattgcaatgtctttgcttattcgtctgttgtctgtctaataatagataagtaaatatctattactcatatatttctagaatgtccctcttataccagggactgttcagtacatttattttgaatggatgagtgatggctctccaggcattgtgaccattacgaagcgtaattgtgtgtgtcagggaagggggatgtgagcgtatatggggtgtgtgtgtgtgtgtttgggggaggg

SEQ ID NO: 106129 - DNA, 1078 bp, Homo sapiens
tcatgcctgcagtgagctgtgttcattctactgcactccagcctgagtgacagagtaatactctgtctccaaaaaaaaaaaaaaaaaaaaaaaagtataaccacttaagttctaaaaacgattggctcgtgagtacatattatctgagaaggaatggaaagaaattaaaactcaccgattcatcccttggaaaatctttctaaaatatccatgtgaaataatataaaagtttccaaggaatcctaagaccaatagaaatcaataagcctatgagatggagagttggacagtgcacatgatggccagatttagaacttgcttaaatttagaaatgtaccaaataataaataaaattgccttctcaaaaattttaaatttctcttcggggtttttacctttgggaagccatgtacactttgagagctgatgaaaatgtcataattttccctagaaaggtgtgcataatctggattgtgcacaaatttcacttcctcatccctactgcaaactcgaagggcatctcaggatatttagatcaagatcctctgtctagatattaccacttcataaaatattgcacatgtgttgggagtaaatagttcccagtgattagtgaaatgaatgagcttttggtaatatgagacatgtcttcatttcactgctattcagtttgtgctgagaaatagggggcatgtgccaggattttggtgataaagggtatgtacattggtaagatggaaacttgctgatggactgtactgcattcactaagtgtattcagatacaatatactggaggtggtggattttagtctaccttcaggaataagttaccttgaaagagtttgcatagcattaggtgtcacatagtaaaagcacatctttaaatattttcattaaggactttccattcattatgcttgtctctgggtacgaaaattccaagtttacctctggcaattctatatcacttatttgtaattgtaactcaaatctcatactacaaatgcagttatgctgtaggcatttgtgataagagcaaggaacgaatgattttgttgaattatcaagtgagggtt

SEQ ID NO: 106130 - DNA, 1048 bp, Homo sapiens
aaataatacattgagatacattttagtgacatataaaaccttttccacttttattaaaaacatttcgaaccatttgtccatttcatgagggttagttcagtttagaataggtgatatccataattccacttaaccgtctcaggttgccataagccaggagtgtgtgaatgcttgagggcacttccattatcccttccttgttctggtcttactgtgatcacaggataccttggtatcataggtgaaatgtgactgtgtgacatatgactcagtgaaagctctagtattaatctgtatatttaatacaagtaaaatgcaattttctcttttagattaaaaagtgtaaaatgaggaagaagcgcagagattttgaaaagtcaatttacttgcaatatgatgtcttacaaagtaaaaaatataaagattgacaaaaaacaagctattaaaaaaactgtcttctctttttggaagtatattaggatcccttttagaagtataggagtacctgttggtcaggatagggtaagttttgctgcagtaactaacaaacttcaaatctcagtggattaacatatttgagatttatttctaatttgcttaaagtaagaagcaggtcaggtgactctgtgggacgggtcttttccatgcagtgactcaggatccaggatttctgcatcctgatgcatggcttcaaacgttgccacagcaggggaggagagtgactggagatggcacattggttctttaattccttgaactgaaagtgacataattgaagggagtgtgaggtggagtcctctcttctgtccaggaaagggaggagagacacatatatggtggattactaccagtggggtttttatgtttttccaaaaatggagctaggtgaaataaagtttggggagcaatcttctgctattgctgttgtttctattatactgctagtgctaccagtagacatttgttgagggccaactgtgtgctaggcattgtgcttagtgctttgtgtacattatcttatttagtgatttcatcagtcatctgaggt

SEQ ID NO: 106131 - DNA, 1046 bp, Homo sapiens
tataattttttaagacctcttgagggaaaggggaaacctttatagaaaacattttttcatactgtatgtgtcactatctgtgacagaaatctcatctagaattgaatgtagcaaaaaggaaatttatagacaaatgcatcagttacccattgatcctgtaatgtggcaaaacagtccaccacaaaacatcagtgacatactaagaagcatttatcaagtgcataagtgtggtgtttagctgatctcagctgggctcgctcatgccccgctgggcagtggctggttggctaggcagttctgctgactttggctgggcttgctcacacatcttggggcggcttgcctgttggctaggacaacttggttctattttatatttctcatcttgcatcaggctagattgggaatattctaattactatggtagaggaaaatgagcaagagagtaaacacatgtgttgcttaaggcgtctgcttacttcacatttgttatcaccttactggacaaataaagtcacatgactgaacctagcatcacattgggaaaacactgccaagacatatataaaaaaaggagtaaaggattgagacctttaatgcaatcagtcacctggcatatgtaactaaaatggccagggaacagatgtatagatgatagatgatggtaacttctatgattcctggatctggagtatgaagtgatgtcacctggtttggtttcacactctttgaagtttagctgtggttccctttgtattgtctccaccctcagggaggccctttccacattgaagtactcacagctctatcttgaaagtaaggaattccagctgaagaagagcttatctttcccagctgttccaactagagtcctagtatggagtcttgttggaccaatgtgggtcacatgcccatcactaaactagctaccatgtctggaggatacaatatggtggttggccaggcgtgggtcatgttctcaccccttgcaccatccaggatggtggagtgaagggagtcaaccttatctaaacccagtgaactgt

SEQ ID NO: 106132 - DNA, 1008 bp, Homo sapiens
tggatgatatttcctagtttggtaatctgcagaggaagagagaaatgagagataaatcagtgagaaagcactgtcctatattttaatctaaatgttacatatttggttttagcactgtgtttgtggtagctgggtttattagtcagatattgctaggttgtgctgggctaacaaaggacctccaaatctcagtggcttctttctctcaggggttgtctgtgattctgctccatgttatctttattctgggacacaggctgaaggagcctttcttggacagcctatcttcatggtagagaagaaaaaagaatgttttacccacaagagggctctgatagctactgtttggttatggcatttgttacttctgctcacatttcattggccaaaacaagtcatacggccaagccagatgtcattggagcaggaaagattatcttcccacaggaaggagactgtagggatgggcaggctagggggatggtgaatatgttgaacacatgatgcaatttaatgcatgggctaaagttttacttgcatgtgcaaagtttttttttggcaacctttttaatcaactactttttttagacccattgcaagatgtttaacgctgttatttctattttactcatgaggaagaaagggtctaatgtaagaaaacaacacaatgagcctgtggtcaatattgatgatgatgaggattgtactgagtatttactaagcctcaggcactgtgctaagtacttctgccttctctgatttaatcattattcaccttatttttgtgaagtagccattgttacacttgaggccattgttactcagatacttactgaggctcagagaggtttgctaacttgctcaaggttaaacagataataaatgtgagattcaggtctcaaatccagtgtatgcttaatcacttaaccaaggtttctcagacttagatgatatcttttttaatgaaaataatttctcgtagaaccccagggttggcttaaattatta

SEQ ID NO: 106133 - DNA, 1041 bp, Homo sapiens
acaacatcattttgactttcaggatcatcatcttgcctctggctgtgcaggacaagtaccatagtggagataatgttggaaaattaggctggattaagatttaggaggcatctggattcctggttgaaatatttgagtttgatttcatgggctagtgagtataaagccattgaaaaagacagagaccagaggttgggagaccactgaggcttgagtgcatgacatacatgctttagtacgagtgaaggtggagggaaaactgggcatgaaacagagctggggacatgagaagataatggaattgagtgaacccaaatcatagttgctgttaacctatgatcatctgagagcaaaatgaaagtctcctgaaggctagtattcacttctactgatggcttcacatttgcccagaagtagggaatgagtaatgtagagaattgctaatgagatatgaatcactatttcatgctgtggggtggggtcttctactcattgtcaataccatttattgagcccttgacgaccttgtattaaatgactttggtctgggtctggctccactgtgccagttaaaggtagcagagatgaagggtaaggtcagaaggtgctgcagtggtacattagattctgtccatggacttatttctgctaaacattctagaccttccttgaggggtagattggggttactttaactgtctgtgtctcctttttttcttctctttactttttaaatttgtaaaataaaggatttggtttacattcatagttttcaaatgtttttcagctgttaaaactttgtttcctaaataaaaatttatctggaccctcagtatatttatagaaagcagagctgttctggaaatttagggtccagatttatgttgtatgaagtgtctttatgttgaggccactgctctaaaatgacacctacacacccttcctggttcatgattatgtgaatcttatagctgttcagatgttttatttgtgcatcatctttaacaaatccctttgttattccacaggttgtgtcttaat

SEQ ID NO: 106134 - DNA, 1575 bp, Homo sapiens
ccggtggaacccaaagaaccaatcaatgctcgggagaggagggcagctcccacttgtcatggttagtttcctggttggctctttaaatcagtgattttacttaaccattggtttccacctggtatggggatacagctgtgagaggcagacaagcgggaagaaaactctttgaaaatggacttttagaagcaagtatatttgacctgtgtttccttgtcctccccatcccttacccaccacccccctgattattagttgtagtagttgcggatgccgaggccactggcttaaaaatgaaaatgaatctgtgtaaagaaggaattgggggagggggtgttagaattgcccacctatttctccagaattgcagtctttataagagacaacatgtaccgttgagctatccgggaaaagggtgtggcactttgtctcctatggtcactcttgtccttgtaaagtcacattgtttctcagtatacagtacttggggcttggctctactggatggatttataaggtatttttggagccggcaaacgttctttatggggagtcacatgaatagaagggattcttttagttctgacagttaactcaacttctggaagtgagggctgccttgttctcttttgcagaatgtcagttcggtggtggtggggtcaagccattttctttccggggagtagtagagtttgcctttttctcatgtaagccatcttgtctgtttgcttctgtgctttaataaaatacttttacagttttggcagggaggggtgtggaaggtgatggtgtcatggttttcaccagcaagactttcacgggtggatgaatcatgggtgaaggaccagatccatctcaactcactactagtgaaagcctgatttttcaacacccttctccctgaattcattagaaaaattactgattgatccaaagagctgtcactttatagaagttgtacctggatgtgaacataattctgtgaattaagcctttcataaacagactgtgagccagaatatactgattagaatggttttcatgtagaagccgggtttgtcaaagcagtattattactattactatcatcatcattgttattgcataggcaagcactttgttgagtactttatatgcattatcttttttaaaccttgtggagcccctgtgaggtaggtactattcttacgcccaaattatagatgagtaactagaaggaattcagtatcttgccacagtttagtatgaaagcaagaacctgagcccgggttcgtcttacccagagcccatgaccttggccgtggccttgacttcaaattttggttgtgtagtctgcatgtgtccagtctgaagtgtgggttctcccagcatacgtagagctaaccattttaagagtccactgtgattctgacagtccttttatcagcctgttttgcctttgcatttgaaggctgtggcatgggccaataggcaaatttagtaactctgtttattatatatttccagtagaaacataataaaatataaaaaatataacacataataaaataaaaattttggctcgataaaaatttg

SEQ ID NO: 106135 - DNA, 1048 bp, Homo sapiens
taagacatgtaagaactgtatagcactatgccaagtattataacagatgtaatttagtgttaattttaaaacatgtattttacctcctaggtcaatatagtctatatttaaacagtatttctaatcagccaaaggatgagaacattatgggattattcaaaaaaactgaaatggtttcatctgtcccagctgaaaataaatctgtcttaaatgaacatcaggagacatctaaacagtgtgagcaaaaaattgccatgtatgtaactcctatctgttgttattgtgtggtcatcttcagaatatggttttgcttttcctttacttgcatgtgaaatagttactctgaatacttagagctatttaaaagcttattacttaatatttatggagtcagttgtgtagaaatgtatgatacagtttctgttatcttttgtgttttaccttagagagaatgaatggaaaccagctgatatattcagtactctgggggaaagggaatgtgatagaagttcgttggaagcaaaaaaagcccagtggaggaaagagctaggtaggtaacttttatacctttattatagttttattggcttaaagaatatgtattgaagccgggcacggtggctcacacctgtaataccagcactttgggaagccgaggtgggtggatcaggagggcaagagatcaagaccatcctggccaacatggtgaaatcccatctctactaaaaatataaaaattagctgggcgtggtggtgcacgcctgtaatcccagctactcgggaggctgaggcaggagaattgcttgaacctgggaggcagaggttgcagtgagccaagatcgtgccactgcactccagctgggctaccgagcaagactccatctcaaataaataaataaaaaagaatatgtattgaggatgaagtttaggggccaagggaaaacgtcccctttgccctctggaggttttctgaaagatcaactgacaaaaggcaaattaataaaaggcatacaaatttattaacatgcatggaagttttacaaaatat

SEQ ID NO: 106136 - DNA, 1060 bp, Homo sapiens
caagactgtactgtttagagtccttatacatatagatcactagctttgaaaatttgagaaattcaaagaattaggaaatttctaaaaagttgtaagaagctatgcaacatcacataatgcattcaatgaaacaggttcacatgggcaaatgtggaataaatggaatattctggtcttgtcaagagtttcagaatacttctagttttaattgattaaagactttgattttattttttcttttatagccacaaaacctcataagttacctttgaatatataattttttcctctatttttctttgacggtcatcttctatttgcttattcaactcttcaatccattttctttgcagttcttgtttcacagcactgaaagggtgctccagcagtactgtttcctaaacaacagccataaaagccatctaaagttcagttctctttttctaatcacttaatatgtgcaaatcttgccaaagtaacatacagatttaatccactgaggcatttatctgtaagaggagcaataacttcaaacgaatttgaattcaaagaattaagtagatatattctgattctcagaatcatattttaaatatactagatcagagatatataataagatatctaagtgtaagggaagggaattttctaatgaaaaacagaaaattctttctccaaaacaattaaaagactttcaaaattcagctggatgcagcagctcatgactataatcccagcatgttgggaggctgacatgggcagatcacttgagcccaggagttcaaggccagcccctggccaacatggcaaaatctcatctctactgaaaaaaaaaaaaaaaattagccagctgtggtggtgcatgtctgtaatcccagctacttgagaggctgagacacaaatcacttgaacccgggaggtggaggttgtagtgagctgaaatcatgccactgcactccagcatgggcaacagagtgagaccctgtctcaaaaatattgtttttcaaaattctaagtctcttttagaggctgaaagagttattaatttaaaacagatgaa

SEQ ID NO: 106137 - DNA, 1033 bp, Homo sapiens
ccagaatattccatttattccacatttgcccatgtgaacctgtttcattgaatgcattatgtgatgttgcatagcttcttacaactttttagaaatttcctaattctttgaatttctcaaattttcaaagctagtgatctatatgtataaggactctaaacagtacagtcttgttaatttttatgatgcttattctgctctaaggtgacttttagaaatcatctttggttgtcatttagaattatatatgagaataattggaaaaattcttagcaattcttatttgtcatcattagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaagtaagttcatgcttatgtatttattgacttttcagaaagtctgtgtgctttagtaagactgttgttatgtctaattggtttcaggtttggtatttgtctttgaaatagaaataattagtagatttatcccaaacaaaaatgatttagcttgttgaatctacctttttgaggttttgaatagctaatgtatgtatcttgccagctttctccgttctatgactgctctcttggacccagctcagattgaggaacgagacagacgacgacaaaaacaattagagcatcaggtattgcattgttaaacattgttctttaccttaataagtaacagtcatggtgaacatatacctaagtaaatggaaatttaaattctgatgtaaactttacagcataggtcctgtccagttgtgtcacgaatccaatccctaccacaactggcattgtaatattagaattagcttatcaaatgctacagccacctgcctt

SEQ ID NO: 106138 - DNA, 1042 bp, Homo sapiens
tagggactgggctctcaaaatagtgccatgctacagttccttaggtcttgggtgtttgtggagcctagtgtgagctccctcttgagcagtgctttcatgtggtctccaggtaacgccctgttagtcttgagacccacaagagtcaaggggctgtttgatggttaggattgtaggagtccttgatgggcatgtggattgctggggattgctcactttccttttcctccaattaggcagcctctgtagactcctagctaatcctgtcaagacaggctgctttgctttcttccttgcttttgatgcttcctgtcatgttgaattccactgttctctgttagatctacgtgaagtatgattgtctactcattattttggttcccctctgtggaagaggtgagcactgaatgtatctagtcagccatcttgaattccctcctgcttagatttttatttttgacaatgatttacgtgattgcttatgactagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagtaggtacttacattctaattgtaactttggtttttgtttgtgtttttgagacagggtctcactcttttgcccaggttggagtgcagtggtgcaatcatagctcactgcagtcttgacctctgggcacaagttgtccttccaccttggtctcctcagtagcagggactacaggcacgtaccaacacatctggctaatttttttgttggtctgtggagacagggtctcactatgttcaagcgatcctcccacctcagcctcctaaagtgttggtattacaggtgtgagctaccatgcttggcctcctaattgtaacattttagaataaaaatggatatgtttttaaaggaaaaataaccagaagttgaacatttctattattttgaattgtgaag

SEQ ID NO: 106139 - DNA, 2366 bp, Homo sapiens
ttaagtagctgcggaattaatctgatgcatacttacctttccttgctgaatgaatgaatattcagaggctcttcttcctaaaatatggatagataaatgcagaaaggaatatatagcatcttcacatgtccccacaaatatttttagggctacttgttgaaatagtctgagggtaatatttgaataacaggtactgactgagcaatggaatagatatagttttttccagagtcaaaactaatccttgggagttcctaatctcccaaacctctgtctatgtggactataaacaagggttttaaaggggtatttgaatacacagcatccatctacagaagttgtgtaagtgtaaaggactcgataagcataaggaaaccttttcagctttgtgggccatattgtttctgttgctagtctggtgtgtgaagtcagccacagacaattcataaaagaatgagttgactatgttcgtataaaactttccaaaaacaggcagcagcctggatttgcccatgggatatagtttgctgatccctaatgtaaactgaaacagatcagaacagccttaccaaagcatacgtatgagaaactgtgttttgaatccagaaacgtcaacacatcatctaagatggaagagctttacctttttgactagatgccacctcaactttgactccgtttcttgatgagatgaatgaaaaatttctggtgaaatgcctctgttttgagagaggtgcccaggattatttttttctaccaaatgaagcaattccatctgcctccttacttttttttcttctctctgcttttgaagctgtttagggtacttttctgatgctggaatataccttttaggtggcttatttatattccaatcaggccttttaggatatttcttcatgtgttttgtttgtttctctattcttgtgaactgattacactggtcattacaccgattgttttctttttctaagctggctcctttatcctgagttagttcttgcttgtttttcttggtgctaaactgtccaataagttctgccgaaatctcaggagatgaacaatttgtgatgtccctctccattaatgatccacaatgtgattctgcattggtgaatattcctatatttaagtcatctaaaaaaaagttgcaaatgatttttaaaaattgtaaacaaaattttcaatattaaataattttccccaaaacattaaacaattattgccctctaagacttttttctttcattaattttcaacaaaaccgaacctctatactcattaaagaacaaccacatactcccaaccactggcagccaccactctaatttccatttctatgaactgataatcatgaaaagatgctcaacatcatcagtcactgggggggaaatgcaaaccaaaaccacctgagataccacttcacaaccagtagaataacaagggctggcaaggatatagagaatcagaacccacatgcactgatggtgggaatgtaaaatggtaccactgctttggagaagagtttggtggttcctcaaaatgctaaacatacagtacctgttactcatgactcagcaattctactcttctctcgaactaaaaatgtacatccacaaaaatctatatatgaatgttcacagcagcatattcatagccaaaaagtggagataacccaaatgttcatcaactcatgaataaaaatgtggtattataaatgtaatatttattcagtgacaaacaggaatgaagtactgacacatgctacaacatggatgaaccttaaaacatgctaagagagaaagaagccagagaagaccgttatgtggtctaattccagttacgtgaaatgtccacaacaggcaaaaatattcagagacagaatgttaactggaggagaaaagagaaatagaaagtggcaagtaatgggtacagtgtttctagagtgatcaaaatgttttagaattgattgtggtaatggttgcaccactgaataccaaaaaagactaaactgtaggataaattttgtggtacatgacatgtttcaacaaagctgttatccctttattttgtaactcttactgaaaacctcaagttttgttaatttttgaacttttaaattgaacttaattctaactgctttaattatgactttaagtaaattttaaaccaaaccacaatttccacacaaatacctgtttgcacaccagtatccttcttagaagtcgtagaattcatatatgtattcattttaccactgatttcatcagaatcatgtcttgaatttgaaatgttagatgcattatattccatttgtattgtatcaactggcaaagagaaatcacctgataaaacaacacttaagg

SEQ ID NO: 106140 - DNA, 1009 bp, Homo sapiens
catgattctgatgaaatcagtggtaaaatgaatacatatatgaattctacgacttctaagaaggatactggtgtgcaaacaggtatttgtgtggaaattgtggtttggtttaaaatttacttaaagtcataattaaagcagttagaattaagttcaatttaaaagttcaaaaattaacaaaacttgaggttttcagtaagagttacaaaataaagggataacagctttgttgaaacatgtcatgtaccacaaaatttatcctacagtttagtcttttttggtattcagtggtgcaaccattaccacaatcaattctaaaacattttgatcactctagaaacactgtacccattacttgccactttctatttctcttttctcctccagttaacattctgtctctgaatatttttgcctgttgtggacatttcacgtaactggaattagaccacataacggtcttctctggcttctttctctcttagcatgttttaaggttcatccatgttgtagcatgtgtcagtacttcattcctgtttgtcactgaataaatattacatttataataccacatttttattcatgagttgatgaacatttgggttatctccactttttggctatgaatatgctgctgtgaacattcatatatagatttttgtggatgtacatttttagttcgagagaagagtagaattgctgagtcatgagtaacaggtactgtatgtttagcattttgaggaaccaccaaactcttctccaaagcagtggtaccattttacattcccaccatcagtgcatgtgggttctgattctctatatccttgccagcccttgttattctactggttgtgaagtggtatctcaggtggttttggtttgcatttcccccccagtgactgatgatgttgagcatcttttcatgattatcagttcatagaaatggaaattagagtggtggctgccagtggttgggagtatgtggttgttctttaatgagtatagaggt

SEQ ID NO: 106141 - DNA, 1686 bp, Homo sapiens
aaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgtcaatgttctaacaaacactgccaacacgtcaattttttaaaaagcgtgggccacattgctaagaatttgttaaagcataactgtattttttgttttagggccttattgatgttttgccgttccaatgtatgcatttttttactcaataaacttgtcttaattttagaactgtctgatgatttcgtactggaaagaactactcaaagacggcagtgtaaaagcaagtcttaggaaagtcccattttatttgtgtctaacaaacatacaggaactgaaatatttttgttaaatcctgggatgcaccgaagtaacttaaaacaaaccgttcaacaggttcccccaaccgcccacgccacataaagaacagacatatctacacttgaaaaagctcatacctgtctcagttctgaaagtcccttaaggattgcttgctgtcgatccctatttttcaccatgttaggattaagaagtggatccctgacacagtcagaatcaaatagctgtcgtttttggccacagtctaaagccagatgaaagtaacaagtcagtcaattacattagtaaaatgacatagccctgtgctatataatattgtcaggagtcattataataagtatgtatcctaggaaagtactaagaaaaatttaagacatattcaagaaactttatagaactaagtgcaggaattactaatttggaatttaaagttgttgacggggtttacatgggtcttcaatttttacagttagaatgcttaatatttacttaccttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgtttttcactactggaactggtgatgatggagacctatttaaaaaaaaaatagtaaaaaattgtgtatttagattaagtatatctctttaatcacatttcactttatttatgagatgaagtctcgctctgttgcccaggctggagtgcagtggcgcgatctcagctcactgcaactctcctgcttcagcctcccaagtagctgggattacaggcgcacgccacagtgcccagctagtttctgtatttttagtagagacggggttcaccaagttggccaggctggtcttgaactcctgacctcaggtggatccacctgcctcggcctcccaaagtgctgggatt

SEQ ID NO: 106142 - DNA, 4164 bp, Homo sapiens
ttacaggcatgagccacctcatccggctaattgtgaattttgagtagagatggggtttcaccatgttggccaggctggtctcgaactcctgatctcaggtgatccaactgctttggcctcccaaagttttgggattacaggtgtgagccaccaggcctggtccatatattgtgttttttgaaggaaggatttatactgtttttgtccctttaagtccttcattaaagttcaaaattaataaaggtaatcataatttattatttagtaagtagaataatcagctgagattttagcctaagctgtatagctggccctgaggcctcgcgaccaagaaacccctggacttatcccttctttctttctttccaaagaagcacaccccctacatcaggcagagagctaaagcagtgcagttgtcattagttgcctcagtggagaaattgaattttaatctaaagcagaaatttccatactaaattttagaagtacagatccagaaactgaactgcttaatttcacagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacaggtaaagagagcactcctaagctttctactatgaatataggaatgtgaatgaaaggattttatggggctgtggtgggtattgctaagctttgattctgaaaatgtgaaggaaaagattttgtgagggctaggggctgtctatattttgaagtgtttcatacatgaaactttttttcttaatttagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcaggtaacttttcagtggttttcattttctttaacgcagacagaaaaagaggaatggttttgctgttaccaaataatgaaatgaccattttgaaaccacgtacctcagtataaacagccatagggaaagtgtttcaagacatttatcattctaatacttagcatgcacaagatctgctcatttattatactgtagccagtgtaagttgtaagttattatagattatgcatttctacctatattgtagacagtgcatactatggagtatgcattttgtctttgaggtttttgtaagcattattggttactattgtcagcaaaggggttatattaataaaaaggtaggaaaccagatatggcgatttagcattgagctactagatttccccacatgcataaagcaatttaattgcaagatagtagagctgtcatagctttaatcttttgtgagatggcctctgctttggttccaggttctgtgtaaaatgaaagatgtacttttgtttttgatgaaaaaaagcagaaatgatcattcatttagtgctaaccaactagtttagtaatccagtgaagctagatgtcaaaaaattttattttatatttgtcttgtcaaatactgaattaccgtataactttagatgctgttttgacattaacccctttggagctgggagttgggatttcccaacattaaacgtgaacacatttcgcagaagcttttagcatcggattatctggacattcacatctagtgtgagtgttgtgactaagtgaacttgtggcagaagaccaagctttaagggattgtggacttgcagaccctgacgcgttatattgtgtgagtagtgtataattttaaaacttaaacaaactgtgtatttcaatagaggaggactttttgttttttaaatgtagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatata

SEQ ID NO: 106143 - DNA, 3230 bp, Homo sapiens
gcatgtcagatggtaatttaccttttcattaactgactaagctggtctgagatctgcccaaaagttccagagattggatcaaaatcagtgtagaaggtgctgctttagcacaacagcatcctctttggggtaacacttcaggttgaaagagcagcagactggttgtcaggtaagctgggtttttattatagctgtctgaccagctgtgctgacattaaaagtaatctctgaaatgaggaatatgacctccaggatcctgcagtttgcttcagtgttcaggattccaccagcaagcagagagcaaagggaactctgcatgaaagtctgcctgtgtcctgtgaaaggcagtaccatgttcaccagcatggaggaagagttactagttgggaaagtctactttgaagacagaaacttgacagaaatggctaatttgtatgtgaataccattgtacataatgaagctctatataaatgcttttttagctgttgtgaattagagctatggttgtgaaagttcttaactctgaaggcgtttatcccagttaatactgctgcaaataaccaagggcctacttagaatggaaaggaaaaggtgagctagggagtggttaatgattagactctaggttgccttaaagtgtttctcataggatattatagtcaacctagagtctaatcattaacctctataataactaaaggagctgggttaagaacctggcctaattaacagttctttctgttaactcacactgttacttggctggctttgcatagtgctgtaacattgtgactgtgtgattggtgaagctctgtaacattgtgactatgtgattggtgaagctctgacctttagattcctcttctagaaaagaaaagtggatttgggccatgtgcagtggctcacgcctgtaatcccagcactttgggcggccaaggcaggaggatcactcgagcccaggaatttaagaccagcttgggcaacacagcaagactctgtctcttacaaaaaaaaaaaaaaaaaaaaaaattagcctggtatggtggtgcgagcctagtgccatccatgtattcaggaggctgaggtgggagggtggcttgagcctgggaggtcaaggctgcagtgagctgtgatcatgctgctatactccagcctgggcaatggtgagaccctgtctcaaagaaaaaaaaaaaggatttgatggtctcttagagtgtaagttcattcattgttaataatgtcatggtagtagttaagcttatcagtttatcttgcatttctggtgttaaattgatgtttacaaagaagtattttaatattgatttagttgtttttctttaacaggaatatcttatcaaattaggcaatacagaatgtcatcctgaacagtttttggaaagaagatcaaaattagataaactattgattattattcaaaatgaagacattgcaggtttcattcacaaggtagactattaagtcaaattcactactttggttttaaaaactcccttattttaaaatcttactgtctgccagactagtgtttttaaaataagctttaaaggagattaaacttaaggacccatctgtgaatcagcttgtgagattcaagtttgtacctatgcaaaattttaaattgctgcacatcacagatcttccctgtcactcaggtagtcaagactaataagagtactgaatccttgaatgccattgggtctgctgactgactacataatgttttcatcttcatttgtatgtcctaggaaaaacctatttgtgctccatctttgccagaccagtccccttttcccttaaattttgaggtatcccatctagtcttaggagccctatctccatcctacatcttggacgtctttcctgattgactgttcgagcacataggcttttgccttcgtctgaattctgactgtactcacaggttatagagaggtcagcttttgtccattttgtgttttcaggtctattgtaagctccttttccttagtcgtctgtggtaggtcccagtacataaatgttggtttatatattgggaaataatgttgggaatattatttgtgtggctttccagaggtaatccactaatatagatgagccataatgcattctgttagacttcttgtaggttccttcacacttgagtctgtcaattcattccctccatctgtttctctttttgttttgggatttaaacagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttggtaagatgatgttcttttgagcacgtaactcctcttctgactctcatactttttaatgtactgtccatttattctgccattcacagataactagtacatttcagtcttttcttgagcttttattacctcaaatttctttctccttctcttagaccaataatatcctctaaatgtggtgtaaagcaaggctgtctgcccctgctgcagttgaatcacttcttgtattactgtcatcaacatgttcttttttatgtgtagatgttatattattagagctttaggcatgtatagatctgtctcccttagacaaagagaaatgaaaatagtacataggaaagtaggtgtttctacataatatgaaaaaacacttctttcataattcacttatggaatgattatttattgaattaaaaacaaacttcattatctctaacagagaaccttaaaaattttttgacattccttgaggaacttagtactccagaaggaaaatggcaatggaaagtccactgtaaatttcagaagaaactaaaggaactaggcaggtaagctttgaaacataactatataatggttgttgattttaacattgtactcataatatttctctcttcccatgtttgtagattatggatgttcatttttcacagatgtccatagccagccataattgagtatagatactgaattattctagcctttataagaagcagtatttttcagtagaagtttgctgaagttgttatgtgcataggtaaaattggtttaatctttgccatttgtggatttagagtaatcatccaaatggaatgatcagcatttttttctttttttttttgagatagagttttg

SEQ ID NO: 106144 - DNA, 1297 bp, Homo sapiens
aaccccgtctgtactaaagtacaaaaaattagccgggcatgggggcaggcgcctgtagtcccagctactcaggaggctgaggcaggagaatggggtgaatccgggaggcggagcttgcagtgagccgagatcacgccagtgcactccagcctgggcgacagagcaagactccatctcaaaaaaaaaaaaaaaaacaaaaaaacacagacacacacacacacgcctttctgtgtgtctgtatgtttagacatagatacgtaagtttgttaccagtaggtaggtaaatggtaacacattggagcaattacattagtggtataatagtaaaattaatcataaattatgggattttaattcctcaagggaatgcctaggattttgaaataaatgcctgctctcatttatggagtttacttaccatgactggaatttcattagaggaagcagagggaccatgggctttatagctactaacatgtcctaagccttctgtaagtttggggatctctgaggtcagcatgttttgtgtgatgttacctggtcaagacctgaagaacatagaaattacatgagtcagagtactgtgttgggctttccttactgattgctaatggtttcttgggaaaatgaaataagacttctaggaattccttggttgcatttttgccctacatgactgaatgtagagtttctcaacttttccccaccagccagcaacaagttccctagcacagtactctttgggggcatagctagctgcatattggtttggggttagatgagagaataggttgggcacagttcccggtgtgcttagcataactccaacttcctccatccccgcaccccccaccccccacccccccgctcctttttttaaaaggatttgtaacacatacctatttgacattttaaaaaatttatttatttattgagacggagttttgctcttgttgcccagggtggagtgtaatggcactatcttggctcactgcaacctccgccttctggggtcaagcaattctcctgcctcatcctcccaaatagctgggattgcaggcacccgccaccactcccagctaattttttgtatttttagtagagacagggtttcaccatgttggccaggctggtctcgaactcctgaccttaggtgatgtgcccgccttggcctcccaaagtactgggattacaggcgtgagccatcgcacccagccgttacatttagattaaggggataggagatgcatttcctaattaattgtgcttttaatttatctggcatagaataagtcat

SEQ ID NO: 106145 - DNA, 3254 bp, Homo sapiens
ttaaaaatattccctttatttataacccttgaggagtaaacttactggttgttgtttagctatacattttgggagccactgttgcatttaaagtaataaatagctgggtgtggtggtatgtacctgtaatcccatctacttggaagactgaggcaggaggaattgaggccagaaattcagggccagtctgggaaacatagtgaggccccatgtctaataaataattcagaattttttaaattaaggtagttcttcgcaacccatatgttttatgagatgcaattcaattttttttctttgaatatatcagatatttgacatgatacgtaattcaagaagtccaaaaatacttaagaaagtaatactgccccagcccggaacacttagattcttccccatatattagccatggttaccaatttctcgtgtatccttccagacactttatgtgtactaaagcacattttaatgttggagatttaagatactcaggatatttagtactcctaattatcttatgaaacttggattttctggtttatcaatttcatacagttctaattcttatcctggcacgttggatattttgttcccctctcacctccgcctacagacccgccttgggtcttttcactgtgctgacaaattgcctttgcaatagttaatgagtgtactggttcatgataaccaccaggattggtagagaatgtcataagctcgactcctagtgaggctatttaaacctttagaaaagtgtgatgagtgtgagcaaaatcttcactgtaagtttgaaaactacctgtacctggactttctgatttagaggcaccatttcctatactacagcagcaatttgttagggaatgttggccaaggcttaaagaaaaacagtaattttttagcgggtaaaattgtgtatacgtcttctaagcaaagatcatgagtttttgtcctttcctaaaatataacactaaaattgaagttaaatatatttttccccttgttgcttaaaaatggaattagagttccctttttcaaatgtagtttcaaaaacatactgtgtttgaatttaggatttttttggggaaagtatgatcttttggattgagctgtttgtcaagagtgaaaggttttaatctcattagtatcagctaaccttagtatcagctaacatctgtatctcaaatgaggtatagctatcttttcttttagaattatttccaaacaaaaggaaaatatttatgaaaggactgtcaaaaatgtgcagctgtgaaatatgttcttctcttgtcttattattgttccttttatttcctgataaaatgaagtccctgacattacaggaaatctacttagcaacctcgtaagtgagaacaagtctgaaagcagataaaattaattatcctagatcctagatgcaacttttaacttggcagttattcccacagcatttctgtttggtattcttacaattgccttacactcagaattcttactaaggggccattaccatagtagatattacttggcaaataataaatacagggattgagcaagctgatgtaattgactgtcttgatttaaaatgtgtattaaacttagatctacagaatggtagggaggcagaaacaagcaaatgacttaatttgtattgatgccaaattggtgcttgcttgagcgcttcaaaatagcagagttgttaacactagctacaactctaaggaccatcccataagtagggcacatagggaatagaattcataccagaattttaggattttattttaccttctaatatataattagttctaaatgtgtgttaacccttttttcccccaatttaagggtttgtgttttcatatcttatctttttggattgctcttataataatgaactcttcctgtataggtatgaaatcaccagaagaacaactggtgtgtgtgccaccacaggaggcctttcctaacgacccccgggtaataaatagacagagaagttctgattaccagtttccatcctctccatttacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtacagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggtaactaaaccagaaggtaatagtaatgctgtacaaacttctcttgttggtgtgacctctataaaatggaagttttttgtatttaaatgttttgtgtttaaatgttaggccaggaatggtggctaatacctgtaatcccaaaacttgggaggctgaggcaggaggattgcttgaggccaggagttcatgacaagcctgggcaacataacaagacattgtctcttaaattaataacaaaaattaggtgtggtggcactctactgtagtcccagctgcttgggaagctcaagtgggaggatcacttgagcccaggcattcaagattacagttagctatgattgtgccagcctaggtaatagagtcagaccctgtctctaaaaataaatgttaattgtgtattttcataatttaactcagggtgg

SEQ ID NO: 106146 - DNA, 1525 bp, Homo sapiens
tatttgtaagaaatgtgaaatgactacatctttgtagttatttatttcctttgggagttcccctcccccgctaattaaagttactagtttccttgaagaaaatcttcaccatctccttctaggaaaatgtggttaaaaaaaaaaagaaaccatgaacaacagatatataacatagaggaaagttcacaaatctttttttttttcccctctgatacagaatctctctctgtcacccaggctggagtgcaatggcatgatcttggttcactgcaacctctgcctcctgggttaagcgattctcctgcctcagcctcccaagtagctgggattacaggcatgtgccaccgcacccggctgatttttgtagttttagtagagacagggtttcaccttgtcggccaggctagtctcgaactcctgacctcaagtgagccactgaacctggccacagatctttattgtacagctttttgaaattttacatatgtacatgaccatcacccaaatcaagatgtagaacgtttctagcatcccagaagattttcttccacattctcctagttagtactctccttgttcccaagtaagtgctaatctgattagttttgcctgttgttgaacttaggataaatagagcctactcatgtcgtctctcgtgtttggtactttcatgcaatatcgtgtcagggagtccatgttttgcatctatcagtaattcttttctgatttcggggttttaccatgttggccaggatggtctcaatctcttgacctcgtgatctgcccaccttggcctcccaaagtgttgggattacaggtgtgagccactgtgcccggctagtagttatctttcttatgcttcagaatgttccatcagcacctgcattcctcttatttggaaataccatctttatattttgtaagctaaagtgtagacatctgaatgatggtgcctttagagaactgactactcccctttcacttaaaagttaaaatactgcaattatttaatggcaataagtttttttttaaaaaagcacggtgtctcatgtttgtaatcccagcactttgggaggccaaggtgtgcggatcaggaggtcaagacatcgagaccatcctggccaacatggtaaaaccctgtctactaaaaataaaaaaattagctgagcatggtggcttgagcctgtagtcgcagctactcgggaggctgaggcaggagaattgtttgaacctgggaggtggaggttgcagtgagccgagatctcaccactgcactccagcctggtggcagagcgagtctctgtctcaacaacaacaacaacaacaccaccaccaccaccaacaacaaaagctttattatggattgacatgtatgtgtgttttcaatcacttatagatgaagatattttcaaaataattaagttttgttttttttttctatttttttttgcaacagaatcttgctctgttgcccaggcaggctggagtgcagtggtgcaatcttggctcactgcagcctctgctt

SEQ ID NO: 106147 - DNA, 4264 bp, Homo sapiens
ccttaaggacaaaatataataggtatggaaaagatagaaatcaaattgtcatttttttagtagcctagtgtaatacacatataatcctaacaattggcaaaatagtaattacaaatgtttcatctcttgtcaagcacctggttgactttgagattttgatggtagttattaatacacatatttaaaacctaatgcatgagcttattttcctattgatagaatgcttaaattacaatggaaattaaactttaatagcaattttgaactatgtgcaaaattttacaattctttttgtaaagtgatgcgaatatttgtaaagtctaagcaaattggttgagttcctgaccataaatgctttatgataattttttaggtatatttgattttaaaagttttatgcttgcttttaaacttaacttcaaccaatgacttcctttttctcagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagtaagcatatagctgttggttacctttgtgtttgtgagtgtgtgtgtgaaagaggtgctgtgagtatgcttcagggaatgatttttttctttgaaaaagaaataaaatgcacttttgagtaaaggtgcctgtctaggatggtacttcctaagttattccttgttacaaagagataaatgctgaagtagttttccttccttcttagaagcttaatatattgtctacagtttacttgtgataaagcttaggcggaacaatctattaatatttgtcagaaatggcttattgggagttaattccttattgtttcataatgaagttgaattattaaagcattggctttctgtcggcagtaacagagaacccaaaggtgaggcagatgaggatgccagtctcagtacagcagtgtgacagttaggtacttggtatttcttacgcaaataggaatggaacataagcagcctttaggattacccctgaagtgactctcagccttgcttattagagtgtccagtatatttatgatatatgttcagagtgctggtttgtagctgagaagtagccttatctgccttaagcagtcactgcatcactggggaatagttctaggattgcaccgtattcctatgggcttatttcttcatttactgtctccattttctcttccctgcctttgtttaaaagttgtatgcatgtccccattctttctcgatgtcgttttgggatatttatttcaaggggaagatgatggcaggagggttattggggtatgtaaggtaggcactgaggaactaacctgtattaatattttctgatatcttttgtattttaaatcaagttgatggggggcgggggcatgggttgaacctagcacactacccatttttataactaaagttttattggagtacagctgtgtccatttgtttaggtattgcctgtgatagactagagagtctggcctgcagagcctaaaatatttaatgtttggcacttcagcacaaacgtttaccaatccctgttctaaattaacataaaattatgtttcgagggaaaagatgttttaattttgaaactagagtataactttaccatgttgattttacgcatttgtaatgtttagattgaagcacgtgaattttcagtgaaaaaacagtttattcttgacattaaaatgaattggaaataaagctattcagtgtgtactttgatttttaggatccaaatttaattagcgtgaataattttgaagattgcagtttgtgtcccagtgttcccattgaacatggatttcgtagacaacagtctaagtcaaataatgttgaagagactgaaatacattggaaactgattccaattacaggtaagaaaagtatacttggacttgtgtttgcttcattttacttagagaccagtttcctgaatgtttccatcttctgtggatttcactcttgggtcactaggtgcttcatcttaattggtgctgacatcttcagtgtcttattttgagtaatacagtgttcatcactgagtgttgctgttcttggtcagcatcagcaagcacctgcaaaatcaccttaaaaacagggatttaagacacactgtctctatggagtttagcatgcagactgctgaatgaagactgttggcagaaactgagtttttgataaggtgaggtagctgcagagataaaatggtgctctttggacaaccaattaaatgctgtcttctcaaactttaaacttcaccgtaacaagctgtcatctaataagtgataatgttgaggttcatctattagaaatttgatttcttaatactggattatcttaaataaattggattatcttagagaatggcctgaatgatcaaatgtaaatgttattgaactgtgaggcaaaaagtttagcagatgttgaaatattatctttttttttttttggtagcattctaatttctctgtgcaaacacatacatacacacacataaatacatactcttaatattccaagttgttactcacttttctagctaaacatttttggaaatattttcagggtatacgtcttttccagtcctacacctctaaccttttaaaaacaatagcaacagcaaacaactttttgttacaaagtagactggcctgtgaactaaactagaacctgctgagacttccgaggactctgagaagaatttataaaacttgatgagttcccatgggctttagcaccatcttctacttaacatctttctggagggtaggaggcctgtaggtgatgatagagggaacctagtattgttttatgaggtggaaacatcagcttgagtaggagaaacaaaagaagtagttgatataagaaggttatcctaaccgtttctcatttagacaccttcatacttggtgttgggtcatttgaaggtacaatgtcttaagtgttgatattccatcatcaccagtatgacccttcagattattttaggcagaagaaggaatgcttgcattgttatcacttggggttgtctgaaaggtgcttagtgtaggtatcactaatgtctgaagagagtctaatggatgctttccctcaggagggaatgcaagaagcccagaagaccagctggggaaacatggtgagaaacaaacaccaggtgagaaggcttgctttgcttttcttcccagtgtgcccttcttcagagttgctacttgcatttctgatactccatcaatagggcattgacttaaatttttttaattacagaaaatttggacagtaccatatttatttatatgtaaatcattacttgagttgtatccactattcttactataaagagtgttcagataagtcaccgaatatttatataaattttcttcacccatagtagagtctatcttacaatatgatttgggaagaccagaatatattcctaagccatttgtgcagtatattttatgataaactcttctttttttgtttttggtttttttgagatggaagcttgctctgtcacccaggctggagtgcagtggcgtgaccttggctcactgcaacctctgcctcccgaggttcaagcaattcaccttcctcagcctcccaagtagctgggattacaggcgcatgccaccatgcccagcttatttttttatttttagtagagacgggatttcaccatgtttgccaggctggtctcaaactcctgacctcaggtgatccacctgcttcagcctcccaaagtgctgggattacaggcttgagcccccaaacctgggtttcttcttttttaaatttttaaaaaatagccaagaagggtaagccatttatattttaggtatactattcatagtcttttaacctagttcttctgattgtaaaactaatttctgcaggtagattaaataagattaagaaacttggatttca

SEQ ID NO: 106148 - DNA, 4043 bp, Homo sapiens
gatagagtctcactctgttgcccaggcagtggtgcgatcatggctcactacatacagccttgccctccctcctaggctcaagtgatcctcctgcctcagcctcttgagtagcttgggattacaggcgtgcgccagcacagctagctaagtttaaattttttttttttctttagaagcaggatctcactatattgtctaggttgttcttgaactcctggcctgaagcgatccaactacctcagcctcccaagctgctgggattagaggcatgagccactattcccggtctgtgagggttttgtatgattattttttagcttagttcaattttgcattcaaattttagtaactctaaagcatcatttgccaggataaatattaggcaattcaaaattaatgagaatttttggcactgatataagacaagatttgttaaccaccttttctaagaatgaactttaatactgtgtattaagctaaagttcccactaatggctttatttcactgttggattaaggatgagtttctcagttgtggctactcagcatctacatatctgttcatgtgaagttagttactactttataagaggaagagatgacatgcaggactgttttgcttggagcctcagatcttgttctgtctctgtttcttcttacatattgcttgccactatttgaatttcctgggggcagtaggaagtgagatcttcaatgagtgggtgatttttcctttaaaaatgtgttctgctttttcatttgttttagtttcttattggcctgttttaggatcctggactttacaagcatgctattcatatatttgctatattgtatatatgtactagggtacatactcgtctggttcaacattaatgtataaatgtttttatacttctttggcaatatttagatctgtatttgattagtttcttgattgctaacatggtttgcttttttgtttgtttgttttatttacagcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaaggtaaaatatcagattgctcttataacagccaaaaataaagtagttctgttctttcttgtagcagaggggcgtataaattaaagcctgagggtcaaattcagcctgtccactatttttgtaaagaaagttgtatttgaatacagccatgcccatttatttatgtgtatgtagctgctctcatgctgtcatggcagagttggcactgagactgtatggcccacaaagcctaaaatatttgctacctggcccagtacaggaaacactttacaattcctgccctggtacatcagatttctaaattgtttggtttaggttaacatgacataataatactaatcagaactcttgtccttttatattcctttattttttttgagacggagtcttgatgtctccccaaggctggagtgtagtggcatgatctcggctcactgcaagctccacctcctgggttcatgccattctcctgcctcagcctcccgagtagctgggactgcaggcgcctgccaccatgcccggctaattttttgtatttttagtagagacggggtttcaccatgtgagccaggatggtctcgatctcctgacctcgtgatccgcctgcctcggcctcccaaagtgctgggattacaggcgtgagccaccacgcctggccatattcctttatttttatagttgaagaagtataatatcagaatagtagtatcttttaggctgttgcataatgaaaaggaaccttctgaatttgaaaataaaatatgcatacacatactcttttctaccccaagaatccaggaatatctttgggtttttctttttttgttgttcttttttcctttgttttgttttagttgacagaaaaagatagacatgtaaggcgcttgttttaagtgtgtttgtttcaatattgcaagtcagctaaaacacttttatctagatttttaagatcttcacactactagttgataagcacagaatgagttcttttgcattcatagaaagttgacataacaatccacgttttgtgttactgttgctcctctgattatggcagaactgaatattcttatgctttttattaagcaacttgtctcttcagattcagtgtgtcttagtctaggttagtcagatcagtgtcttagtctaggttagtcagatcagtgtctttttacacttttgctcttagcaatctgtatttgtatcctcacttttcactttcctgctctttttatttatttatttatttttgagacaaaatctcactccgtcacccaggctgtagtgcagtggctcagtcttggctcactgcaacctctgcctacctggttcaaaagattctcgtgcctgagtctccccagtagctggaattacaggcacgtactactgtgcctggctaatttttgtatctttagtggagacggggttttgccatgttggccaggctggtcttgaactcctgacctcaagtgatctgtctgcctcggcctcccaaagtgctgggattacagtcgtcagccaccatgctcagcctgctctccttttacttcttttattgttatggtattcaatgtggtagccactagccatatgtttttatttaagtttgaattaaaatgaaattaaaatacatttcaacaaccacaccattgtattagtacagagagagaacatttccattattgcagaaagttctatttgacattacttttctttgcagtaactataatgattttttctttagttaacctgtgtgtctctttctctttgcaatgttgttactctttgtctgtgttctttatctctttggtggccttcctgacttactaccttcttgcacccgtttcagtatcatgttcttctcagtattgctttgctaatttgctaccaatctcatcttatatacttgctttttaaggctttgttatagactagccatgtccagccatgtttcccactgttctctcacatgtcttggttaagggtcatctctctctgcctagagtatgtcatggtcagtcttttatttccctcttttttttcctgaagtagcttccatttctttcaagccttatatctttgcagttcatattctcctcagctttctgtctattctccttaatggtctcctctagtttatgctggatttgcaatctgtgctgaacctgttagcacttactgacacatactgtcttatcttgtgacatgtcttgagagctctgtttactatgtgctaggtactttatgtatatgaactcatttattaatagttcttgagtgataggcattattatcctaattttgcagatgagaaaatcatctcagataagttaaataactttaccaaaagttatgaagttagt

SEQ ID NO: 106149 - DNA, 2216 bp, Homo sapiens
agccaccgtgcccagcccccatggaatatctttattatactttgtgattaagaatgtgattatcaggccgggcgttggtggctcacgcctgtaatcccagcactttaggaggccaaggcaggcagatcataagatcaggagatcgggaccatcctgaccaacatggagaaaccctgtctctactaaaaatataaaattagcttggtgtggtgtaatctcagctactggggaggctgaggcaggagaatcgcttgaacccaggaggaagaggttgtggtgagccaagatcgtaccattgcgctccagcctgagtgacaaaagcgagactccatctcaaaaaaaaaagaaaaaagaaaatccaagaacaataaactcagtgaggttgaggagataaaggaacactagagtagttgggggaaagtagtagggacctgtgtcatacagcgtcattcaggcagtgttcaagtgtttggaaatttggatttgatcctaagagcagcagattttgaaggattttcaagggtgtgcattgaaactttgaaagtgtatgcaacataagatctgtgttttgaataattacgttagttactcgagaataaattgaggggagatgaggtagaaactattacattagagggtgatggcgggtgggatgacaaggtaatgatacaagaagagacagatttatgggatatttctgaggtaaggtccaatttaatactgaagcatatctagtttgggtagagggattgggtcaaacatcagattgtggtgggttgagaagtgaatggaaaatgaatgtgatgccagtatatgtggtttagctgaaggcgaggaggtggttggagagaagggaagtggctgttccaaggtttctttttgtcttgctaaatggtggtcgtaagttccaagaaagagggatacaacttttttgcataggtgcgccatttaatacaagttttacaacagttgactttttacttctcactttgttgagcctcagtttccaggtagtcgaatggcagtcaaatatctttgagtttcagaacgtgcaacttcatgtttaatggctacatagaatttaattattttcatatatatgtgcttaatcagtctgttgtttatagatgggatagtcagattgacataaaacttccaggcagagttataaaacccttgcgagtctttgacttacaggctagaaacctttcaattaaatgtcctagaattaaaacacacacgcgtgcacacacacacacacacacacacacacacacacagtctctctctcactctctgtctctctctcttttttttttgagacagactctctcgcccaggctggagcgcagtggcacagtctcagctcactgcaacctccgggttcaaccttccgggttcaagcgattctcctgcctcagcttctcgagtagctgggattagaggcatgtgccacgacacccagctaatttttgtatttttagtagagacggggttttatcatgttgcccaggctggtctcaaactcctgacctcaagtgatccacccgcctcggcctcccaaagtgttgggtgagccaccgcgcctggcccttccttcttactttctcactgcatatgaacataattttatgtttgtattacatggcttgttttcttctgaaagcctgactacaatgcaagcattcctcatcatcaaaatctattcagttcccaagttcagaaagtgaaagttgagatagtaggtttggatatggagagatactgagttacacaaatctatttggttcttgtgtttcagagagtgagtattgagaattcggacaatgaggggtttatcagaaaattacaatatctttcggttactgatatgaggatcaggataggaaagatggcatttcgttcctcacctgaccaagtattacattatgttaatggaagactggatcttttccagaatcaagaagtaaagtaaaatcctagatcttaaaggttgctagcattctacaaggatacactcccagaatctaatgtacctaggaattttgtgtagctatccgttttccagcaggcctcactgggattattccgtctatagctactttattcatagttttcttgataatgagcagtgcattgaggaatactgatttttaaattttgtccaagaaatgcacacaaggttttctgaatcagagacagattttgtgaatacc

SEQ ID NO: 106150 - DNA, 1073 bp, Homo sapiens
tagcgtggtggcacatgcctgtagtcccagctgccctggaggttgaggtgggagaatcacttgatcctaggaggttgaagctgcagtgagctgtgatcgcaccactgcactctagcctaggtgacagagtgagactgtcacaaacgaaacaaaagatctttagaataaggtgagatattcgtagatatgctcttctattttccatcaagtgtacttttttgtgtatgtgttaagattgctagagttgaaaatacagataaggcaaacatgtttttaaaattttctttcagacctgagaaattagatgttgaaacagttatgagtattgatcatctgaaacagaaaatccctccagcactgttttataaggaaacatacttaggtccaaatgaaggtaaggtaatttaattttattgaaatgcattagaagcagacttgatttggatatttactatgtatttttcttatgtcagttttgaagaatggaatgtattgcagcctttatgaagttgtggaaaagacaagaattggaagtaacatggagagtttactgcaaaaactagacagagaaaaacttgtgagtgaaaagttttttaatgtttctcattctttgttacaaatatgcatattcatgtgtgatcatattagtgtttcagtttatttttgcctctgaaagtaccatgaggtgtctgtctgttgctgctgtttagttaacagtgttttactgtggttctggtattcttttatttgggccatggtattggagcttgtgcaaaccagtctttcccatggaatatcttttttttttttttttttttgagacggagtcttgctgtctcaccaggatggagtacagtggcgtgatcttggctcactgtaatctccgccttcctgggttcaagcaattctcctgcctcagcctcctgagtagctgggattacatgtgcacaccaccacagccagctgatttttgtatttttagtagagacggggtttcaccgtgttgtccaggatggtctcaatctcctgacctcgtgatctgcccgcctcagcctcccaaagtgctggaatta

SEQ ID NO: 106151 - DNA, 1579 bp, Homo sapiens
tgtgaatagactgaaaggttttagcactttaatagaaaaagataaaaaataaaacaggtttcataactcagctttttaaaagtattaaattcaccagaggtgtaggacttagaattagagaagattgaaagtagcattgacattaaactattttaaagtttctttgtttttttttcttttctgagacagagtcttactctcgcccaggctggggtgcagtggcgtgatctcggctcactgcaacctctgcctcctgggttccagcgattctccagcctcagccttctcctgagtagctaggattacaggcgcccaccaccacacccggctaattttttgtatttttagtagagttggggtttcaccaagttggccaggctggtctcgaactcctaaccttaagtgatccacccgcctcggcctcccaaagtgctggggttacaggtgtgagccaccatgcccagcctattttaaagtttctttataatgaaaacacaatgagtagaagatacaggacactgtaggcattcatataatcaaccagatttcatacagtgtccctttggaggaaataagagatgaataattatcttgtctttgctccccaacttttctgataatgacatttagacagatacatttgttattctttgcaactggaatgattttgtaggggataaatacctgaaacaaaaatcctaatatttgaactgttagtaaatagaagtgtagaagagtcactgtttttttttttttgccctcctacttaaaccttgtttctagatattttccgtctcatttctaataaatgtgcactcacttctctgggctgccaagtgactaagctgtgtcattatattctttttatttagataaatataactataccttgtggaaaggacagcttttaaataaaggaaaacttttgtgttatatttctctgaggtcagccactcgtgcttttttgcctatcaaactgtaagtataagtaaagagcagttcgtggttgctaattttatcactttcttgagcctttttccttatttctttttcatatttaaattttattttggttcataagaacttcaatataaatgttggtttgttttttaaatggttgatttgaaattacgtgatttggcaatatgagtcctctacgtctctgtcttgatttgaggataggctagtcagtacatttacggtataaaactttatcttttttttttttttttgagacggagtttcgctcttgtcactcagtctagagtgcagtggtgcaatctcggctcgctgcaaccttcgcctcccgggttcaagcgattctcccatctcagcctcctgagtagctgggattacagggtcctgccaccatacccagctaatttttttttgtatttttagtagagacggggcttttgccatgtcagtcagtctggtctcgaactcctgacctcatatgatcctcccgccttggcctcacgaagtgttgggattacaggcgtgagctaccacgcccagcctaaaactttttcttagtgatttaagtctgaaatataattttttagttttattctaagta

SEQ ID NO: 106152 - DNA, 1038 bp, Homo sapiens
ctatctttgtcacctatgttcagattcttttccgtatctccctttgctactttgtttgcaattggagcccaggtgtgtttttcttttgaaatagcaaaaccatagtttggtttagttgagattgtgttcttagtattttgctttttgtattagattggctattctgagctgacctgggagcttaggctctgtttataatatttttattaggaaactcccggtggtcaactcttcagaagtaaacttttggaatagttagtaatactctgggatcttacgcacttagatgcagaatattttatatcacaaaatgaatacaaagtactaattattttagttaaattggcacgcagagcttaaagacattttttgtcagaagtgcatatatggttttctatttctcagaaatcaggcagttaaatataaggtttcaccttgcctttttaaagaagttaatttttcattttcttatttttagtattatttttatgagtatggctttgatgagctaaggcgaagaccaagacacgtttgtccatatgcagttgtgtcttttacttacaaagatgatatacaaactccgaagtttgtaccttcatcaaggtaagacttaggagttttagacatcatccgcagtgataattctactacagatcctgtactactgagttaggaggaccattttgtttccttcccatttttttttttttaacttcccttgaagttggttggagactgaagtgtttacaatgacttttaaatggtcggtgtgaagaacagacagtttaccatgtggaaataaatacaagctaaaatttaaacctcatctcgctaatctcttccttagaaatgaaggtttgtgtagttgagtaagtggcaggttttgtttgttttgagatggagtctctctctgtcccccaggctggagtgcattggcaggatctcggctcactgcaagctccgcctcccgggttcacgccattctgcctcagcctcccgagtagctgggactacaggcacataccaccatgcctggct

SEQ ID NO: 106153 - DNA, 3144 bp, Homo sapiens
atgtggtttcatggtatggtagcgattatttgttaatttcatatgaaaatttagtctgaagataaattagttattaaagagcagtaatagcctgaatataaaatgttagctattttatattttaaatgcatatctattttatagataggaaagccagtggtttaggataacttatagttccaactagttagaaaaagtcactcttccatcctataaatatgtatggagcacatcttatgtgcttggcattgagaatacagttacagagaaaagaagcatttttcttgtcctaattgagtttataatctagaagttggtcattcagcagatttattaaaccacctgttggatgcagtgtaccatgttaagtaaaatggaagatacaaagataattaaagcatgaatttataatctatgggagagttggaatgtggtaaaattataagataaatttaaagattggtgagcattagatgtttatttgactatattaatattatatataaagagccagttaaaataggggaaaaactgaaggacagagagtatagagagatagagattatttttccattttggtaggtgtgagatttcttggaaaaaaaaataaaacttgtagcttgaaaaacataatcacatgctaagtagttgttatagttttaatttcatttagtttacagaaaagcgaagagaactgaagtttgatggtcgtttagataaggaactttcagaatcctatgcatttctgatggttgatcgataccaggtgagttaacgcattttataaaaaacaatttggggatgtttccattgtaagttactaattttgtgattattcaacagtattctttacaattacagacttttttgatatataagtggaatacatgatttaatggggcaaaatgtttattgtttgtaatttgtttttcaaatgtactcagttttttctctgaccagtcctattttcttcccctagaatgtgcttgataataatacttttctgtttatttatttatttttttctgagatggagtcttgctctgtcacccaggctggagtgcagtggcgtgatcttggctcactgcgacctctgtctcctgagttcaagcgattctcctgcctcagcctcccaagtacatggggttacagaaacacccccccacacctggctaatttttgtatttttagtagagacggggtatcaccatgtgggccaggctggtcttgaactcctgacctcatgatccacccacctcggcctcccaaagtgctgggattacaggtgtgagccaccgcgcctggccttttttctttattaagaagactgtcttctatattgttgattatatgtgagattatcttctatattgttgattctatgtgcctggaaccatttttccttttttttttttttttttttttgagatggagtctcactctgttgctcaggctggagttaaatggtgtgatcgcggctcactcactgcaacctccttctcccagatacaagtgattcttgtgcctcagcctcccgagtagctgggattacaggacacgccaccgcacccggctaatttttttgcgtttttagtagagttggggtttccccatgttggccaggctggtcttgaactcctgacctcaagtgatctgcctgccttggcctcccaaagtgctggtattacaggcgtgagccaccatgcctggtctgttttttccccttttaatcgaagatatttaggtggaataatattttgctgtttctaattctctttgaaaagaattggttatatatattgagtggcaggagttaagagtatctgtcacacctggcatgaagaaaaatgattgaaaagtagccaggcatggtggtgagcacttgtagttctagttacttgggaggctgaggtgagaggatcacttgagcccaggagttcaaggtcatgccactgcactccagcctagagggcagagggagaccctatctctaaaaaaattaaaatgaagaaaaatggattctagatatggttactttgagaagtgtaagtcagttttacattaatatttataaagtggcaaatatataagatttctgtgatctagaatgatacatagttaagaagctttgtttttatttaaaccaagtttataaaattattttttcatgttttaaatgttgttatgactgcaagatgaagtatttttttttaaatttaggttcaaaccatatgtgaaaaaggattacatgtgggtcagtccaaaataacaattcttggcagtccttccatgggtaatcttttttctttttaaatataaatatctactactaagttgctgtctaaaaatacattgtctcgtaatttcactgcagttgttattaaattcatgctttattatgttcccagaaaaagactagtcataggttctgaaatgtaagatcagttttatcttttgtttctgatttttgaacacctcaaattgatgaaggataacttcttaaaaatgtcttattttagtcctagtgattttgaaaaatataatcagtttccttaatttttccgtcttttctaggtgtctatctttctaggtatgctgatttattacaagcgaatcctttggacacgggggcaatgggtgatgttgttatttttaaaataatgaaggtaatttaaacttacacacttcatgtatgaaaaactacacttgatttggattttaatttttagatgatgctgtttttaggagattgtttaaaagttcatgcttgttagtgtttggtacttaaagatacttttgaaaatggtttatttgccatctttttttgtgtgtgtgttgttttttgttttttggttttttgagatggagtctcgctctgttgcccaggctggatggagtgcagtggcgccatcttggctcactgcaagctccgcctcccgagttcatgccattctcctgcttcaacctcccaagtagctgggactacaagtgcccgccaccaagcccggctaattttttgtatttttagtagagacgggttttcaccgtgttagccaggatggtctcgatctcctgacttcgtgatccacccgcgtcagcctcccaaagtgctgggattacaggcatgagccactgcgcctggcc

SEQ ID NO: 106154 - DNA, 1035 bp, Homo sapiens
catggtataggtagtttgctgaaatacacagtctgagacatacttcagtgtaacataaaataggagctaagttgagtataaacacaggttcttttaagagtctttaagcaatttaggttgcctaatatagcatgcctaaggtttgcaaaattgcaccttccttgtctatgtatgtaatgccagatcctcattgttgaaggaactggtgtatgtaggcaactagttttacattttttttcaatgagttaataagtatctcttttgcgtatcacaaagtaagatagccttgatgccttttttcatggtatttaaagttacattaacccacaaaaatataaaaagctatatttaagatggagtaatgttaaacattttaaatgtttgtttttttattttagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggaggtatgttttaaattatacttactgtaagattgttttcagaaccagttaacagcctgggaaaaaaatgttctctagaaatactaaaatttttaggaaaaccaaattacaaagggaaaacaagtttttttttttttttttttttttttggagacggagtttcactgttgttgcccaggctggagtacagtggcgcgatctcggctcactacagcctctgcctccctggttcaagcagttctcctgcctcagcctccaaagtagctgggattacagtcatgtgccactgcacctgcctaattgggaaaacaagttttaaatgacatctcttttttccaccagatgttgctgtagcattacatttatctgctgtgttaaattgttactaatatgcaattatgtaaaataactttttaactgaaaatcttaagtgtagagatagcttactagctaatggttcaattgtaaattcagctgagcatggtggctcatgc

SEQ ID NO: 106155 - DNA, 1048 bp, Homo sapiens
catagtttctatgagtagttctctctacagtgaaaagtggttcctttttgatttggggaaatatatatatgtatagacttttaggtgtattagtaaattaaagtattttgtgcataagatggaaatttgaggttactagaccagtaattctcaagaactaattgcatagttgatttaaatgttttaaaaattaagtggggaccgggcacggtggctcatgcccgtaatcccagcactttgggaggccgaggcaggtggattacctgaggtcaggggttcgagaccagcctggccaacatggtgaaaccccatatctactaaaaatctaaaaattagctgggcgtggtagcaggcatctgtaatcccagctagttggaagactgaggcaggagaatcgcttgaacctgggaggcgcggaggttgcagtgaaccaaaatcgtgccactgcacttcagcctgggcaacaagagcgaaactccatctcaaaaaaaaaaaaaattcagtgggatgtagaatggttggggatgtggaggataaaaacttaaatgtcctggctgggcacggtggctcatgcctgaatctcagcactttgggaggccgaggcaggtggatcacgaggtcaggagatcgagaccatcctggctaacacagtgaaaccccgtctctactaaaaacacacacacacaaaaattagccgggtgtggtggtgggtgcctgtagtcccagctacttgggaggctgaggcaggagaatggtgtgtaccttggaggcggagcttgcagtgagccaagattgtgtcactgcactccagcctgggtgacagagcgagactccatctcaaaacaaacaatgtcctactatgcgtcagatgctatgcttagagctttttccacgtgttgtctagtgtggcatgtggcatatagtggttattagagtagctggagtttgccattttacatatgagagagctgagctatataagtaatttatttacctgcattttactccaagccagtaatgctaggtctggtatttgtgtccagctttg

SEQ ID NO: 106156 - DNA, 4411 bp, Homo sapiens
aggtcctcgcggggcgttgcggtcgccccttttggcgggctcgggcgccccgaaactccgccccccggcgcggtatttccgcactcgcgcaggcgggtgccgcgctcccattggtggagtggcccgcggtggccccgccccctcccggccccgacgcgcgcacgttgagtggcgggggaaggcagaagaactgcccgagggaggagcggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaaggtggtgcctccccttcttctcaaccccctctctctctcccctccatcttttcattagaatctttctatctcctcttcccacacccatccgagatacgtaaacacgcatgcagcgccggccgcctctcccctcaccgccacggccgcccagctgccgcgtttggtgcgagagaaagcggtggaaccacgctcccctgctgcccctccccgcggaagttggaagtagctcaggtttgaagcttgtccgtaaggctgcagctcccagagaggaaagatggtgctcggcgcccctccctcccagcccctgaaagcagagaagccgttgtgtcctcctaaggatgcttctgagaagtctcgctatggaaatagcccgtggccatggattctggggctttctccaaggccattgccaatgttctgaggaccatgagtgcttctccccgtggaaattcttcagttctgtgtgtctacttgaaatgtgcttgatgtcagcgtcctcccttatttagaaatctctattagtagatgtgatccatgcacactgctgttttccatcacacttcatttccatgtagatttttcccccttgtttttgaagcgttagattaaataggtttttctctctttaaattcgaacttagtattgtttttcttatatttgaaaagaatggaaaggtaggttcttggagcagtaatttcccaatggaaaaaaactaatgagaagttaccttattctcaagagtcaccaacttggtcttctagatggtagaacttcaggttaaaaaaaagtccagtcttagtttttggaacccatatggaaacagttacattaattacttgtacttttaaaaaatcttaatgccatattgttaatatggagtcagaattcctaatggaggtcaaaattagtatcgttttttgttattggggtattattttttaactatccagtaaattttggatattctgaatttagacaacttcctttttgccctactgtatggttaggttttcattatttactttggaaaaaaataggatttgtttttttcccgtatcttttccatccatctggtacagagtcttggctgtagcattatactgactttccataagcatcaccagttccatttgcactactggaattgtttgagccttttattggaaaaatacaaataaagttcatttgtttggatggcaaagccaagaaaatacttggtgtgagaaaccatgttgacaaagatgaagttaacctttggaaattagcatgaggaatgtttctagaaatatcttttgagttaatgtaattttagggttcagaaagatacttttaaaggtcaaaactcagttcttttcgtgtatttagttaaaatttgagatgtatgattatagtctgtatgagaaaagttcccagtgtaatcaattggtagagaataggtaggaagtacattcaaatgggctctggttatgaggtaggaggtggaactattttttttcttcacagcttgataaaagccgtttgaaatctatttttaaggtttaagtgcctaagaatatggacaaaccgtgatttttttttttttttttttactgtttgttaggaccagaagattggcctagaaactcttcaaaatttagtttgaaatgtgggaaggcagtaggaactggaaaggcactgtgtttgtgtgtttttttaaaattagataaaatccagagattgttgtaaaatagacttcagctgaacacactaaaagtggaaataattgagggattaggaaatataaatctagctgttgtcccccatagtcttgtacctcttgggtaaaacttgtattttccatttttacttacagacaaaagttgggaggaaaatatatcgcagtggactttgtcatgattagtgaaaatgagcaatttttaacttgtgtaattatttataccctgaacaccagctgttcaaatagtaaaatagcgatttaaatagaactttaaaaaattaaataagcagctattttaccaccatgaattttatcttgttcaagctgagagaagttagtggttgctgatagaatttaatacataaattcaactttattaaaaaaattcaaaaacagtgcaggttctgttgcattcatattttaatatggtagaccttttcttgtgactgtgcttttccagtgaaatttaagattaggacttaaatattttaataccttaaaggtcactgctatgcaaatacaacttgactcagaaagttctttttttggtcttcccagtagtgtgacatccaaaataactgccattgtaattgagtaataatattggcaaacacttgtatagtgcctaataagttgtgggcattgttctaagcaatttacatacattgactaaatctcaacaatgttttgtggtaggtactattcccattttacagatgaggagactaaagtactgagaagttaggtaacttgcttcaggtcacacagctaagttgtggagatggaatttgaaggtagttgtagagtacttttactactataaaaaagaaaaatcttgctacccagtttgaataatctaagggtttaagttagctgcttttgacctgacctgttagtaacaaaaactgttcccccccttcattaaatatagaaatatttagtatgttttcatccttggggaattttgacattcagaaattatgtttactatcaacatttggttggtactgacatactaagtgcgtctttgactggaaaggtatacattttactgtttttgatgtatgttatttattggctgaggcatgattcttacatttaaccaaattatagaatttaaccaaattgtagaattgcattttgttggtagatgtttcactattgccttctttaaatctagtgagtcataaaaagtaaattaaaattggtaattgcatttgatgtaatttttccctccaaagttcttgggaaatggagtagcgatgattcactttctggaaaacgtttattggttaatgtttttgtagggtccaagggagtctcaaaaattaattgcgctcatgcactaaatttccatactggtttagtccagaagtaatggctaattctcctaacctccatcttcccccacaaaattttcacttgcctttttgaagtcattggagccaagtctcattcttaaggaaatttccatggtatttcattagttgtatatggatgagtgggttctgagaacaatagctctctccatacataatagcaaagtaatcaaggtaaaatttactttgagctatcctcagtccaaaaaactttgtttcgtatttgtactcttgattcctgccagcatattcatttctaattgtacactatgttcaaccttgttgatgtagagatgaagtacccactcctaaagtattgtctgtggtaattttttttagaatgaagaaaagtgattttaaaaaaagatcttactgtgaagaacaaatggatggagagtggttgtattataatcattaataggcgtcagctgtgaattcagaaaatttcagatcctcagcctcttcttgctaattatttcgtcatcttctatgtattagttactttaaatcagacaattgtttatttgtacttcgtatgacccatttgtatgtcttttttttttttttttt

SEQ ID NO: 106157 - DNA, 1071 bp, Homo sapiens
tcaatggctcccacagaaggttctgacgaagtgcttttcattccaaattcttcctctcctgtgtttctataaacagtgtcatcgatagagtcatggtctctcttccttgttgcttcattcattctctaaaataatgagtaggcctaggcagatgaaacacaatgaatacagggccttcttgttatcctggcaggccttcctaagccctttgggttctattctgatgttttaggctagcaaccaactatgagagacacctcctggtgccatgtgcatttcagttaaagattcagagctggcagccgcttctgtcctggcccttttaaggtcagcctctattttatgtcctaatacattcttgcatcaaacttgcactggatgaagttgcaaagttcagacaatgcatcctcctttgcaaaattaagccttcagaatccccagggatgttttcaagctttctagttgagtaagatcaaaccaagttcacttcatgagttggtctttcctgattctctctctaataccatcccaatacacagatgagttcctcatgccctatttacaaggccgtctaaattccgtgcctttagctaccacatctaagagctgggaaagtggtacagaagcacaagaggaaggactcttcaaacaatctatgtaaaacagtagttttgagattctttttctatttttttaaaatccagcaggacaactgaaagtaacttgtttgagtacctctccatccatccagacacttgggaaatacaacacagggtaatagttgccacagattccagcttacacagacagattggcagttacagtactagggacaaaggtacagatacgagagactgggccaacatgtatactttcacaaaagtatgaaaaagtgcttctccaaaccgttccatctgtggaatgcaaatactgtacaggtaagatgcaggcctgcttcccgaagtgcacatgcttctgtcagacgttactttcaccgtgcctgctgtttccacaggaagagtctgtctgttccatgcgctcacagtcgaggctgacctcactcgtgtccat

SEQ ID NO: 106158 - DNA, 1019 bp, Homo sapiens
ggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaag

SEQ ID NO: 106159 - DNA, 1108 bp, Homo sapiens
cgccccccccccccccccgccccgcccacctcgcctggctagtttttgtattttttttttttttttttagatggagtctcacactgtcgcccagactggagtgcagtggcacgacctcagctcactgcaagctccacttcctgggttcatgtcattctcctgcctcaggctcccaagtagctgggactacaggtgcccgccaccacacccggctaattttttgtatttttagtagagacagggtttcactgtgttagccaggatggtctgtatctcctgacctggtgatccgcccgcctcagcctcccaaagtgctgggattacaggcgtgagtcactgcatccggcctagtttttgtatttttaatagagacggggtttcaccatgttggccagcctagtcttgaactcctaacctcaagtgatccgcccacttcagcctcccaaagtgctagaattacaggtgtgagccaccacatccggcctgattacttagaattatattgagtaatataaactaaagtcaagagagtgctaacttttttttcccttcatcaccttcttgattctatttccctttctcgtttttttcttataggagctggggcaggtatgtctgtacaagttgtgaattgcaatgtgaatagggcccccaaagttggcaaccctggctgtaggtgtctgtaggcagaagggctttctccattgagtccctagggaggtgcttctacaggaagggcagtggacatatctggaagtgcctccaacatgcccaactttggttctcctggaggtagatttgaacctaggagttcataatccagtgtgaacctggtacctggggacctctttatccacagaggtccacatatcaaccactcattacattattgcttaatgaaagcttgtggatttttttcttctagaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgag

SEQ ID NO: 106160 - DNA, 1110 bp, Homo sapiens
atattaaaaagaaatctttacagtaactcagaacaggctcccatgcttcaaaaaagtcatgactttgagtagctcatgctccctgttgtttttattcctgcagaccacacacttgctgggatgaaatatggaaaggaggcaactctatcgcactcttcccagtaataaaaacagacatgatgaagtgagatgggcctcaaccccagcgactgcgtcccccatctgtgctggactgggggcctgatctctgtgttgggcctgccagatacattgaatacctcatgaatcagaagagggtcctttattcttcttttctatcctacttggaggcacccagcccagttctgcaccagtgaggctggtgaccagacagctctccacaattacaaaggcaacagaaactcaaagtagtgggcaggctttctgcatcaaggtatagaatcataaagaagttgaagggcacaggatttggagtctacactgacagggtttgaacatcaactgcatcacttgctggctgtggacctgggcaagctatttaacccctctaagcctcatctggaaaatggtcctaataagaacagctatctcctaggctgttgtgacggttaaatgagatacataacctatgaggcaaattacataaagttgatttactagatactcaatgccagcaattattaccatgattgttgttactactacttattattaaacccctatctgggaggaaataggcagtttgctcagcaggttcaaggtttctgattttcaaattacctatgcatatcctccttctattattgtcccagattaaatcagaaaatgagccctttgaatggtctgctagcctctatccccactgccacctccttgatcaggttttcacacctggacagcatcctcccaacttgcatccctatcaccagtctcttcctcctcagtcccttgttctaccaagagtatgtgtccaaggttacagagcttgtaaatgatggagctgggatttgaatcctgaatcccagctacttagaaaccaaccaacaaacaaaaaaaaaacttcaattaattgcatgacaaaggaaaaaatctcttaaattgatatttaaa

SEQ ID NO: 106161 - DNA, 1072 bp, Homo sapiens
aaagttagtgggattctatttatagaaggaggagagtaggagtactggccaaatgtttgaataaataaaggccatccactattgttatctctggttcttttaaagaggggagatgtccactggaaaaaagtagagctcatcacgtatccaagaactgccttcatgcgtgagtttggcctgatatgtgcttgcactatagtccacttggtatccaggtcacacagaacagatactcccagcacatgttccaaagcagccccctgtccaattttccttagcacgtaggctcaagacaatgccccacttcccaaaggccttgtggcaatgtcctctttttctttcacatatatgatttatgttccgtcaacgacaggaaactgctcaaagatccacccagtcctgccgctgcccccgtgatggtttgtttttctcattgtttagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggtaggctcggggcccatggagctggctgtgtgtctggaacaaaggtgcattgcagcgtcagccatgctggaatttgcgccttagtctccaaatcaattcttcattgcgtttgcagaaggataaacaagagtgtctgaccttggggaaggaactgagaaaccagaaaccagctgggagggtgtggcccccactttaaaaagaaactgatgtgaaaatatgaatttacaagaagatgaaaccaagtgtctatttaggattctgaagttcacaaaaataatcattttagttatattttgttagcaacttatagactattttaaaatatttagtttacatagctttgattcagcttcatggaaaacttcctttctatagaatccagttaatttcattcccggtaagttttctgtatcagttgccctaaatgactctgataatattaccctgtatagaagagctt

SEQ ID NO: 106162 - DNA, 1032 bp, Homo sapiens
tgtgagaaaacatcctccgggcccatggctggccttcccataagggccacagagacttgatgctgctggcaactctcctaatttttaaggaggttgaactctttaaagttctccagctctgagcatctggccctttctgcctcagaaggcagatgtggagccagggaccgcagagagagctaaatatttggcttcctctttctctgaaggtctgtagcatcatgtctgggcatgaccaagatgagtttcaggcagtgggggctggtgtttgctaaaaggaacttaacaggggtgtgggtgtgcagttctccctctgcccaaggttaagtaatagtaacatcctgtgtaaagagaattgaatgtggttttctgctaaacttcaatgttttagggctgtttattagatgtgtttaatcttgggccaatttaaccagtagcagactaataaaataacagatttgggcttgctgccaggacaaatgttgacttacccttataatgttgactaaaacgagtaactttgaaagttattgcagagtgaaaccttagccagaaatacagcgtctgaaacagtggttttgttttattttactggctctgcttagagattatgtttgtaacctaggctgctgcctgcttcacctctcagagtcctgtattttactgaattatttcccaaggctctttttttcagcccataaaccttcactcagcaaaaatgaatttccccatggcaggcaagtaggagaggttacttttccaatgtgggggcaaaaactcagtggtaccaagaagaatgaaggtaatgacttgcttgagtcttctctcagaaacaaaatggtatgccatgaacattcaccctctccaaatttgtagtaaaattaattgcttctcccgggtgtaccggaagaaatccatctcgcttgccgcctacccccacctttccttcattttgccatgcagtttattacaaacactagagagctatagtattttgctaccatgtgttttggacttgaaggaaacagggga

SEQ ID NO: 106163 - DNA, 1101 bp, Homo sapiens
gacttgtgtctcatcctctaagccctagtttcctcatctgaaaattgggaatttgcaagggaattgtgaagatgaaataggcatataaagggcttccaccaaacaagtacttaataggtcattagcagcagcagcagcagcagcagcagcagcagcagcagcagcagcagcatctatcttgaacgtagatcagttgagtagaagctataggtggttatacttagcaaggcatctgctaggaggtagctccttcctttgtaggaaataaagagatcagagttagcattgggcattattatttttaaaacaaaagatgttccaagcatactggcaagcttcacattcatttctgccaggtagaataacaaaaaaatctagtgtggctttctggttgttcccagaatgactttcagacaggggttggtgtgtgagctctgggtagagaggcaccctggccagaggagtagggagcaagttgtcctgaggccggctcccacctgacatgcatcatctgagaatcctagccaagtgccaaccacggacacagacccaaggcaagcagatgagggtggattaggttgctttgagctcttcatgccctattcatttgcagggtgctttaactataaatagatcctttgttggaaatgtagggaaactccatagtgtgatggatatgagctggtaaagagctagacaactaaaaaatgacccctaatgctctttaattgtccataaatatttattgagacctggctctgtgtatcatgttccccctggtttagaaaagccatgctttctgtcctcaaggaacttctacttcagtttgaccaagtcattaacaacacgacaatacgggtagtgactgtcaaccacgaggagggggagaagcaggcaatttcattggggagcttggcagactatggagggggaatactgagaagtggtcatccaataggctccctgatgctggatgcccgccaccccccagtcctcaagtgtgcccttagcagagggcagcatcttctgggggcacataagcgggacacctttgaacctgggctcactaagattctgagggaggagtcaagaggagctgct

SEQ ID NO: 106164 - DNA, 1043 bp, Homo sapiens
ttgacttcacacaggttggggaggggtggaagtggctcatcaatatcatgttaggttttggcagtcttggttcattttctcagccatcctggtgattgtgttggggatgtctgggtgtgatcttgcagaaggagtcagaaaccactgtaaagaaggaaataagctgttagaagagggaaaactgatggtttcttgtgtgtaagccacagatgcatgatgaactgtcacctccacctccttcctcctcagatgtttggtggtgacttatctgagagctttgaaggagagagcatcagaaaagacatgttgcattctcttattagtctctgaatgctttatgcccaggttccaaaggcctagaagagtgagcttgattctggcaccaacatcgaggaacaggagcttgcttcggaagtctcttaaatgcagcatttatttctaagctggttcttataagagcttcccaagtagctggggacagggcaaaggtaggcttagcttcttggaatttcagagtctgtttctggaatgagaggactggattagttcattgtttcccagaaggtgggtttcataccacttgggcagctcaaatcttataaagacaaatcacaaaataatttaatcactttcccttttaaattatctgatccttctgattatttcaagtttccacttggaattagtgtgtctttaacacctccccatcacttgataatttccctgtgtaactaagtgtaggcctcagggttcattttttaaagttagtttctgtttatggcaggtgatagtgattttccatttaaggcagtgatagagtttatttttacaataagtttttaagtaaaaaatgactaattaaggaaatagtacataatagctcaggtgatatgtacatatggcaaaaaattatcatggcaatacagagagtttggaaacagtgaacaaggcatgttctgaggggctttctaggattagaattctacaataagttcccaagtttgacacagtcacttgcaaactaaacttgaaatttggacatt

SEQ ID NO: 106165 - DNA, 1174 bp, Homo sapiens
accaatcacccttggatactgaaggatgactgtactccgtctgtgttcagtatagatgatgagaaaatcctttcttagttgtaacattgcttcctgcagcaatgttcagtaatactttcttttttttttttttttttttttttgagatagagtctcgctcttattgcccaggctacagtgcagtggtgcgatctcagcttattgcaacctctgcctcccgggttcaagctgttctcctgtctgagcctcccgagtagctgggattacaggcacacgccaccacgccctgctaatttttgtatttttagtagaaacagggtttcaccatgttggccaggctggtctcgaactcctgacctgagataatccacccccctcggcctcccaaagtgataggattacaggcgtgagccaccatgcctggcccagtaatactttcttatgtgttatccctgtaagtatttgaaaaccactctctctctgcacctctcccactccacactcatgtgcattctctcctctccctctctcccctcagatgttttccttctcctggcctggtattcctggttcccttaacttttccaaatgtgacatactgtcctatctctttcctgtccttgcttatttcttctggacatctttagtgtgcctgaaaaacttgagtattaataagtgcaaggatactgtatgatactatgtcaacaaacaggatttcttttaggcttaatatgcttctttagacaagagaagtacactaatatattgaaaaagatttttgaaataaaaatgacagactaaagattaacatctttgtcatataaataatttatacagatatttaaaaaataccctaagatattcattgacaaataagccaaagatactagaaggtagttcatacacaaggaacagtaaagatttaaaatgttcactctagtaggaattatagaaatgaaaaaggcaataataaggtgctattttatacctaactgatgttgcaactatttttaagacataataaaaccaagctgggcatggtgactcacacctgtaatcccagcactttgggaagccgaggcgggcggatcacctgagcttaggagttcaagaccagcctggccaacatggtaaaacccagtctctactaaaaatacaaaaattgctgggcacg

SEQ ID NO: 106166 - DNA, 1187 bp, Homo sapiens
aaccaatgaaaagtgaaataataatttaagtgatagaatcgtattttaacagctaaaaatatgggagtgaatctctgtcttatgtagagattcgtacaaaaaacattcaccccagtattatgttcttccatgcatttaaattatcatttaatttggtaaacattgatctatgtaaaatttttaattattcccccccacagtattttttacatactttacaaaactgtttattgtagaaaagttgggaaatataggtaagttgttttttataccattattgttaaaggctacataatgttacatgttatggctgtatttagcccatggagtatgatatttacattgtttttatttttaaaaaataggtattttcctgtgataaacattcttacttttgcacacagttttcttctgcacacatccaagaggctgtattcccagcagtggaattattgagtcaaaaattatcactttgatggttcttcatggctacttccacatttagcagtgtgttagaaatatgtaagtttctggctgctggaggaagcttgtaatcctgccgttctagcatgttgttcaggtggctgtgtgcacatgatggcacaggaaacagccctgacctgaccagaatcgctggtcatgtattcatggtagagtgaactcaaacagtcagaactaagcattttcaggtaacttattgactcctgggaggaaaccgtttgtcaggacctgccgcagtttattgtgacctcatctgctgaaggcatggccttggagtggagggtttacaaggaggcaagcttccacaggccctgctccatacaacattttttgccctccagcttttagttgcttcatgaaatggtctatttcttgaataatcgtcctcttcaattcccattggtaattattggaccatcttttatcctcatgttttctgcctgatggactgtcaggcagagcttcttggcaagttttctagccaattaaagatggaagactaattccattgagcagtcaattccagttagctcagctggtgggattgtggcgttaatgcaggaccacaagacaagggtttgatcctacatgaactcggtcaaccgtgctcttttcagagtatggtagcagagtagaaaaacgtctggactctttgcttgctccctccccttccttttaagtaaagt

SEQ ID NO: 106167 - DNA, 1026 bp, Homo sapiens
aatatgcttagttttcaggtagcaatttcaagcattctgtttattagtttaacaataagtcataagaaaagaagcttaacagttcttagaaaagctaatcctggcaccatgatggatttaccttgagcatatctttctgtctcaatttccctacctataaatccacagggtgcagtatccatactaacaagatattccaaagggaaataataatttttgagcataaactgaaaatcctacataatagaaacatatttgtattctgcactgtcgagcagaactttgccacgcagctttaaataatttgtcatgcactaaagtgccaggtactctgcttgttcttaatttccttttcttacagaatcttgccagtgacctggaaaggtagatattattctcttcattttgcaattgatgagtctgagattcatggatgtttaatgagtccaaggccatacagttgtgagtcacaattctgcctgattttatgtcctgttaacctgccgttgcactgggaattacagaactaatgccaatccctccctcaaattgccattcatgtattacttttcctgaaattagtggcagttttctagaaatcagaaggggcagaaagtaaagggaatcttcttcttatatatcattgctctctgagaaaaagtattatagaaaagccaaaggtcaaattgcatgatattttcactttacaatataaaaaacatctacactatggaatacatggaatataacgcagcattaagaaaaagaaaaggaaagaaagatggtgaaagatgaaaagattgccaaggcatactgttagatttcttttttcaagttacagaaatttgggctgggcatggtggctcacacctgtgatcctagcactttgggaggccaaggcaggtagatcacttgagtccaggagtttgagaccagcctgggccacatggtgaaaccctttctctataaaaaaaaaaaaattacaaaagtcatccaggcatggtggcacatacctgtagtcccagc

SEQ ID NO: 106168 - DNA, 1051 bp, Homo sapiens
tgatctgattggaatggtattttaataaggtcaaggactgaaggaatggcttagtgaagttagggcctgctgactagtaaatcaattaggaagtcagggaaatctcccagggagataatttgctcatgaaggaacatcatatattaaaacgtatactgttctctctcactgtgaaaggaaagggaaaatcaacaaagaaacacaaaatatagcactggtttttagaataatgctgtaggactcatttcaattcaggtatcaccaaatagaccatgtggctcaattctaatatagattttcagtccctcattgctggtgagaccaggctgtatatgatttctcccctgtgttcagatggagacatggaagaaaatgtgatatattagttatctgtaacaatattactacaaacttagtcttaaaacaacacacatttattatggtgcaatttttgtgggtcaggagttcaacattgcttagctaggccttctactacttcagggtctgacaaggctgcaatcaaggcgttggccagggttatggtctcatctgaggtttgactggggaagggtctgtttccaaacttacatgactgttggcagcattcagcttcttgtggttgaaggactgagggcttcagtttcttgttattgttggctggaggccaccttcagctccaggaggccactttcagccctttgccacatgggcctttcaacatggcctcttgcttctttgattccagcaatggaaagagttgcctcaaaatatgagtacataacccaatcttatgtaatgtaatcataatacataatcatgtgcatcctgtcatcttgccatgttctatatggctagaagaaaatcagtatgccagcctattctggccctacagggatgtgaacaccaggaggcagggatcatgggggacatcttaagaggccatctgctatgtgtaatgtttagtgacttggtgaaggctcccagaaaacattggggttgtcacaaaaccaccctgtgtttttgtacacacatgtaatccttgttccatgaa

SEQ ID NO: 106169 - DNA, 1049 bp, Homo sapiens
gtggctcacacctgtaatcccagcactttgggaggccaaggcgggaggactgcctgaggtcaggagttcaagaacagcctggccaacatggtaaaaccctgtctctactaaaaatacaaaaattagctgggcatggtggtggatgcctgtgttcctagttactcgggaggccgaggcaggagaatctcttgaacctgggagacgaaggttgcagtgagccgagaccacgccactgcactctagcctgggctacaagattgagactctgtctcaaaactaaaataagataacaaataaaatcaaggataaatgctcttaaagacttctcaacttttacaagttgggggttcactattttcgaataatgccagaaaaacaagagaatctttgatgaaagaggtgataaaatgctccctcctcacctccagcttgctgcttccaccttgaaagcatcttactaaacgtacagcacagttggccaaaaacatgcttgggaaaccaaattgaaggtataagatgaggctgaatttggtttgaatttgcaaatttgagtcttagaattatgcctcaatttggttgaattggctccaagacagaagaaactgctttcatggagtgaattatgaggagctgggaagaccacattacccctgagttacaattcttcttgtgaatctttctatctgtagtttatgatttggtgaaaatgtagggagcttgggaggtagagtcagaaaacctatgttctaacccctccaccccctattctgactctaattcactgtgaccttaggcaggtcacttaaacctctctgagcctctgtttcttcatccatccattcagtaaatactactaagtgcctactaagtgctgggcactgggcatcaagtaagattgtttgtgtcaaagtaatttgtaaataaatcctgtaagaactattgatgttttccttgttaaaatgcaattattaatgttttcctggttaaaatgcaacctttggaggagagcactttgaatagcagtctatccttgtgggtgattcttagca

SEQ ID NO: 106170 - DNA, 1055 bp, Homo sapiens
ccctggggtttaaccactgtgttctgtggatccgtctaacattaggccgtgctcgctctcctctgtggagaccatgaaagctactcttatgagatgagaagccttccatgctaggaataaagaactgagtcatggttctggctctacctataattaacagtgtaccttggacgagtcacttcctttctctgaacttctgtttcttcttttgttaaaaaagaaaaagaaaaaatgtttgggatcagcccttctaaaaccattgtgaaaaggaaactcattagatatggattgttaggtactcaactgataacattatttaccaatgtgaacaattttttttagctatttttaattactgcagagttttctgtgatgcaaccagccatgatggagcgagcttgaactggctctaattaatgtacttgagcgtctgttttaccatgtggtgtttgtttgttccaatctttagaccctcagattgatggagttgggccagtttactaagttgccgtggtgaacaggacaaaaagatgatgttcctttgggttttactttactcattgaatattttgttattgacaagtgaagtctatggaatttctcttagcagcaagatttttttgtgtgtttgaatctttttaattttatggaagtttacttttagaatttaaagattttcagaatttaaagactgtcagaatttacagagcccttagccaccatgtatgtattccagtcccctcactttgcaaataaagaagtggaagccctggaggtgtaatgactcaggcaagacttcaatccaggtcacttctaagattatgccttgtcttacattttcccccaagtatatattgatatccatttttcaggaaagcatgtctctagatgctttctatcgaagaaccactaacattgtattaaaggactatttacaattatgaattgtgatttgatttttgtcttgtttgtcatcaatggccttgacttcccatcaaggtcacaagactgtggataatttggcttcttttctccttgtgcagctacggatgata

SEQ ID NO: 106171 - DNA, 1056 bp, Homo sapiens
aaatttgtaattaggaagatttttgcaagtcaaatactaccccattagataactaaaataaataaataaataattgagaactacactggagttatgtctccttgagtttgagaccttctgccaatgtgcaaggagggtgagagtgctggtttgtttgtggggaaggagtgagccaggcatagttttcaatctgaaaccttgtagtttcctatgagacaagtctacctcacccaagaggtctgggttttttataaggcaaggaactggagcaagatgttcattctggtgagatccccacttcataaaacaagaaatgtcagccatgaattatttccataatagctctgagcaggaagacctcttgttatccatgacaaaagttgaaagggaggtttccagaagcagctattttgaaagggctctgaagagaagatgccaggtttgcataagacaaaaagaaacggatgggtgtgtagttgcttttgaaccgcgactcagtgtgggctctgtatcccggacagggctactgattcttgggtaaagttcaagtagatcattgattcctctttgaagacccaaagctctcctcccagtgtcccttctcctagtgatgctttattttctatttcaccccagtgtttgggtctgcaaagctccaggcagcacagccgctgcagccgatgggatgcttcacattgcttttggtggggacccagtgagcactgtttgtctcttacaggctggggattgtcagtcagaaactgaacttctggtgtacctttgaatgcccaaagagtgctctgcaaaagcagcagtagcaggagaggtggggagctcttgactggtgcggctctcagcctctgacacttgtaactgatggcccctgtcacttcctgtcatgcagcccaagtggcggggaggagttccttcagggaaactatgctcagccctgttcagagaatcctgtgcacagggctccactgcagttaggagccggtgagtccgggtggatgaggtcagagcgccccatggtgtggtgctgcctctttgtccgtt

SEQ ID NO: 106172 - DNA, 1093 bp, Homo sapiens
taatgatgacacaacccagaggtgaggttcttgttatcacactgggggaatctgggtgattggagttgtaaaatcaagtagctggggaattccttgttttctccataaattatccatgtgagagctctgtgtaatttcacattacaggagggaatggctgtgtttaactccttctgttggaagggcagacttatttcacttcttactcagccaggagagggagttggaaagcatagaaatggaacttcttgttattacaattcctggctttcagcaaatatatttatgtttgtgtactttaaaaatacataggaaaagcatctgactagtactgtattctatggccatggccactgttcttgacaaaaagaatttctatctggtcatgcagctgttctggctgagaaacttgccctggttccccatttcctgcagggtggagttggaactccttccttggctccaagcatctcatccctggccttcgcatcctgtcccttccatagaccccttgactgtctcctcgcctcctgaatgaactttgctgttcccacttctcacctttgcgctgacccccctctcctcagcctggcaactcctatacatcactgacaaccagctggaatggcactgtcattggggagaccctgagaatggtccctggcttcttcctctgcagcctagtgcttcgaggctgtgggaaccagcaggttgagcagtgagcattgtgtacaggtctgcgtctcctctggcctgtgagcttctgaggtatttttgcatgcctgatgctttgaacacagagctgggcacatttctgttgaacaaaggaagctggtctcatctttacacatgtcagtctgcatttcttccccaagaagggtttttgggtgatgggtagaataccaggtgggagattggaccaccagcctccaggctccatgagagccaggctgtcctgtggctttggtgcctgcactgtggccagtgtgtattcagtcactgcctgaatgagtattgtggtaagaacctgtgctgcaggcctagactccagtccttattccattactgccaagcttggcacattggacaactt

SEQ ID NO: 106173 - DNA, 1018 bp, Homo sapiens
tcatattttggtgaatattttagacagagtttttggcaaagaataggcacttgctccattacctcaagaaaatggctttttaataagagaatatatagttgcaggaacctaggacttctctttgtgggtcagtttcattccccttctctctctgccttcacttgttactgacctataggttctgctcccggtgtctcctccttgtatgtggcactgttgggcttgtcatgatgccagctctggaccaactcagtgtgatctttcagcagctcgctctcctacagcttatggcatagtctcaggttccccatccccaaatccctaagaaaacttcaattggatcagtttttctttcttgcactgggcttcacaagtggtgggcagtcagctggctagctcttaaaagggcttctctacctcttggttcagtcatctgtggccagagagtcaaggtcaaatggatctgtcactcaccagcttgggcaagtaatcagcctcactgagattcagattccccatctgaaatcatatgtagctcatagggttattatgaagattgacttaaataatcatatcaagtatttagcactgggtctgtgacatagtaatgtgtctggaattggtgggttcttggtctcactgacttcaagaatgaagccacggaccctcgtggtgagtgttacagctcttaaggtggcgcgtgtggagtttgttccttctgatgttcagatgtgttcggagtttcttccttctggtgggttcgtggtctcgctggctcaggagtgaagctgcagaccttcgtggtgagtgttacagctcttaaggcagagcgtctggagttgttcgttcctcccggtgggcttgtagtctcgctgggctcaggagtgaagctgcagatcttcacggtgagtgttacagctcataaaagcagtgtgaacccaaagagtgagcagtagcaagatttattgcaaagagcgaaagaacaaagcttccacactgtggaaggggaccccagcgg

SEQ ID NO: 106174 - DNA, 1031 bp, Homo sapiens
gatgactgctgaggtcatgaaggagctcatagcaccattcatgtttctggactcagtcattgtgcctggggtccccatagcaaggaaagtagggaagtgaaccaaggtccagccagtgttgctcttggctgcagggaaggaaaaaaaaaaaaaaagtcaggatgaccgggaagagaaggagccaagccaccttcctggtcctatttaatgagtgttaatctttgtaaatattcaacagtatctgataccaagtaatagctttgccaaatgagtgagtggagggcctctttctgtttgatttccctggttagtttttttgtgtgtgtgcagagagagtttggaccattttcttttgtgtgtttgtgtggattgaataaaagagtgattgtttttcaattgtctctatgcaggaagccttggctgactgtaaaaatttggcactgggaagcgagcagcagtttgcgatgttactgattcagtgtttgcataaataactttgagaaccttaaaaacccaactgtacattataccttgtagttgcaggacatcaaagttaattaagtcttgtccgcctcattttgcagatgaggaaacagaggccagaagagcttgcatgtgacgttgccttcaactgtacacacgttcatgagaagtgtgactttggaattgtgaaagttttatgagttcttgctgaagcatcttccaggaattctagaattggaatgtggaggccctggaggagtgaaaatagaaaatctttcagttttcctgataatacaggggaatgacagggcagtgaagtaaggggtgcagagcaggtgtttggatcatttacccttcgtcatctcctactgggggcctctcattgtactcgcaggctgtctctctgttgatcagggcaaaggcatacgtggatgtgaaaaagcccccacaaacagctcctctgagttcctgtgacaacctgcccggggtagatctgcgcggagtcagccctgtttatggagaggctgccagaccccacttttgcccag

SEQ ID NO: 106175 - DNA, 3115 bp, Homo sapiens
ttctcccaaaagaaagaaaactctctggccccccaacttcaacactaatttggctccctgaagaagagagaaaatattatttctgtctttattgaagagaaatgggcaatgccaatgtgaaggttactagtcttttttattttctattggtgaagactactactgctcttatttagcagatcttataccttcagtggtcaccagtatagcaggtgaggtataaggaaaacagcagtgtgatgataaatggtaattaatatactttgtctgtgtcagcaatagggaatggtggggactgtggcaaactgaagcgcccctgttccacccacagtgggtaattttccagtcgactgtggccatgaagtacttcctgatcttcccatttttcaagaaaagctgacaatctggatttttatatgaaaaattctgattttaaaaaatattggcaactaagttaaaattcaagtgaatttagacccagcagaagacatggatggacctgatttggtccactgactaccagtttgttaacctgtgctttataagatttgaaggaaaggcattcatggtaattacagacggtgccaccagaaaatgctcttgctaaatgcagccagtagttagattgcttctttctccagtctcccccgcaaagaaatttgacgtgattctgaatgcactggacatgtcttgattgcgtctttacatttcacagtgtcttaaaagaaaggcaagccagttgttaatttcagaatcagatttatgctctctcaatttaaaaaatgctgggaacaatttcatttttttttttttgagatggagtcttgctctgttgcccaggctggagtgcagtggcgtgatctcggctcactgcaagctccacctcccgggttcacgccattctcctgcctcagcctcctgagtagctgggactacaggcgcccaccaccacgcctggctaatttttttgtatttttagtagagacggggtttcactgtgttagccaggatgatctcgatctcctgacctggtgatccgcttgcctcggcctcccaaagtgctgggattacaggcgtgagccactgcgcccggcctaacaatttcatttaaactccacaacctaaagggctttgtttatagttttagctcttggcataatttttttcaggtggtgtgcaattctgagcataggccaagacatgattaggaaagcaggcagttgtagagagtaaggcaaggaacctcctagcgtccattagagccaggtatttgcattatcttccgttttaagtggtctgtgaattgactgtgttttggaggtgtgaaacagtatacagagaaaagcttttcctgatactgagatatcagttaggagtccaaatggggtgttgggtcatccttgccatatcacctcctttccaggctcagagtgaaaatagacaaaaggaaatctgactgcaagccagtggctttgattccagtttcagagtttagggactaggagagagtttagattatctagcatattctccccctggtgtcagacagggctgtgcctgaattattccagacatatggctgtagatggtattctttattttataagaaggagattctgtaacctaccctgctgatcagatagttctttgtatgtcttagagaaattcaagccagcttccttttgttcggcttgtagtggagaaagaacagctggtcaccttccatgtattcaaaaaccacagtgaagtcatccccctggtgtttttatttcagtgataaataattccacccacttaaaccattcttcatggctcttgttttccaggggcctaataattttcactgctgtaatgtttctcagcttcacacttagtttagttgcccaaacaatgttggtgccttactcacattggtgccttgtgaagacgaggctcaggatggggattatggggaaattcttgcacacccagctcctcttaccacttaaaaatataatggcactttcacaaaatgatatgtcacctatattcattgagaattatttgactgccacatttttcccctgatgatagtcatctatcataacttgtgtttgttttcctcctgagatcaaacacttggtgcttattcctgatgtatactctgagaccagctcttaccttctgagtggcagctacccctccctcccaattttagatcctatttttacacatctctatagatatcacctttatttcatgactcacaatattaaatggtacagacttcagtttaaccactggtgtggtaacagcagtagttgctaagtaccaccttcccattgctgtttgagggctaatttgcaaagacatttgaatctcccagtgaagatgtctggggaattttggccagttgtcttccctcttgcccttttgttctttaaaattcagcttggaccatagacacctccaggatcttgtttatgttctgctctcaattgaccaagcactgcgttttgcacaatcagaagtctcacaaaagcaaacagttatgactgcatatctgatgtttatatcctataaaatttcaggaagattcagagtcaatcttctatttgtacatgatgtagacaaaattagctgctccaattgttagacaaaaaattgccattggattacactaatgtgctcatctgttgttttaaaagtttggtatcaggcggggcacggtggctcacgcctgtaatcccagcattttgggaggccaaggtgggcggatcacctgaggtccagagttcaagaccagcctgaccaacatggtgaaaccctgtctctactaaaaatacaaaattaatcaggcgtggttgtgtgtgcctgtaatcccagctactcgagaggctgaggcaggagaatcgcttgaatccgggaggcagaggttgcagtgagctgagatcacgccattgcactctagcctgggcaacaagagcgaaactccgtctcaacaacaacaacaaaaagtttggtatgtttctctcaagaaaaaagcatggtgagtccagacagcagcaaaagcttttgtgaaaaccaattgtgttcatctagatagtaagtaactcctatttttactgttaatttt

SEQ ID NO: 106176 - DNA, 3015 bp, Homo sapiens
ttagtagagattgggtttcaccatgttggccaggctggtctcaaactcctgacctcaagtgatccctcaacctcggcctcccaaagtgctgggattacaggcgtgagccactgcgcccggcctaaacgcttgacttttaagaaatatctcttccttcctcaactaagggaactagaacctgttaggaggatgagagtgccccatcttgagttggttgggattcttgcctcgtttatacagagcccatagtccaaacccagatccagtcacattctgccatgagcacctgcccagcccagtgaaatgcaatgacagtgtgactctgtactctcttctctccttaggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaaggcatgtccataaggtctgacaacagcttgccaaatttggttagtccttggatcagagcctgttgtgggaggtagggaggaaatatgtaaagaaaaacaggaagatacctgcactaatcattcagacttcattgagctctgcaaactttgcctgtttgctattggctaccttgatttgaaatgctttgtgaaaaaaggcacttttaacatcatagccacagaaatcaagtgccagtctatctggaatccatgttgtattgcagataatgttctcatttatttttgatgtagaatttacattgccatgggtgttaaataagctttgagtcaaaagtcaagaaagtgactgaatatacagtcaccttttatgaaatgagtctctgtgttactgggtggcatgactgattgaggtgaagctcacggggccaggctgaccgtcttgaccgttccacttgagataggttggtcatcgtgcagaaggccccaggacctcagcacacacagcctcctcttggtctgagtaggcatcatgtgggggccagatctgcctgctgtttccatgggttacatttactgtgctgtatctcagatgttggtgtctggaagtttattcttaagagactgctacccagctggtctgtattattggaagttgcagttcgtgctttggttggccttctggtctaaagctgtgtcctgaatattagggatcacaattcactgaaatacagcagtgtgtggaggtgatggccagttaatctgctgaactggttttgactaatgacaaacctctttttaagatggtagaatggaggtgatagtcacaaaagtaaatgttccatttttatgaatgactttctacagagtttctatttctaaagaaaaaacaattgttcacatcccatctgatgattagcatgtgtgtaatgaatgctgtcttggtctcccctgtggaaacccttctccctgtgccttagagcaggtgtgtacatctctcactacctttctcatgggtgctgttagattttggcacccgttttctcagcattcagcccagggaatgtggttttcacttcttcgtcagataagaccaacatgaaggggtatgttgagaaacatcctgaggcaaggtgggaggtgggatggggcaggactttcccttccaagcacatgcatggcaggtggggaaaggggggcttgcacccctgctggaaagaaaaggtttgtgtatatttctgatgcaaatgtcatactcactgctctgtaaaggcagctggcagctttttgggaaaagaacgtgctcgtctgttctctggcatcaagtttcttgcagctgctctgagggagagacagtgagctgcaagactgcctccccataacaacaggcaactcagagaagagtcattttatgttgttcctatggaatctggaatgagtgcagagctcctacccacacatgactgccccgccatttcatcctaggcattctgtgaaggagattggttagtccaaacttgctaacatacgaaaattcacttggaacatgatgagagatttcttattgaggccaagagatgtttcctgtcccagaggaaccattaggagtcgcttttagggtattcagctttgttcatgaaataaggcatctctgagaaagtggccccagggagagaatggaggactgggaggagaagcattaactgagctccaagggtgtgtgggcagagagcttgctatgtgaactcactccttaagaaaatggaagagaaaaagagagtgctagttaaaaaatcgggatgttttagtttggatttagggttttgatacttatgttgaaatactaatgtttctgatcaataaaatcaaactcttaatataccgagtaatgaaaccatagtgtgattgcctcagaataaattgagaagtccaacttcctagttttgtttaattagtttcactttttctactctccccagtatgctagaaatgggaatcgttgccctgcagattacggcaaaacatctgttttaagcaaagctgcattttttgactcagaaattgtcccagacggtggatataagatgaaattcagaaaaacgttctgccaagtcacaggcttttagatattatggaaacaagaaatggaaaacaggatgatctccatgagaggccttgatcctgagagtaaaaggcttgtgtagataggttagacaacgtcctctagaaaagagaccagggataagtccaggtttccaggaaaaccaagaagcctgcgggtagctgaaggtagagtgctagttgttcatcttaacttaccaatgagctacagaaaggacttagcat

SEQ ID NO: 106177 - DNA, 1329 bp, Homo sapiens
gacctgagtaccaagtacagactcatggacaatcttcctcagctctgttcccacttgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtaaggtgcctttggggccgggtcctaacaggccgcagcctttgaccatgcttctgaaatcagtcaaagcgtttttccacttttggtgccaacttattgggcaatgaaacctgatgagaacacagctcgtttggtagtcttgatttataccaggtgatgggagtactcacatgtttgagttgcagaaatactaatgctaaattatagtgagctgcccagaccctgcaaggggtgttgtgccacatacagactatgcactgtatcacttttctaaactccaaaaacatcagacacgaaaacacattgggccccaagggtcttgggtaacagtttgtggatgcgtcttttttagacctgtaatgttcacaccccccgcccccattgtctttaaagctacattcattgagtctgggattcatgggtacagtattctttctatccttcagcatagggtcccaggtatgagggctctctaggaaggcctacttctgcagggagcatcaggtagatgccatctcaggctgtcccttaccatgtctgtaactagttggagtcatgcatacaaacccttgactttttttttttttttttgagatggagtctcaccctgtcgcccaggctgcaatggcatgatctcagctcactgcaacctctgcctcctgggttcaagcgattcttctgcccagcctcccgaatag

SEQ ID NO: 106178 - DNA, 1057 bp, Homo sapiens
tgaaatttggctctagactactatagaccaaggtatgtgatactctctgtacttcatgatttacagaaacaaaacaaaatttggctcctctctcttaaatgatgttccatcaaatctgacttttcttccattctaatgtttataacctggaagattaaagccagtttggtgtgtgtagctcggactagataaatagtcaattgtcctctgaagaaaagtggtgggaggggagatttccttaggcaaaattctcactcaaaggtattttatgtcccagcctgactcttaactgttgaattgttctttgcaactctttaaatatgaacctttgaatcctttttaaatcaccaaaccacactagagaaaggtggttgcatggtcctagaacctgttatgcggcttatgtttaaaaagaaaaaaagttgtttctctttgaacctttacactgcttaagtttaaaaactttccctttgaaatttcccagtgcactccccgtgggccgggcccatcagagccgtggccatcacagtgccactggtagtcatatcggcattcgcgacgctcttcactgtgatgtgccgcaagaagcaacaaggtatctctttgtgtgctgtgtctccccacaacaaggggcaggccagggggtgctgccaagagaaagagagactgggagtacctgggtcctccaggatggcgcctgggaagcctcatagctcctactattcagttcccagaattaaaatatttggcttttaacctcaggagccactaaaaaaaacaggtatcattatatatctgtttcttgggacagggtctcgctctgttgcccaggctagagtgcagtggcacagtcatagctcactgcaggctcgacttcccaggcttaggccatcctcccacttcagccccctgaggtagctggggactacaggcatgcaccaccatgcctggctaattttaaaaaaaaattttttttgtagtcatggggtctcactatgttgcctaggctggtcttgaactcctaagctcaagcattcctcctgcctcagcctccctc

SEQ ID NO: 106179 - DNA, 1057 bp, Homo sapiens
ctggcttgctcaaggccgcacagctagtaagtggaaaaatcagatctaggagccaagccactgataactcagtggctactgattttacaaataggccaaggttaaatagaaactaagtaacccagcctttaaactgggagtggtcagaagagtggaaaccgtttcatggatgttcacaggactgtctgattgcctctgtggataccaagaaagtttttggtcgtggtggcaaagcccagtacctccttagacatgctcctgtgtatgtcaggttctgtcatagtttgctctccttgctggctctcatctctatcaaggtctttgacctcctgctcatgttaaaattatggcaaataaaatatgtataaacacagactggtaatttctttcctcacccttttattaagtaaaggttgttcaaaccagtttctttgtcttcaaatcaaatattcctgctgagggtgccaccagctaagcatagactatggcaagggtcctgggctgtcctgggccttttatcaaagggaagttcagataacatgtggcagataaacacagttgcttttcgatctaatcacattttctgaaaactgtggttgagactggtggcaagtctccttcagctctgggggagaagaggtgtcctgaagacctttgcccaagaagtgagtttttaaagtgttctttggtctgttgcaggagcaaactacagagacgaccagctgcctccttcaaaatgtttctccaggggattatataattgaggtatgcataacacaagaaagccctattaatgctatagaatgaacccagttcatatagaattccaactgtttacaacactaaaatttcaagctattgaaggtgtgcacagttatatttttatatggttcttaacatgcttttaaaaaaagtttatatataattgatttttgatctcttcattaaatatttcaaacaaatatttttatgtaatcatatggtccatatataaccatggtttaaaatctctagtattccttaatactacaaagatatatttttaagattttagctt

SEQ ID NO: 106180 - DNA, 1041 bp, Homo sapiens
gaaacagagcctccatgtgactgtagcatgaacatagctctgctgcccttggctaccagccttgaaattatgtaatgcctgacaagcttttaaaatctgggtgactttacattgttaccatttatgtggcataaagtgaactgcattaatatttttatattataccatttaaattttcataagatacaactgcacagtagtgaaaatcctcattgaattgatgtattttataccttttctagcatcacccggcacagtatctttatatttcattgggttgttgggagaggaaaatgtctaactgtcctaaaactaaaaacatgtatctttattctcttaatagcctgtgacctgttgttacagccggacaatctagcttgtaaaccctgtaagtaatagtgttcttatctatcaagtctcaaagtatcgccactatgatggtgttagggtagcctctggttgctcactctgggtcctaccttcttccagtctggaagcctcggaacctgaacatcagccagcatggctcggacatgcaggtgtccttcgaccatgcaccgcacaacttcggcttccgtttcttctatcttcactacaagctcaagcacgaaggacctttcaagcgaaagacctgtaagcaggtgagctgctgggtgtatataaaggaacactgcgtgtttcaaagcgacccccaggccactggaatttgggttgctcaatgtgagcattaggctttgttggctctcagtggttggtagatacttgagaatgtaatcattgggcatgtctcagggccatcttgccactgtccttcattccctagttatctgtaacccagctgtcctggtggtgatatagcctggtaacagtattgccaaggaataaacaagaagtatttctcatttgttcatatatatgtatgaacaaatatatatatatatatatttttttttttttttttgagatggagtcttgctctgttgcccaggctggagtgcagtggtgtgatcttggctcgctgcagcctccgcctcctgggtt

SEQ ID NO: 106181 - DNA, 1041 bp, Homo sapiens
aactgttttctaagggcatgtggggggtgctttttctaagcagctcctttcattcataagaaggtagttgtatagaattgtgatcattttagctttatcagccataatttaagtaaaaatgacaagaaggaacttgactcatatttagtgacgtctggcatctgattaatctcttggacagggttatgaatcaatgtaagtaaagggcttaggttgcattgaggcctctcaatgcataatcactgctaaagcaggattgtaaaagttgcggttacaatctaacaattttaagatacaaatatgtgtgtcagattcacacccacagttgctggcatggctattttaggctaaccagtgaggacttacacgtgcaactcagggagctcacattggtggtgtatatatgttctgggtaaatgctgggtagatgctaatgaaagatttgcacatccatgatacttggttcagctaagtaaagacgtggaagggatctttctttgagttacaaagtgaatttctaatatgtgctcttggtcctagcagatcttgtattacattcaagagttcagaattttcccgtcagctgcaaacaaacatttgtatctctaatttaatatggggtttgtgaaggaggatctctccgtgtaaaactttaaagtatcttgctgtttttttaataataccaaatatttggcccacatacctatgcctgtctcttagtcattactttctttttaattcttcaacatttaattaaaatttaattcacagcttgtattgactcctgagacgtttgaagttcagttgcattttgggaaaatgtcatttggacataaattttttgcaaccagaatccaacactttggacttgctagtaattggatccaggctgtgtagaaaaacttattccatattttccattgaaaaagatatttctgtcttccacagggaagttcctgttactgctcagttgactggttactagtcaactgaaataacttgtttgaaataactaagaaacaattactgggttttcaacaa

SEQ ID NO: 106182 - DNA, 1256 bp, Homo sapiens
ggggcttataagagcacagaacagtgtgatttggggatcttgggctttggtcttgggggattggattgtctcgttcctggtctcctacctggttgtgttactgtggtgtctgccatctgcaggttgagcagcctttagttgcacaaactgtggtcttgtccctaagcagttgtagacactcttaggattttaataagttcacaacactttccaaagtgttttagttcaggtgaggagttctggaatcttgtatatgtggggaagagaggctagaaggaggaaagctggagaaggaaggtgaactatgaagaaggggagcttcagtagattgtgggctggtgtgtcatgtggatttaggttttctgttacttattcctcaccttagagtggggggtgggtggtgtgtccatgtgcccctctctgcccaattgtgctttcccaaggcccatgtatatctgagttcagggatacactttcagtgggtgtgcctggcttcaggataagcagcgtgaagatgcctgtggcatatggatgtcatgtggttgtggctgaaaaccctgggctccatcagaagtgttctccacattttgttttggtgtaacaattacccattaaatgccaggctgcccgcatatggttccctccaacatccttcttgttgagtggaaacttcaggtgtgtggctggaatattttcccatcatttagcatttcagaattaacatattttggagaattctgtgattaatgctgaacggcacatttgcagagtattacagaaacagttaaattggagttggtagatctgtagctgctctttctcatgatgcataagtggtggaaaaggcggggtcaacgggaggattccggggctcactctgtggatgctataattaaagtgggaagtctggcacagttgttagccctggtattgagtgcagatggctgacggccacatcaccaagagtaagagttaggccttttaaagtcttttttctttttcttttatgacccacactatgtattccaagcataggtatggatgcagtgaataattttctcattaaaagtaacagcttattcccatactcattcccagtcttgaaatgagaaaccagtttccttagagttgaggaattgcctatctgtcgtggcttaatagagcttgcggatgagggcgtctggagtagatgaattttataaccaatcagtgctcaaagtggatctaactggaagggctccagctggcagctcttg

SEQ ID NO: 106183 - DNA, 1104 bp, Homo sapiens
tcgcttacttatgcccatgtgcctgcccttccagcgggccaaggtgttttcccggcatcaagcccgggaatggaaagtcacaggtttgtagatgatcagcccatctttgatcagcttctggatctgctgatggaagttggcattggcgatttcattggtcttattggggtccaaccagaccttcttcttgccacagcagaggacactaaaggcgagcctcatctgaaacctgagcatactcatggctgtggccgcagcagcgaaagcaatgagctccccgattcttagtttaaagtcagtttagccagaacctttggactttcctttaaaaaagaattaatcactgcttttaatcttttctggttagcttctgtttcatgctaacttcatgacaaaatgttacaggtttctaatttaatttcaccatattactttgattttgtaaacatttctccatgggaagccttaatgaagtggcaagatacattgatttctttctgttgacaggtgaagggacaaggttgtatgtgccatttacttgcctcagccctataggagaggactaggaacacaccaccaggcccacttcatcaggggtggaaatatgctcctacctgctgttccatctgctgcgtctgcctcacaatggatttgctttataattgacctctctataccactccttgccagaaatccttggagagggagtgcagggagaccttaattcctgggaacaccccactgccttcttcacccacaaaaaagacatttatcaaaatctaaaattgaccaagacatcagtacttcatttttacatcattctttgccttctccgaatgacattttagtggttcaaggaaattaaaacaaagctgaatactccttggcaagcataattatttcctggcctaaatgtcatacaatgatttaattggtatgtcattgtgtgtatgtgtgtttgcatgtgtgtgtgtgtgctttaatggaaattccatgtggtatctttgggaaattaggaaagagagtcttctagatttattgcttatagtttaagaacagactgctggcttccatccaaatagtaggacgatgtaaagttacagg

SEQ ID NO: 106184 - DNA, 1031 bp, Homo sapiens
tgtcatctgttatatcactctggggctagaaactggcaagcagtggacaggaaatattttcatttcaaatcgcttcaatcttatggtctaggggcaaaagtgtctgatttcaggaaagccgcagtgaatagcatagtaatgaatgcatttttagttgattaagcaggcattctctccctttcaaacaatcttccctctttggcttggaggggctaaataaacatgtgatattaaatgatagcatttcttgtgttggccatgccttttctttgatcatcttaaacttttcaaagtgttttccaggaatcctcagcagagcaggagcaagccagaggagaatggctaaactcaagttttggcccccttcgtaattgtttactttctgagcagaggaggttttctgagaagatgctgactcttctgaattcctctttaaaaatggaatttggtacctcacccttgggatcatgaatttaggaggaaaaaatattttgagtttttgtttattttcaaaaagtctgcaattttattgtaatttgagtcccgatctctcacatccatcaggtaaagagggtgaggagagttccatccagaggaaatctggtgaggcgatgacatatccgggacagtgtacctttcgtcctgactgcccagcctttgaacatgttacctaagtcatcacttcccagcaagcctcggaggtagacaattatttctgatgtggttcccttttttccagatgaggattccatggcacaaagagccaggaagggattaagatgagaatccttgtgactcggagaggcctctctctgccagaaaccggagctgcagagttcttaccctgcccatgcccccagcagtcgggcttgccctgccttccaagcaccctgtctcagatggacggctgccatgtgcaacaaagcaactaatggggggtggaaagaggcgagactagacagcactttggagataattaaattaaactcagattaggcaattaccccaaagattcccaaacctggctgaac

SEQ ID NO: 106185 - DNA, 1880 bp, Homo sapiens
acacttgaagtcctgagtgcataaatgtaaatgtgtctttaaaaaaaaaaaaaaagaagagatatcgacattgtaaattaagtcagtgtgtgttttatctatatatggcaggttaaagcaatccaatcaacaatttctcattgtgtgagttggaaaccctttggtgtctgggaagggcatgttgtctgttcatagaaaaccacaccctgctgctttctctatttgcagattctacctgttcagtcatatgctgaaaagtccaagtaagaaagaagtctgtagcttaaataataccaagaatatctctggggagactccttcatcctttcccaaacaatatattaaaagaaggcttttaattaataacaccaggcaggaaactaaaaattgaacaatttaaaaaattacctacataacaaaaactccatttgtaccatgtttttgtgaagtggcctaaaaaacgaataactagtttctaatagagactgttaacattgatgtttgcaactccattgttcaaagtatccatgataaaaatggattcccttttctttggttccttgtttggaaatgttgggggaaggtggatgtagctaattaaggctacaacatttaaagggggggacttaataggtaccagctgtcctcaacaaatcactgggtggacgacaaaataaagatgtgatgtgaacacacatgtaattctcttctaaaacggaaatgggctcataaattttctgatttaatagtgtaaatgaaaactacctctactgtgcttatttaagaagcattcattttatggtaaaactaatgctaaaatgtcttatttgcatatggctggtaccttaagacttgaaagggcagtagatggcaagtattattggaagcttagtaaattgtaattttattgtacctttcttcattccatacctgatctaatagacgttaatcatgaggcttttcattaaaactactacatggtagggaagcatgcttgaacgtaccagaaaagccatataaaattcaagtatcaactttgaaaacggaatggaaattggtagcattaattaaaatgtttggatggatatttacatttcacacattaaatgaatacttcatatgaatccttttgaaatcatgagggattaggccttaaatacaactttttttcagatgtaaaaagtactttattgccttcaaaactaggagtttttccaagtgttctgtttggtcatttttgtagatcttttccccccattgaatagtaaccctttaaaaaatgctggcagtgtccccagacttctgtgctgcgatggactgttttactcgagagtgggagggttaatgggataaagggagggcttccttggaacgaagaggtgtgttttcctgagataggccatatggtttagaaaccctttccctgtgattttattctgtccgggtgatttctggtttcttctctcccaaaacggcccccttttatctgaggaaaatgcagtgcagtatggaccaaatgtagcagcagtccgccgcctgagcgtggtctctgttgagtgacggtttatggccccttcctctggagtgtgcacatttgctctgggtgcagcacaggcactcacacggttaggatttattgtaactgttcagtatctgaagctcaaaaagacttatttggagtgaggaggcaggagaccctttttttgagcagccaccctgtgttaggttgtgggaccagtcccccgtccacagtggctgcctgtctgggccaggagcaagacaaaggagtaggggcctggacaacagggaaattcaggaagagattctggggccacagtaccgagcactccccgtcctctctccacacttccctactcatt

SEQ ID NO: 106186 - DNA, 1386 bp, Homo sapiens
agagtttggctttaaattatgtcactggccttagagaagaatgtgaagactttctcagagccctgaccgataaaaggggtcaggctgggtggggagtgtgaggatgggaggagcagggaagcggggcgggggagaagctagtttggatgggtgcctctggcctggggcagatgaggaggcctggagtgaagaggacttgacacttcccctgagttcctccctagaacagctgggtttgtctgaaaacagtctcaggaaggagtagcacaggatccaaatcagattctcagcagttcaaatcttacaacttcccaacaaaggaaagaactgctagtgcttttaagtatttttcatgcttcatttggcctaaaacatgttttttttttcttttttaaagctttcaaggctttttcttcctctgtccctgaactttttatatactgtgccccagcaggtgtctgctcctgctggggctaccccatcaacaattttattgtcctccttcattccccgctgcctctttttttgagacggagtttcgctctggagcccaggctggagtgcattggcatgatctcagctcactgcaatctccgcctcccaggtttaagcgattctcctgcctcagcctcccgagtagttgggattacaggcgtccaccaccacacccagctaatttttgtatttttagtagagacagggtttcaccatgttggccaggctggtctcgaactcctgatctcagatgatctgtccaccttggcctcccaaagtgctgggattacaggcgtgagccaccgtgcctggccccccactgcctcttcagcctgcttctgatggatgggtttttaggcttctagaacttgagcctccacccttgatttgtaagaatgtggggtgaggagagggctcagctatcagggagcttgacaggttgagaggtgcagtggccttagagcagacctctctctggccaccctgccctggcagccagaccttttccatttcccatctactcccaaatttggagagctcctgccctcagtcagccggggggctgtctgtgctggagctacaggccccatctccagccagccagacttgcccagccagtgggaggcattgtcctcctgggcagtgtttgtcttggctgcttggatgttctgaatgggcctgacacacgattaggtgactgatggcctccgaaacacattgtctcctccggggcccacagcctttgaagctcttcccggtgggaagtaaagagactatttgctctattaaaatgccttggtatttcctctgtttaaccacaggccacttcccctctgccactctaaacccggcagggccaccggctgattgaaaagacacaagccctcaagt

SEQ ID NO: 106187 - DNA, 1334 bp, Homo sapiens
gtcgcggccgtgactgtggtcgctgtcactcgagctgtgcacggcgagggatggacggtgccttcgccgctccgcgactgctgcgctgctccctgcagacttggccttaataaactcatcaaaataaaagccctgtgttctgtgcgtcggaatgatgctgatgtggttgctctagcttaagacagttttggaaaatgtaaccatttaatatgttttcagtactgcagaatgaaagcagctatattttttaaaatgttggcaggggctgtaacttgcatagggaaaacttcatctctaagccgttttacacgataatttaaacggtttaagacggtgttgctggttggacactatttagaatgaaacatttctgaattgttgctgatttagaaatgcagttgcaccatttcgtgtgtctttacagttgaacatggcccccaaagaagaaaagcagaagaggtctagatctccttttcctggatggcacttctgccatggattttgtgccaatgttaattgccaagttgaaatggggctctgattgtagaattgatttgttcttttttattctgaaagttatcttcacaggccagttgcctgctgctaatgtactcttaacagctgatagtgacaaaaagagaaactcacatttggtttatcttgactgccagtatactcggttcaatttttttcttgatgatttctccatataaagttataaactgtatttgtttcagatgatttgcaaaaagtttgtggaattggtcaggtgtactttgtcattttactttttattatgtaagattcaacaggttgccttacctttcttctcttacttggcttttttttttaatagcccataaagactataaacggctcagaatggattgcacactgccctggaaatgacttgtgaggcagagataaactcttgactcatctaatgtcttgaggtttttgccagattagtttacaacttaagaattgtggtttttttttttctttacaagcatgcatcatactagtgtccgttttacaatatatttgtttgttttttgagatggggatcttgctatgtttcccagtctggagagcaatggctgttcacagacactatcgtagtgcactgtgtcctggaacacctatgctgaagtgatcctcctgcctcagcctccctagcagctgggaatacaggcgtgtgccactgtgccagcttttttttttttttttttttttttttttcctgagacggggttttgctcttgttgcccaggctggagtgcaatgttgcaatcttggctcactgcaacctctgcctcccgggttcaagtgat

SEQ ID NO: 106188 - DNA, 3367 bp, Homo sapiens
agccaaaccatatcaagcagtcacttccacctccctgctccctcagcccttgtcaaccactaatcttctttctgtatggatttgcctacttttgatatttcatataaatggactcataattttagacttctttatgtctgttttcacttagcataatgtgttcaaggttcattcatgttgtaatatgcctcagtacttcattccttttttggctaaataaaatttcattgttatggatataccaagttttgtttatctggtcatctctttatatatctgtgtatctgtttatctagtcattgtttatttgtgttgtttctaccttttaactagttcaaataatgttattatgagcattcatatacaagattgttttttttgttttgaacaacagttttcagttctcttgagtaggtacccagaaatgggattgctggatcattgcatggtaattttatgtttatttaaaagttaaataattttagaaaaccaccaaactgttttctacagtgcctgcaccattttacattcctaccagcaatgtaggagggttccagtttttccacatcctcgccaacaattattttagtttgtgtgtatttaaaatttttttaaaaattatggccatctgagtgagtgtgaaatggtatctcattgtggttttgatttgcattttcttaatgtctaatgatattgagcaccttttcatgtgcttattggccatttgtttatctttgaagaaattatatagatcctttgcccgtttttaaattggttgtctttttattagttgtaaaagttctctttctagatacaagttacttatcagatacataattggcaaatattttctcccattctgagttgttttttttttttttcactttcttgatggtgcgctttcatgcatagaagttttaaattttgatgatgtccattatatattttctcttgttccttgtgcttttagtgtcatatgcaagaaagtgttaccaaatccaaggtcattctgtgttttctaagagtttagtaaatggaattttttgactatatagtattttgtactatatcacataatttttagtgttttcctatataaaatatatcagaaccatttttactagattatgtttaatttacataacactggttaaatgtctgtgtatagttatttggcctttttggtctttctttttctagcttagctcttgtcatgcagtgctttcaactcaacttgctgatgccatgatgttccccattacccagtttaaagaaagagatctgaaaggtattgaagtcaagcttatgtttactttcattggctgtgagatcaacacttgtaaaatgcatattactctgtacttacaccatttctggatgacagcctatgccactcttactttgctcagttaccaaacatttataggagctcctgctagatgtcaaactagatattgagaaataccgatatggataagatatcccctcttttgagaaattctagagaaggaagtgggcacatgcataattacaacacttatgtctcttataattagggaatgagcaaggtgctggcggggctgttaggagggggtcagcaaggctttacccaaggatgtgacatgagcattgaacagtgaagaggaatttgccaggagaacagtcattgttctgttagagggactagagtgcacaagatatggcttttagaaatacacagcctatttgacagtagcaagaaactcagtgtggctgcaatgctgtatgtgttagagtgaggcaggagatgaatccagaaatagagtagatgggagtaggtcatgctaagaggctagaacttcagattatgagcaaaggagaagccaatgggggtctttaaggagagacacaattcctttggaggatggaatagagtagccttgttatgtaggagactagactgggaagttgtgggagtccagtgagatatgaccaaggcctgagttaggatagtggcacagggtatagaggtgtgtgtatgggccgaagtggcaagaggtaggggtactggcacatctaacaatctgcaacctagtcgtttctgggttttatttttacccacttaggattactaggtgatacaatgagagttttatagagttggttttgctttcccataacttgtaatctcagccatacacacttacttccaaaatatgtagagagattaaaaatattgaactaatgtatcagtgaatggtaaagtatttaaattatacatggaatacagacaaatgtgtattatactattctacacctacaccatttctggactgcaacccgtgccacctttactttactcagtcaccaatacatctaatgtattttaaagatggagttactaattgtggttgtgatcctcaagaatggtcatttctaaggtctagaacaagatctcttttcttcagtgtaaggggactgaatggcataatcttattaatgagatgttttgtttctcgtttagcatttgaatatttagattcatatatcaaaaatgcatgattctggcactaaatcagaatatttgcatatcttaccatttacagtgggtttttaaatttgtttttatgtcatatcactaatttgtagcaagtagattttctggtggtgtaactgttgctaatgatagtaaatgtttcatagactagctgaaacacagagtagctttttcaccctgaatgttgaactatgaaatattattttgagttttaattatagtttaagtagcagttattgttttccaaacaaatgtatttcataaatgtgccaaacttaaattattcttgaactttttcagaaatactaacattaaaggaagtatttcagattgcaagtaatggtaagccctataatttgcacacttatttcttgcagtgatgtatttgtttatcagtgcatatctgtggccagattctttgtaataattgaaaaaaaaccaattaaaaataagtgaacattacttaaatcagtattgctacttaaattacactgtttatacagtgtaatttaagaaaaatcttaaggaaattaagtcttacaggttactatcttcataatgcctaaagaggtagtgtaatattttacccttcttgttcttttatatatcccaatttttctttaatgagtgttatatatatatatattttaagatacagggtcttgctctgttgcccaggttggagtgcagtggcttttcaagccacaatcatagcatactgtagtgatcctgctgccccatcctcctgagtagctgggactattggcatatgccactgtgtctaagctgcgtttgctatttttgtactagaaaatactttaaaaagcttta

SEQ ID NO: 106189 - DNA, 1017 bp, Homo sapiens
aagaccattgaaagcatttgtaagttttgaaaagtactgttgtattgttaacactcatttcttttttccagatcatgatgctgcgattaatagatatagccgtttatcaaaaaaaagagaaaatgacaaggtgtggtacatatttattccttcagtgtcataattaactattcattaggtggtttagtttttcctctatcaaaatagagccagcagttactttgtatgttttgttatattactattagtttattctttccttctagctgttcaaaacctttctgataatcattgacctctttaaacaaaatattttcttctgccaaaatttgatgttataagtaaatataactattctggaaatttaactgatgcccagtatataacattgccttttgttgctttgtattttgatgacatggcattggttctgtttgaatatataggtgtgttcaaaaatgtcttctgagatagagtggtcacacacataatgaaattctgttatgaggccctccttatttatagacatatatatcttttgatatttgttcaaggagtgaaatacagaaatattacactatatttgaggagaaatgcattcaagtaaagatgagagtacagagtattaacaggtttttttgggcgtgccttaagatcatgtctttctccagcatctagtccaaggcttgatgtgtaggtctttctagatgcttgtgactgaggtgatctctgtgcctgggtgttggtgtctgcagccttggctgcagctgctggtggaaacacagtgactgcttgtgggaatccacagttgggtaggatttactgtgcaacagctactgtgacaaaggaaatgtttctcacacaaagtttagtacaaagattgatttccttttcgtttctaattttagctgcagactactacttaatggtgtattgataaaatgtatacatttgagatctctattagtcacttggccttagagaagtagttaaaggctctgggtataaaatttgata

SEQ ID NO: 106190 - DNA, 1017 bp, Homo sapiens
aggtgtgtaccactgcacctggctaatttttttttccatttttaatagagtcggtttcaccatgttggccaggctgttcttaaactcctgacctcaagtgatcgtcccgcctcggcctcccaaagtgctgggattacaggcatgagccaccacgcctgggctcaatgtgcattttgtaaattatgtggttggaagttaaacaggaaaatttgcttaaccagtatgttgaaggatttctaaaagatcagaaaacaggaacattaatgctcaattgcttgtgatactcaattccttgggtaggctcttctccacagctcctactgaagataatacaaaattaagtaaataatagcagattatttacttaattatttaaatcttttcattcaaaggtgaagtatgaagtaacagaagatgtgtacacatccagaaagaaacaacaccagaccatgatgcattatttttgtgcattaaatactcttcagtacaagaagaaaatagcattgttagaacctctacttgggtacatgcaagctcaggtaaatactgtactgtatttggattataactgtcctaaaagttttatattaagcttgatatttacattaagtataagggtattataaactattttcaacatccttgtttatgtctgtgttttaagaagttatttttaaaatgtcatcagactattattttaaggaagttaggaagaatggttttccttgcaaatgaagatttcaaatattttaggtaaatgaaaccacttgttcaccatagctggggactgagagaactaaatgaatttcagagttacacctattgctagagcttcaactaaacacttgcttcataatagatctgaaaaagaataaacaagtttgagtttatcccatattccttgcatacttcctgagttaaaaataatagatgaactccaacgtgcccaaagagtacatcaggaagggggctagaaaatttgggtagtataagacaaagtgtcagtctcctaaaaat

SEQ ID NO: 106191 - DNA, 1810 bp, Homo sapiens
aaatggaaggatcccttgagcctaggaggctgaggctgcagtgaggttttattgtgcagtctggatgacagacgagaccctgtctcaaaaaaaaaaaaaaaaattgaatctatttaggtaaaagagtactttactgattattcctcagatagaaaacttatctttgtagtaaacatgaaatactttatataatttattggaaatactttaaaatttattttccaattttaaaagattgttaaccatatgtatatattacttgttccaattcaaaaaatataaaaggatatgcagtggaatttaagtctaacttccttaatggctccctgtgcagtagaagtcacaaactacaatgtatttttacacaaatgggaatattcctttgttttttacttaaccatgtgtcttagagattgtttatatgatttactttaagtattgcttaatctatttttgtattgttcaattccccccactccccactctccagataagtttctttaagatgggttctgaaaatcttaatgaacaactggaagaatttttagctaatattggaacaagcgttcagaagtaagtatttttttccttaaaattgaaaatgaaatgatgtgaatgataacagctcaatgacataatgtaaagatatttatcatttactttcctgagggaatattttccctgccatgagagtttcttatgtggttcatggttacttcttgtttttttttaacctcttttttccacagattgtgaactttgaatttcataatagtgataattttattgattctacactcagttttatgtctgaatataacagacacataatagtaactccccataagtgaaattatctttaaacttgaaattgtgggagtttgatgggagattactaaatattgtttccaagccatgaaagcttagagagaaagcagttcttatcaggttcaaaatgccgagcagtgtatgtggtcagtccacggtatggagagagatgaaagtgattgttgttttaaaggcacagggcagaacagtttgaaaattacgccaaaatcaggcattcggggggcttcatttgttttttgaatttagtattgtttccaaaatatctaagtttcaaataaactgtaaacctgttttaaaatatattcgtgttgttttaaccacccatgccgctcttcctctctttaagaaaacatacccgaaacaaatatgcaggtaaacatgattggtaaggagttctttattggttgtgatttgtagcaaataatctgttctgtgtcagtgttcgcagggaaatggacagtgatatagagaccatgcaacagacaatagaggatttggaagtagccagtgatcccttatatgtgcctgacccagaccccaccaaatttcctgttaatcgaaatttaacccgaaaggctggataccttaatgctaggaagtaagaaaactattgttatttttgtatattgtgtatcatgtaagacaataccaaatgaatatagtaaataattgatgtctgtcatattttgatttttattaaaggttgaaactttttagaggtgttagtatttatgtgaactttttgacagatgaagtacatgaatacttttcagaagtaaaatcctacctagatatttattgaataatgtagaatgataaaagaagtgaaaccagggctgggcatggtggctcacgcctgtgatcccagcactttgggaggctgaggcgggcggatcacctgaggtcaggagttcgagaccagcctggccaacatggtgaaaccccacctctactaaaaata

SEQ ID NO: 106192 - DNA, 1502 bp, Homo sapiens
tcctactttaatatatttgtaattatagcaccaagtcaaatgttagttttcacctgatgataggatgaagcaggttaaccctagaaataaaataaattctgttgttttgaatttactcccttggaaattgaactataacctatattttatggatcattattataacagccacagtttgataatttccagccttgttttggaaactgtatacacattcacaaaagtgagtcaacatacatgaatttattttagagactgaaagcatatttatatttattttcttggcatcttggtgcctcttcgcaagccagttcattgtaacatgctttatcttgtgtctagctgatgatgagatttcaggtatgttgttattaaagagtgaatgtgctttcttcattcagtaaaacaggcttggtgtcatctacctgggacagacagttttacttcacgcagggtggaaatttaatgagtcaggcccgtggggatgtagcaggaggcctggccatggacatagacaactgttcagtgatggctgtggactgtgaagacagacgatattgttttcagatcacctctttcgatggaaaaaagttagtattttttttctactactactaatctatagtatattaaacttctgaaatgtgagataattcctttttgtttagaaattttatggacattttaggttcattatgtattaagataaattgctttttaatcttgtagaaatatattgaatttttgtctctggcttggttaaatggtttcttgatattttgaagttgtcaaagcaatgtcatatagtaaagacctgtgatttcatgttagggaactggaactgaaaatcctgcatagtatcagggaagacagaacaagttaatggaaagagtcctaaacctggggtcagaaggatcaaactctggatccattacttactgtgtggtctcagacagtacagtaatgtctgtaacccctctccgctccatttttcttcatgtaaaatgtgaatgggggggggttgtaatccctatcgtaaattgttgtgaggaacagaaattctaacatatgtaatgtgactgacatatagtaggtgctaacaatagtgttattttaaaatgttaatcaagtatttctgatcagattatttttccattaatgtttataataccatttaaaaaatttctgttacctttttttgaggcggggtcttactgtgtctccctggctgcagtgcagtggtgtaaacatggctcactgtagcctcaacctcctgggctcaagggatcctcctacctcaggatcccaagttgctaggatcacaggtgcatgccactgtgcctggcaattaaaaaaaatttttttgtagagatgtctcatcatgttgcccaggctggtctcgaactcctggacttaagtgatcttcctgctttagcctcccaaagtgctgggatcataggcatgagccagcatgtccaggcttctattacctttgcattaaa

SEQ ID NO: 106193 - DNA, 1064 bp, Homo sapiens
ttgtaacatgtacttacagaacctaaaaagaagtttttacaattccaggacattcttggcatttttctcaagcaactaagattgcagttaaataagtgttcctctgtgctagcttatttaaattcaagaacttttgcaacatggtttattatgttgattttttgttgtgtatgtctaaacttccaattcatctgtgtcttctaaagtgcaccaacattgatcagttagtgtgtgagggcagaggccttcatcatagtaatttagtgatcaatagtgtttcttaataggatggggcattttagagctttttttttttaaatgttaactgtggttttaataattagatttcttctatgtggctcatggtaactgaccatgtgttcatattttcttctaaactttttaggcgtacaaatccatttggagaatctggaggaagtacaaaatctgaaactgaaggtaagacagatgtgcagcattcatatattttagaactgcttctcagcaaactgtgaataatttattgtttatatttgctctgctactaagctcagttttaatgctatctttacttcagaatttcctctacttacttatagtacacttgaagcaacagaacttaatctgacttaagatgttgtgattcatacaaaacgatagactctcatacttttgactttatagtcaaattcagtgcctaagatacctttcaagcttttcctaacagctgatgtttctcttctggtactggagcataaattttgtttttccgccactaactatttatttgaattctaaacttacagaaatgctgtaagaaccaccagttgttgtgtgtttgtgtgtgtgtgtgtgtgttgagacagggctccctatgttgcctaggctggtctcgaactcctgggctcaagggatcctcctgccttagcctcccaaagtgctaggattacaggtgtgaaccaccacgcctggcctcagaactgccagttgttgaagcattacttttagctatttgaatttgaaaccctaattttcctataacttggaatactgtagttaggagt

SEQ ID NO: 106194 - DNA, 1026 bp, Homo sapiens
tagtatcagctatgattggtctttggctgttgtagttaagtctatggccatctccaaaaagttgtcattgaacattttatgtaacttaaaagaattaacacaattctttttgtaatttttttaacacagttctttttgactttgtaaaatgtgttaatgactaataaaacaaatgtaatattcaacaacctttttctgcttgttaattcaaaccaaatatgacattacttgtttctgcattacaagtctgttaaaataattggctttaatatattaaaatatttatatttttagaacttagcatatgagtttgtcacaagtgctgctgtaatgacttgtaagatctcatgtttgcttctgatgttttctgtggcagtttccattaccttgtgtagttttgtatgctacacaccaggaaaataagcgcctttttggatttgttcttcggacatcaagcgggagaagtgaaagtaatctgtcatcagtctgctatatatttgagtcaaacaatgagggggaaaaggtacatggcttttcagaatatctctgtcataaccacttactaattgattcttactaagatttaataataattaaattcttacaaattaaattagttagtaattactgattgaattctttacaatttatacaaatttatgaggcacatgtgaattttgttacatgtatagaatgtacagtaagcaagtcagggtatttagggtgtccatcatccaagtacaatacatttttgtgaagtatagtcaccctactctgctgtcagatattaaatatattctttctatcgtaatttatggttgtaccctttaatcagcttttcttcatcctccccctttcctcatcactcagccttcccagtctctgttgtctgtcattccacactctgcctccacgtgatcaattttttggctcccacatacaagtgagaacatgtgatatttgtctttttgtgcctggcttatttcacgtaagataatgacttctagttccatccacgttgttgtg

SEQ ID NO: 106195 - DNA, 1748 bp, Homo sapiens
caaattttgcctaggcttactgagctgcttgagcaaagcatctctgaatagagccaagctgatggtttgggccttctgactctacagacccatgttttccctgccactgatagctggtgcaatcttttagcctctcatttatgttgggaaccaaacattatgttgggaaccaaaaccagccattttcagatgtcttcagctgagaatagcattagcagctgcatgcttcttcctcgtaggccttactgtgacagtaatgaatttgacataacaagaagtggggtatatatgaaggtgagagtcagcagtggaatcctgtagacttcaaggaaaacatacaaagccttggtttgggggcttgagcattcttaaatatgcttttgcttgaagcaatgtattaggattagttataaaactagttccatcagttatttggatacttgacatttttgctttgttgtgagaactgcctgaatttttcatactttttctctttttagatatgtgattctgttggactggcaaaacagatagctttgcatgctgaactggtaagaatccaagatgtggctgggcacagtggttcacacctgtaatcgcagcacattgggaggccgaggcgggcagatgacttgaggtcaggagttcgagactaacctggccaacatggtgaaaccccatttctactaaaaatacaaaaattagttgggtgtggtgtcgtgcacctgtaatcccagctactgaggaggtctgaggcacgagaatgacttgaatccgggaggcggaggttgcaatgagccgagatcacaccactgcactccagcctgggcaacagagcgagactgtatctcaaaaaaaaaaaaggaatccaagatgcttgattttccaagaatgttaactaaaatagtatattagctctttcatattagcaagtaaataaaatgattttgctaagcaaggttaacagtgatactattaccaacatagcatttagaatttggataattgtttaccattgaatataaactgttgatgtgctttcttatgtataaatgcaaaaaaatattgaaaggttaccatgtgatattaactgaaatgtctaaaatttaaagttatttcatatttaattcattagttttattcatctgttctttaggatcgtagggcatcagaaaaacaaaaagaaatagagagagtaaaagagaagcaacagaaagaactcaataaacaaaaacagattgaaaaggtatacagtcctaatgtctggatctttatgtgttgtttgtgaagacttaattcagcactatgactttcagatttgaatttccaaatgaagggctgtttctgcttgttcagccacttcataaacagatgattcataccatagcagaaaagggtcacatctgttttttgatatgatgtttacattatagttacgttgacatgtaatatgactgtttcaaaaatataccagaactttaatatttcagaggaggttgtctctgtcaaagcagttgagaggctgtgtagacttaactgccattgctgaaagccattttgccttctatgggggggaaataaataaatatatatgttatatgaaatatataatgaaatgtatatttttaatattgccaggagtgtcaaatcattgtccatccaacagaataattttaaaagacaaatttcagagcaaaacttgaagaatgcattaaatgatccatgaaattgtaagagcgtgttatggg

SEQ ID NO: 106196 - DNA, 5398 bp, Homo sapiens
acagatcaataagcattggctgtgggctggctctctggacaaagaagagggaagtggcaaagatgacattgaagtgaggctttcttgataggcgaggctgagggaaggtgacacctgatttagcaaagatgaattggacagggatggagaaaagggctggagaggggaagggaaaggagtgtgggggtgatccctttcgagggttttactataatatatagtgagagatgattgatgatgggctttatttggttgttggtcataaaaaaagaaagataaaatattagattttagtttgaatgctggcttttataggatggtgccaaaattcattttggtgttgtattgtttgggtgtagcttttctttttatcaagttgtcagaagtatgcatacatatttatgacagaagaagtggctctcaagaatgtatcttaactgcataatttgccatttgactgcagacaagtaacttagtttcttttttgtcttttccactaggacttggaagaacaaagtcggttgatagctgcttccagtagaccaaaccaagccagtagtgaggggcagtttgttgtccttagcagtagccagtcagaagagagtgatttgggagaaggaggaaagaagagagaatcagaagcataagcttatacttttggtagatattcccccttggaatttgacagtttctatggtgaaatggcagaaggtaacaactatgttgaaatatcaaggaggagattaagctttatatttgcttatttgttgtagctacattttaaaaaaaagattgaacttgatgacttaggtttgcattgatcttttttcccccttaaacataatgtactatgtattaacatctaaaggaaacctgctcatctccctgaagcagactgctgaggaattacatttgctcaagaattttttccgtcaaattgtgaacttttaattcttgcattgtaattggctgtgtccataagaaatcatttattcttcaggcttagacattcatggatatgcttttctttcattaggaacattttgctggtgatgaggaagcatttagctgaataagtttaaagccctttatacagagaattctacaagtttgcaaatattttaacaatattaaatgtgcaatagaacttttataaaataattagaacagagattttacagttaaggtttcaaattgtggcaggtggtactgttgatctcagggtactttctgggattgctcacatttctctaatgtactgcacttgatgccagtaggaaagaagcttaagtgtcttcagttcaagattgatagagcccttggcattttattatcacattcttagttctcaggttgggacttcaattactgctgcagagcagtagtggttaaaaataagatattggaatttattaaaagatttttgttcaatacattttagattaggattgacaagtaaagatactgctatggaatgatacattgtattttctgcattgtgtgaaatagtttttattgaaagtcaagtgacatttcaaaagaagttctataacaattatgtttcatgcttaaagtaaaaattcccagagtttagtttagaaaatgtaatcttttaaatttcagactgatatattcccagtattttcataatgccatgttttgataaagtactgaatcaccactttatatccacaaaggcaaataactaatgtatgataatagaataatttgcactaattattgtaaatatgtctactcttcaaatgagtaaaaggtccaattttgtgaaagattgaaaatgaattgaatgcctagtagagtataggagaagttgaccaaggaaggatttaacctggtgccaaggttaaaataacatttctctactgcctattgtttatgttaaaccttaattttttttctgtaatcacttttaacactgctaatagaaattatgttttcatgtgtttcacatgaaaaagtatatatatacaaagttaatatagtgggtaaaatactttacatagtcacacatttacaaatttttcaagaggttagccactaagactttaataattttacaagggaaaaagcctttttttttctttgatatacagttttttcttcttagttctgcattagaaatggcatctgttttaggtctcaaaatataactcagctgtttcacactgtatatgtacattgttttctgtaggaataggataatgatatataggatcatgatattccttctatccatgtgccaaatgggtgtaatgtttatttactgatgctttatgttaccaaaacatacagtaaaaaagtagaaatttatgaaatacttttgataaaaagtttattttgtgcttaccaaaaggaatgctttcacaatagtgtatcagttcttttgttttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagagttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggattaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaataaaatgaaaaaaaaagtgtttttttgagacagagtcttgctctgttgcccaggctggagtgcagtggtgtgatcttgggtcactgcaaactccgcctcccaggttcacgccattctcctgcctcagcctcccgagtagctgggaccacaggggcccaccaccgcgcccggctaattttttgtatttttagtagagacggggtttcaccgtgttagccaggatgttctcgatctcctgacctcatgatccgcccgcctcggcctcccaaagtgctgggattacaggcgtgagccaccgtgcccggccctaaaatgaaattattaatgttggttctgaaacagcctcttagcattcagattgtattttaaatacttaaacacaccaattgtagaaagcaaccctttatttttagcaagtttggtttactcttctcccatgagattttgtctttctacattaactagtaagacataaagatttgaaactggaactatattatactttttaaccaatctctgtggcttcactcatgaaatttacttcagttaatatgagactgggggttaagttgtaactaatatgcaaaattgctttgtatatttggtgattttgtaatgtaagtgaattgattcttatttcactgatactattaatcatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgtacagtgttttttaatgaaatatttgatactctgaactttatttctcaaagtaatttcagatgtttgtaaaacaatggacttcttaagctgttatgacattataaattatacagctagcccaactataattccacagcagctaaaatgaaaaaaaaaagtcactttattgggaaaagtttgttatagaagcaaactaatcgatcactggtgactgtttttcttttagcaaaggaaaaagacttcattaattgacgtatacttgctactgtttggtcctacttacagaaattcctctaatttacaggggcaggttattgtgcataccacagtatagcttggatttgtaatttcaatactaatgcatattcatcccatgtgctctttatagtttcttatgtcaattagttactttcttctgggatttagtgttttgtcttggattttatagaaatgtatatatacttttagaaggtacagggaatagatgaaattaactttagaattatataatttatctgatataagtgcatgtatagcctaaatatatttctatattgaaagatataatctaccactcacttaccagtttgatttaaaaaataactattcatgtcagctatataaattttttaatgtaaaaaaactataaaaataatttaaagtctgtgcttactgaaatagtctatatagccattaatccctacactagaaaaaaaatcatatagcttcagtttccctagaatggactatctaattcttttaaaaagtaccaagactaaacatgtaaacatcaaggccatagctgactgggctgtagtgaaaatggacgatatcattctacctgttttccctgttgatatggcttctaaatgtgacacaagtatggttgaatgaatgtctttttcagtttctttcctcactttccacacatagaaatgtatacttacaggcctggcacactggctcatgcctgtaatcccagcact

SEQ ID NO: 106197 - DNA, 1055 bp, Homo sapiens
atagaatcacttatacaaacctagatgggatggtatactacacactaggccatgtgttatatagcctgttgctcccgggctacaagcctgtacagcatgttactgtactgaataggcaattatatagtaaatatatatttaaacatagaaaaggtacagtaaaaataagcattataatctttatgggaccaccattacatatgtagtccaatgatgactgaaacattgtatgatacgtaactgtaggaaaaaatacagtatgtttagggttctgtactaaccccggtttcaggcttccactgagggtcttggaacgtatcctctgaagataagggagactactgtattatatatacttctctataaaaaagatactgcagtgagttatcttgacttgtcagaagtggcatctattcttttgagcacatagacattggatttatacacttaattaaaactggtgtatttcagttaattgaaatttttactatttgggtttttttttttttaactgcctagagaatgctagtcatttatatgttgagaggctatgttcaaagctactttaaaaaattttttttttcttttagagatggggtcttgctccggtcacctaggctggagtgcagtggcgtgatcacagctcactgcagccttgacctcccaaggtgaagcaatcctcctgcctcagcctcccaagcagagctactttttaaaggacttagactgcattgagattttagttggtgggtaaagcaaaaaatatgaatcatacataagtgaaattttaaggaatacagctgcaaaattataccttttccattagaatggtttgattaccaggttcctgtaaaaattccttgtccataaaggtcgtattctttgtaaaggacatatgcttttagacgattgggtaatggaagaaatgacatgaagacagggcagcgcaaatgtaaccgtcccatgcatttccggatctttaggcggcacaaatgttttagggagcgagggtttgctaaaaagaaaaggcacattatccaaagagaaaaagaact

SEQ ID NO: 106198 - DNA, 1029 bp, Homo sapiens
aagactggcatcaatcatggatctggcctgtgagatctgaagttcttaaatctgcatgtggccaggcggggtggctcatgcctgtaatcccagcactctgggaggccgaggcaggtggatcatttgaagccaggagttcgagaccagcctggccaacatggtgaaaccccgtctctattaaaaatacaaaaattagctgggcgtggtgactgcatgcctgtaatctcagctactcgtgagactgaggcaggagaatcgcttgaacccaggaggcagaggttgcagtgagctgtgattgcaccactgcactccagcctggttgacacagactctgtctcaaaaaaaaaaaaaaaaaatctgtgtgttttagccccctcagggacagggtagaaactgaagattaccacccaaagggaaataacatgaaataaattattaatttgtcttacgtgctactttgaaagaatttgctttgaagaaggtcattttgataccctctacagacatggctcttagctttttctcatccttgtttttattgccatatgatattagcttttcattccggtgtccatggtgttgtttccatgatttaggtggattgggatgaaagtattacctatctatataataagtagttacctaacagattttgtctccttggaaaaggtaataaatacaaattaagtgtagttagtaacatttttaaagataggaatagtatttttctggtttaagtcaagcttttaaccagaagagaagggtgttctaattctaaaacaaccaaataagaatacaattagtacttttgtaaaaagtcattctatgagaaggatacttacttaagataaaatgtatttctgaccagatcccctgtttttggagcacagctttcaactttgaacagatccgaacttgatcaacataatcaagcatcactcgaacaacctttccagagagatgttgcagccatgacaaagttattacttcacagaactgagggaaacaaaatcagaattaggaaagtaa

SEQ ID NO: 106199 - DNA, 1007 bp, Homo sapiens
ctaccgggaagaggcagtggctgaggacgtgctcaacgtggatgcctggcaagacggcgcggtgctgcagatcggcgatgttaagtacaaggtggagcgcaacccgcccgccttcaccgaactgcagttgccgcgctacatcatggccgggttccctgtgtgccccaaactcagcctcgaatttggggatcccgccagctcccttttccgctggtataaggaagccaagcccggagcggcggagcccgaggtcggtgtcccctcgtcattgtctccctcctcaccttcttcttcttggactgagactgatgtggaggagcgtgtctacaccccgtccaatgccgacatcgggctaaggctcaagcttcactgcaccccaggcgatgggcagcgctttgggcacagccgggagttggaaagtgtgtgtgtggtagaggctgggcctggcacctgcacttttgaccaccggcatctctacacgaagaaggtgactgaggacgctctcatccgcactgtctcttacaacatcctggcagacacgtacgcgcagactgagttctcgcgaacggttctgtacccatactgtgccccctacgccctggagctcgactaccgccagaaccttatccagaaggaactcaccggctacaacgccgatgtcatctgtttgcaggaggttgaccgcgcagtgttttctgacagcttggtacccgccctagaggccttcgggctcgagggggtgtttcgaatcaagcagcacgaaggcctggccactttctaccgaaagtctaagttcagccttcttagccagcatgacatttcattctacgaagccctcgagtccgacccacttcacaaagaactgctggagaaactagttttgtacccatcagcgcaggagaaggtgctccagagatcttctgttcttcaggtaaagtagttccgcccgtctcttcacatactgtcccacttttaggggccaggaaggcgaggaatgaggtgggggt

SEQ ID NO: 106200 - DNA, 1175 bp, Homo sapiens
aaaaaactcaaaaaaacaaacaaacaaacaaaaacattcaggagatttgcaaatgccaactgaactcttggcactttccgtttattttaggtttcagttcttcagtctacaaaggactcttctaaaaggatatgtgttgctaatacccatctttactggcatcctaaaggtaggttttatttggtatcacaagtgacttaaacacgcttaaagttgtttaaagtgttttacacaaatgcatatcttgaacgtcacccagagactgtaatttgtgtagtttttcttttttaacttaaagacaactttaaaaaatacttacattaatgttttttatattcataggtgggtatattcgcctcattcaaatggcagtagccttggctcacataagacatgtttcatgtgatctgtatcctggcataccagttatattttgtggggactttaatagtacaccatcaacaggaatgtatcattttgtcatcaatggcagcattccagaggatcatgaagactgggcttccaatggggaggaggaaagatgcaatatgtctcttacacatttcttcaagctgaaaagtgcttgtggtgaacctgcttacacaaattatgttggtggctttcatggatgtctagattacattttcattgacttaaatgctttagaggttgaacaggtgattccattacctagtcatgaagaagttaccacccaccaggccttacctagtgtttcccatccctctgatcacatagcacttgtatgtgatttaaaatggaaatagatgtgtgtttaatggaattgaagtctgaaaaggaagtagttattttagcagaaaatttaatatgaatcaaagcttatatgtaaacttcaaggaggaatggtaaaatgttcagccctcctagttatgttcctgatgtcttcgttatgaaactgttgatgtttgcatcatacatcttctctttccttgttttcctctacaattggaggagaaacaaatatatttcttactagcaaaatagaaaattgaattatttttctccaaattgagactctcagaaaaggaagattgaattagcgtgttttttgtttgtttgtttttgtttttgtttttgtttttttgagatggagtttcactcttgttgcccaggctggagtgcaatggcacaatctc

SEQ ID NO: 106201 - DNA, 1786 bp, Homo sapiens
aaagggaaccaaaaaccagcactgaaaagaaagctgaatgaggggggaaaatcttgtctaaatataatgaataggtagaagtagcttgattgattgagacggagtctcactctgtcgcccaggctggagtgcagtggcacagcctcggctcactgcaacctccagaataggtagaagtggctttatttttaaaaaataatttaatctaaaaaagtagagacaaagtctcaccatgttacccaggctggtctcgaactactaagctcaagtgatcctcccatctccgcctcccaaagtgctgggatttataggtgtgagccaccacgcccagccagaagtagctttaaatatgggagagttttgtgagatgcaagaggtgtgaaaagactcttaagtttgattaagaaagtttaaacactggtgttatatattaactttgttaatcaagtattttcttgtcttctctttacagtggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaattgtgtgtgttctttttgagttttgaaggtatttgaaatgtattttcttatgtagccaactttgcttgcatattttatgtactgtgaacagtaacacagatcccactggtaggttactaattgtataaagtggagatctagattgttttcatgtgtataacagcatggggaacactattaaaaacatagttttctaaagtcagatcaagggtaaaaggagggcctggcatggtggctcacgcctgtaatcctagcactttaggaggttgaggcaggagggtcacttgagaataggagtttgagatcagctttggcaatgtagtaagaccctgtttcccctgtctctacttaaaaaactaaaaacaaaacaacaacaac

SEQ ID NO: 106202 - DNA, 1054 bp, Homo sapiens
atgacctttcgccatgttgcccaggctggtctcaaactcctgagttcaagcaatttcaggcctgatcgtttgcctcagcctcccaaagtgctgggattacaggatgagccaccatgcctggccaaattcacgattctttaggatccttgatttgttatttttctttttgttcctactttgtggctattttggtacctgcacttaaatgtgagagtgcagagggaaggggaaaaatagatacaatttattcttagggtagttgagaaaagtaattaattggtgaagaataaaaattttttagatttgaaatagcactaataaattaaacttacaaatagttctcaaatcagcttttagcattacagccttaagttcttacttttaaagagacattttcttcctaatgtctaaccattggtaccattttgctgcctacactgtttcatatagagagtgtcgtttaactgttaaaatttactgaaacaatttttccccagggtcttatttttgtggtagatagcaacgatcgtgaaagaattcaggaagtagcagatgagctgcagaaaatggtaagaaatatactttaaattcatcattttcaaggtgtgcttttctggattaaactggtggtggtttagtacattttgactatgattagattacacaaatggattgggggggctagaaataaacttaagaaactatattatccacaggttcttaataatgtacttcaaaatctcttatagagcgttttaaaaaacacatggaagagtagctacttcagtaagttgggaggaaggcagagcagtgttgttttttttttttttagaatgcctcatgggtaatcttgatgcctatctctggctgaggatatctgatttagctcagtcccttactttacagatatcaaatctatagtgctgtagtggttttgaccctaggaatcttggttcagatgttttgttcccaaggtcatcggttccattttctctatgctgtgccaataattacttcagaaatgttttttaatagtaaccatttaaggataagg

SEQ ID NO: 106203 - DNA, 1020 bp, Homo sapiens
aaaccttgctaatccttaagcctaataattcttgaccaagggtaaccctgggtttatccctagatttgtttagaatgctttgtaatttactttgcattcttaatttgaaattagacccaattctggcctctttggaccatctgagaattaaaagtctaagtactgcttcctagggagttcatgctagctggggaaagctttatgtgttacctgatagaatcaaagctaagctcttagcttgcattcccagcattactgatcagttctcctagctataaaatttaaaagaaactatagctttaaccatgtttctaacttatactaacaaaccatggcacagtgtgtagtaaattcctcttataattccaactaatttgccattgtaaataagtaaatatttggcttttcaaataatttcatagcagctgggcttatctgtagaatcctagcttttcttcactcttgattctaggctgttccaggaagaaaataattagggattaatacctaaaataattctccttctcaataatgtcactttgggactgatagcattatttgcattttaaaacaaaggctgggtgcagtggcttatgcctgtactctcagcactttgggaggctgaggtgggaggatcgcttgagctcaggagtttgaggccagcctggggaacatagtgagaccctgtctttacatttaaaaaaaaaaaaaaagaataaaaatgggaagttagcagtcaaaataaaattaggtcccttttaggggcattacctcttgtaaagggtaggtttcaggaccgggtgctatggcttatgcctgaaacaccaacactttgggaggccatgatacgaggatcacttgaggccagtccaggcaacagagtgaaaccctgtctctacaaaaaaaaattaaaaaaaaattacctgggcatggtggcatactcctgtagtcccagctacttgagaggctgaggtgggaggatcacctgagcacaggagttggaggctgaagtgagctaca

SEQ ID NO: 106204 - DNA, 1948 bp, Homo sapiens
gctgaggcaggagaattgctcgaacccgggaggtggaggttacagtgagctgagatcatgccacttcactcccgcctggacaacagagcgagaatacgtccccccgctcccctgcccctccaccccccaaaaaatgctggtagttcatagaatttaattggaagagatcttagatgatctgatccagtccctttatttatggctaatttctctggtctcagtgtcctaaagtcactcaactagtttgtcgcaaagctagagattagagcctaagtcagctacatacttgttaccttttactagtacatgctgtctctcttggtctagaaagcagaatggaaaggctttctgtaggaagtgttgcctttgggaatcagaaataaggtcatttcatttctaactcatttagaagttgtcttgaacagtcaacttctagttttgaactataaatttattgtaaaattatttcttggagtgtgcttttggtctggattttaaatctataatgtcttcttctagttggattggatgctgctggcaagacaaccattctgtataaactgaagttaggggagatagtcaccaccattcctaccattggtaagaaagtttacagatgactttatatcatgatatgttgtaaagtgaaatatatacagtctagttttgagattgtctttttgttaagcatgttgattatcttagaagtacttttaaaacaggccgggtgtggtggctcatgcctgtaatcccagcactttgggaggccgaggcgggtggattgcttgagcccaggagttcaagaccagcctgcataacataatgaggccttgtctctgttgatgtttaggcttaaatatattttttaaaaataaaaagaagtactttaaaaacactattctaagaaaattccacaataaaaggttttattttcttaatgacgctgcacagcggtcatttttgtttttctttgtaggttttaatgtggaaacagtagaatataagaacatttgtttcacagtatgggatgttggtggtcaagatagaattaggcctctctggaagcattacttccagaatacccaggtaagggatactgtatgtttttataacttttctttgtgggtttcatgctctaaagtttttattagtatctagtatttacttggatattggtgtttactatgagttggcatttgtcttatcaccacttccacattcttcagtggactctcacttaggccttgaaggctaacttatatagggtggaagagttgtaaagcaattgcggtaagtgtttggaagatggggtgggtgctggtgtagttcacaagaatgaattaggtctcttatccgtagttctttgctttccatcttagtttagaaagtaaggtctgtataaactgtcattgtagtttctgatgaatgtaagacaattgatagtcctttgtttagcccagttacttgtttactttattaaatacagtaaagtcagttcgctgcattgatttgtaagatatttttatattgccacatagtatgtatatataatactggcatggaagagactttagtgatcctgtagaacaggagttctcaaatttgggggtggcacgtaagaatcacatggggacctttgaaaatcccaagacctggatcatcccctagatgacttgaatcagaatatcaggggatataatccaggtacagtagtgtttcttaaactttaatatgcatatcaatcacctgggtatttgttaaaaatacacattgagtccataggtcctagctaaggcctgagattctgtatttctagcaagttctcgggttgtgctgatactactggtctggtatcttacagcacagcactattgacattttgggctgggttattctttgttgttgggtatggggagggctctctatgcattgtaggttgtttagtggc

SEQ ID NO: 106205 - DNA, 1019 bp, Homo sapiens
actatcttgcctgttcttgggctgaagcgatcccgcccacctcggcctcgaaaagtgctagggttacagggcgagccactgagcctggctgcattgtcctattttaagtctggtttctgtatcttgatccatgataagatgtaatgttgttaagtgaatccttaaattatgtatatatccaaaaatactaatgtgttctgcagaggaattactaattctgatctctttactttgaactttccagttcttgcctgttgaaaagctgaaaaagtgttacttttaaaaagtttgctgatatcagtgtagtgtagtatgccagtgtagttctgtattgtcttgaatgtgactgtggttttgggggtctagagatgttcaggagaaaggatcctatatttgtcactttaaaaaatattaccaagctaaagagtggtgttttatatttgtttcttagcatattttgtaaatccatctatttatgtaatttttttatgtttttcctcttgattctaaaagtagtatgtgttccttctgttacatttagaaaacaggtaaaagaataaagtgataattacctatctgtaattccactattctgtcatatttactctcagccttatttttatttttattttttgagacagggttttgctctgtcacccatactctggggcacatacaggtggcatgatcatagctcactgtagccttgaactcctggattcaagcaatccctcctgccttaggctctggagtagctaggactacaggcgccactatgcccggctaatttttaaattattttgtagagaatgggggtcttgctctgttgcccagctgatctcaaactcctgggctcaagaggtcctcctgcctcgacctcccaaagtgctaggatgacaggtgtaagccaccacacctggtacacgctcagccttttaagaggaagtttttgttcctctaaaattgtagttgtgatgtttagttttgtgtcctctctttttgatttagcttattacaag

SEQ ID NO: 106206 - DNA, 1091 bp, Homo sapiens
ctgcaacctccacctcccgggttcaagagattctcctgcctcagcctcccgagtagctgggattacaggcatgcaacaccacgcctggctaattttttgtattattagtagagacgggggtttcaccacgttggccagtctggtctcgaactcctcacctcaggtgatccacccacccaggcttcccagagtgctgggattacaggcgtgagccaccgcgcccggccggaggttttattttagagctgtactaccatcaaaacttgcaaacacaagcttctgtaatatttcaaggtatataaagagtaacagtatatacattggctcatgtttattttcctcttagcgtacttacactttgtgaatcaattgtttatgagtcattcataaagtattttttctttcaaagtttcttagatttcctttgtcaagaggacagaattattttaggagggcaagcatatttaagttttcagtggctgaaagttggcagtctgaaaaaggatcggaagttaatgggaggacttcggactgtgataaatgaatttccagtctgttcgttaaagagatttaacaatatatggttatgttccagaacacatagtatattggtctttttacttaagatttattgtaaatgaattgctatttttcaattccttagtcttttgtgattgatgaaagtatcagaggggcaaggaatatagaagtatgctaccagcattttcatatatttactatattgggaggcatttccctccaccccaaaaaatgattcgaagaaaatgggagagaaaaaatatttaagtttctgcatttgtgtggaggatttaggagttacttgtttttaatgttttattactcaggcatgctatcgttttgcactttaattttgggataatcagttttccttgactaaaaaacacttcagtcacaagatcgacatttatggtaactcatcaaaggaagtatcaacgtacgagggagatatgtgcatgaacagggaaaaaggtggtttggaagtttgataattcttacatttttctgtctggctttatgagtgactgacagcaaaaataatagatcacttt

SEQ ID NO: 106207 - DNA, 1052 bp, Homo sapiens
agtagctgggattacaggtatgtgccaccacgcctggctaattttgtatttttagtagagatggggtttctccatgttggtcaggctggtctcaaactcccgacctcaggtgatccgcccgcctcggcctcccaaagtgctgggattacaggtgtgagccaccgcacctggccagaagccactaactaaaataggcacacatgacacagcatgtggttaatagctgtgtcttgaattatcctctaaataaccaaatttagttgtatgtatttgtaaaggatatggcttcagaagctatcttttgttctctgtcgatataactcttaagggcattcctgacccaagaaagactccttgcgtttgtaactgtggtctaatacccaaatgtgccctgttcttatggatacagtctcttgaagcatacctcaaagtcatagagagaatatggcatttgaaagaaatcgtttgccttggatcatatgagttattttgtgaaacaacagctgacttttcagaaaaggagcaactacttttatatgctaaaagtatttcataactttctgggaaaccttatttaggtataaatggtcatcttattatttttcaaaaaggtatattttaataattgtacaatttatatacagtttgtgaccagaatttgtaagttgttggtgtcatatcaaggatcttttaaattatgccactacaggatgtatcatttcaagtctattttgcacagctaaacagtagcaaaagatgccaattagcatgataatggtgtcttcatttttactgtatttaactgaaacctaacacatgttgaaaaccatatcatacctagtttatctcttaatttcaaactatgtacttgtaaaaatgatgtaaatttgcactgggaacctgggaaagagtgactgataatttttggtgcgtgatttttagatttgtctttttttttttaagaagaatttgttactatgtaaaccctgacattaaatgttttatctctaccagcatcaggaggaatcactgctttaagggtattatgtaat

SEQ ID NO: 106208 - DNA, 1661 bp, Homo sapiens
atgcacctgcaacataagcccaggaagagcatatccgaaaacacgaagtgtacatccagtagtaaattcatgttcagttctcttgatttgttaactaatgttccttataaattagtcactacttagtggaagtgggggttactgttacagtttgagctgcaattttgtttttcttgcttgatctaaaaaagccacctcagtacattttgttttacttccaaatatgagacaattattctggctaatgcagaaaattatctaacagttattagaatattatgagaattattcttgcactataatgctatatctgggttaaatactttgttctccttttccttcttgtctttccttcacagtagccttacctattgaaatagagaggtttgaatattattttgagaacttactgatttgggactttatttattctaggacttacttctctggatccagaaacacacagaagtagaaacagtagaccttgtcttgaagctgaaaaataagctggtatgtagccaaaacagccaaagattaaattgacttttctttgaagacattgtcctctcatgtgagctgacaacccatgatagttcgcagaagtaactttttaaatgagagggcttgaaattggtcaattgatggtagatactgctgaaaatacttggtcactgaaacagaccataatgatgccatattattctaacgttatgtatatagaatctaataagctctataaaaacattgtcacttatatttctaggtattattatgaatttacatagaagccttttattgagctcaataacgaattgtttaaatagaatgctccttgcttttttagtttctgtaatttctggtctaagactgaaagtatctaattgttagacctttaaaatggtttatttagagaatgtaatgtattaatacagattctgaggataatttaaatgttatgaaatgttccttatgtagttgcaggctgatcgagagcacttacctgtgaaacctgacactatggaaaagttacggacacacatagatgccattatcttagcattgccagaggacttgcaaggcatactgctcaaaacgggcatgacatgatatttgccaagattttccagccaaaaaggattatgcatcatgaagcatactgacatttcaaccagacgcacaaaggagatctctcagtggcagcggagtggaaaattgccatgaatgctagttacagggtagaaagactgtattgtataaacagacctttttagtgcattactttttaaagtggatatctgtggtggttccactttaatactgaaacaccgaaaggcatttctatatttttaatcatgttctaaagtgctcttatgagagacttgtgggccatcagtattagtgatttcatactgcagtgctggcattgcagatatttttttaaattggtgctgctttgcccaatcatgttaaaactcagggggatataaaaataacattcacactggctatcttcttaagaacagaaagactgaactgtcctatggttagaaggaattgatgcttatgtagtgccttctgttgtcctacatgtttcacagttcagctgctagtcttgaagcttttccttagcttcattatgatacgtaattttataaggtatt

SEQ ID NO: 106209 - DNA, 1090 bp, Homo sapiens
ccaggcatggtggcacgcacctgtagtcccagctgctctagaggctgaggcaggagaatcacttgaacccgggaggcggaggttgcagtgagctgagatcgcgccactgcactcagcctgggcgaaagagtgagactccgtctcaaaaaaaaaaaaaaaaaggccgggcgcggtggctcacgcctgtaatcccagcactttgggaggccgaggcgggcggatcacgaggtcaggagatcaagaccatcctggctaacacggtgaaaccccgtctctactaaaaatacaaaaaattagccgggcgtggtggtgggcgcctgtaatcccagctactcgggaggctgaggcaggagaatggcatgaacccaagaggcagagcttgcagtgagccgggatagcgccactgcagtccagcttgggcgaaagagtgagactccgtctcaaaaaaaaaaaaaaaaaaaaaaaagagagcagagaccaaagtcaagtagacctcatttcaagtctaaattgtattaccttggtcaggttatttagccttttgaagaagcctcagtttcctaataatacctaccacataggatcattccaaggattacaagagatcatgcatgtaaaatgttgagtgcattatctggcctatagttgctcagtaaggttaactattatcgttaaaaaatggaccgcgttgttgggcgcggtagttcacgcctgtaatcccagcactttgggaggctgaggcaggtggatcatgaggtcaggagttcgagaccagcctgaccaacatggtaaaaccccatctctactaaaaatacaaaattagccaggcgtggtggcgcacgcctgtaatcccagctgcttgggagactgaggcgggagaatcgcttgaacccggggggcagaggttgtagtgagccgagatcatgccattgcactccagcctgcgcaacagaacaaggctctgtctcaaaaaagaaaaaatgtagtccccttggtttatctaagatttagttgaatttttatttgaaatctgacttcccaagtcagtctaaatttagctatatctcttgtggggagtgatggagttgtt

SEQ ID NO: 106210 - DNA, 1071 bp, Homo sapiens
cgcgatcttggctcactgcaacctccacctcctgggttcaagtgattctcctgcctcagcctccccagtagctgggattacaggcgcctgccaccacacctggctaatttttgtatttttagtagagatggggtttcaccgtgttggccaggttggtctcgaactcctgacctcaggtgatctgcccacctcggccttcccaaagggctgggattacaggcgtgagccaccgcgcctggccgattgatctttctaataagtgctttttctttcatgcggcattcctccacttggttatctggtagtttccctttgcctgtaagataacatctaaacttcttagcatactaacatggctctaatgatcgggcaacaatattctcatttctgactattcatcctttctgcttttgctccaggaatgctaaactctgtgtagttctacagacaggccataatgtcacttcattgctttgcacatagtttgttctgcatcactcttccctctctcatccacttggcaaaaaacgcccactcatctttcacgtcttcctgtaaatattacctccttggtgaggctgtcctttaatcccctggtagacataggttctcctttgtgattattatgctttttttttttttttttttttgagacagagtctcactctgctgcccaggctggagtgcagtgatgcaatctcagctcactgcaacctccgcctcctggtttcaagcaattctcctgcctcagcctcctgagtagctgggattacaggtgcccaccagtacgcccagctaattttttgtaattttagtagagatggggtttcaccatgttggccaggttggcctcgaactcctaacctcgtgatctgcccgcctcagcctccgaaagtgctgggattacaggcgtgaatcaccgcgctcggctaattgttgtgcattttaaaccaccttcactgtcttctaattttggcatcataactgggtgtgtatatctttcttcctgtgtgctgctggaaggaccgtgtcctttcgtctttttatgtctagtgtaaaacgtgttgcctg

SEQ ID NO: 106211 - DNA, 1050 bp, Homo sapiens
gtattgggttttaagttaagtatatccaataagtgcccttggaaaattaatttttcttatttccttaaaaatatttaggattgaaattcaaagtatcaaagcaatattgataaaatagatcgatcatatggtacaacaatttgagaattatatgcttttattgtcagttattctgtgtgtcaatatattacatttaattttgtaaaaattaggatgagtcaaattgatagatatttttatgtggataaaagggacttatgtctctatacatcaccatattctaaatgaatttgtgtatcagatcaggatacaaatagcaggaagaatttatatcaatgtggagtttttagaaagattatgtaggaattttaaaaacaggattggctacattaaaaagtatttctactgtgcatcacctttcaggtgtttctgcccagttttccttcatagtcagatgctctgggagctggtgctgttgggggagccccttgtggttatggcgccatcaccatcggaatcatcagagactgtattggcacttgttaagtgagtctatttggttactatttctgggttttttttttggatgctgcagtacttaacctgttggtgatatttgcagcacttcccacctgtcgtatttttccccacccattattgcattgatccatgcaaaaaccctatcagaaggtaatgcttattatagcaccattttatggatgagaaaattgattcaggctccctgagggctggaaccatgcctttgttgttctgagtggcaggcacattgattcattacatgaagttgttccttgataaatattacttgtgtgaatgatcagtgtagagtcaaaggcacatagctagtgaacagtagagccagaatttcaccgcatcttctgccccaaacccagtgtgttctttcagtatgccatttcacattacatatatctgtctttctaattctgtgaaatgagtttaccatttattaaaataaacaaagtatccctttgtgtgtataccgtttgtatagatgttttctagttatag

SEQ ID NO: 106212 - DNA, 1053 bp, Homo sapiens
tttttaatattttttgtagggatgggatttcactctgttacccaggctggtctcgaactcctggcatcaagtgatcctccttcctggattcccaaagtgctaggattacaggcatgagcttgggattaattctttttttttttttgagatggagtctcgctctgtcacctaggctgcagtgcagtggtgcaatctcggctcactgcaagcttcacctcccgggttcacgccattctcctgcctcagcctcccgagtagctgggactacaggcgcctgcccccatgcctggctaattttttgtatttttagtagagatgggatttcaccgtgttagccaggatggtctcgatatcctgaccttgtgatccgcccgccttgtcctaccaaagtgctgggattacaggcatgagctgtcatgcctggccgggattaattctttatccatgttatctgcattatttttgattttctgctatattagggaatattggtaagacccattccctctctggctgttcctaaaggaagagaatcttaaaagttagacagggcagcatggcttattgatcatgagatagatatattttaaaattttccataaattttggtgataccttcttttatttttcttttctatctctcaggtggacacaaatatatctgttattttacctactgttcatgaggtggatattttcaggtaaagaataaaaaattttattaactgacttccttttgctttgtggtggtggtgttaatttatttaaaaaatgaatattatataggatgtggaaaaaattggaagaaaatagttatgttttacatgttataaatcaatggttcatccctgggtacatgttataagctttgacaattagggaaatttaaatatagaatatgtattatatgtaaaaatatttttgtttggtttagtgtgagaattatattgtaataatgttagaaaacatgcttttttaaaaaagagatgcattttatttgggagtgaaatgtcatgatgtttgtgttctattttaaaatacttcagtaagaaa

SEQ ID NO: 106213 - DNA, 1025 bp, Homo sapiens
gagtatgaattaataaaaattaagagaaattgggaaagccattggttcttagtcctaagtgatgttcttaacacgtgatgtcagaccacacatgttcatcccagggttttgttctctgttagatttttcttttaaatgaattagcattttgctctcagactttgtataggttgtaccctaagtgctttgcaagtcactgtcgagtaggacttatttttgacaatgttctctctctgcatttggccatttttgtaggatctgtattgtgtttttccttgggaaatcatcaaaagtaatactgatagttctggattgagtgttctcattgtttcctgtgagatttatccaaaaatttggcaagcttgagagggtgtgtttgggtgtgtgtatattaatgaagcaaagatttgaacaataaacaggaagcagtatgaagctgatgtccattttgtttttcaacatacttgcttctcagggagttagtgattactgtgtgtgtgtgggtatggagaccttgatttacttactttctgctgtgactaaaaataaatatgaccttagtttttaactctgacatagataattttgtttttgtagcttttttggcattactgaccatacctttttagcagcaggatacagcacttctcatcctccattcttttataaccaaaaataatttcctgtctttcttttaggtacggattcccacatgtcatgacaagcctgggacaactcaaatagtgcagttaactcagcaggtagtgtggtactatggtagaatgatccagcacatatatagtctctttaacagaatttttaaactagcaaatgcagagtttcttgagtttattacatatttctgaatattactgaaatgtcccattaaataatttttaatgaattggtaatatattttctaatgtttcttagggtcttttttcttgttatttctccagtagagactggagaactcagaatttatattttaattgtgaggaaaaggggaaagtgaatttttttca

SEQ ID NO: 106214 - DNA, 1699 bp, Homo sapiens
attttagactaatgttatatatatatatttttttgtttgtttgtttgatttgagacggggtcttgctctgtcacccaggctggagtgcagtggcatgatctcggcttactacgatctctgtctcccgggttcaagtgatcctcctgcctcagcctcccgagtaggtgggactacaggtgcatgccaccacacctggctaatttttgtaattttagtagagacggggtttcggcatgttggccaggttggtcttaaacacctgacctcaagtgatccgcctgccttgggctcccaaagtgctgggattaccagcgtgagccaccgtgcctggcctataatatgtttataactaatgtttataatatgtttaacaaaatttaactcttttcttccaggtaatttatcctcagcattccaaacttactgacagagaagtaagtaaaaatactgctctgtatagtttactgttatatttctgtttgtttttattgattatgtatgtgtcagcatacatcacttttgttttctttttcagaaaaccaatatttgctatttgtcttttccagattcaaattcaggtaactgtttttcatacagtgtttctgtttaattttatactaagaatactggttatactgttaatgtatgaaaattgattgaaatagcatattagattgcaaacagatcaatgatttttattcctattttaatgatgcctagtcatgtcatcgttgattttagtagcttcaactcttaaaataactgttatggtgtgatgaggtaaaccatcaaggaacaataaactcttaaaatagtgaagaggttgaaaatcagcgacattggtatatttgggattcgtggagtatgtattaaatagtttatatagtatgtagtttactttcagttcagaatttgggagcttaccaggaactctgtaaaagcagtgaacctaaaaaaagccaggataaatttggttaggaagcaaggccataagttacgtgcagtagtttatatgggttaatataggtaaagccttggcgtagtgcttggtgtatagaaaaaaacatacaagggtctgtttattgttgagcttggttttgttagtctctttcaagctcttccttttgtgtggtcctaatcgttgacatccttcaggttacctcttgtgtttcactttcaaactagcttttcttggcttatagtgaccaaaacatttagcttctcaggccacacacagttataaccctatagcagagacagtctagttttctttccttttgtggttacttcctttttttttttttgagatggagtctcgctctgtcacccaggctggagtgcagtgacgcgatctcagctcactgcaagctccgcctcccgggttcacaccattctctcacctcagcctcccgagtagctgggaccacaggcgcctgccaccagtcccggctaattttttgtttttgtatttttagtagagacggggtttcaccatgttagccaggatggtctcgatctcttgacctcgtgatctgcccacctcggcctcccaaagtcctgggattacaggcgtgagccaccacacccggccggttacttctaatattgtgctagttagttcatttaatctgatttgagagatttgacagttaaacaaaattttttttagcattttctcctttctgtataaatgcttcca

SEQ ID NO: 106215 - DNA, 1014 bp, Homo sapiens
tgccattctcctgccttagcctcccgagtagctgggactacaggtgcccgccaccacgcctggctaatttttatgtttttagtagagacggggtttcactgtgttagccaggatggtgtcgatctcctgacctcgtgatctgcctgccttagcctcccaaagtgctgggattacaggtgtgagccaccgtggcctggctaatttttaaacttttttgaggagacagagtctcactatgttgtccaggcttgtttttactttttggctattatgaataatgctaatatgaaaatttgtgtacgagtttttgtgtgaacatgtgttttcacttttcttggatatatacctagcattgaaattgcagggctatactgtaactctatgttgtaacttcttgagaaacttccataactgttttccactactgatatatgagggttctaagggttctaatttctctgcatccttatcaactcttgttattgtctctccttttgattacagctgtcctagtaggtatgagccatgtcttattgtaattttatttgcatttccctaataactaatgctaaacagtgttttttcagtgcttattggccattttcatttttattttttggagaagtatctattaacatttgtgcccatttgaaaattgggttatttgtctttttattgttatattttaagagttctttatgtattttatatactagacccttattagttatattaattgtgtcttagcctgttcaggcttctcacaaaataccacaaactgggcagcttataaacaatatctgtttatttctcatagctctggaggctcacaagtccaagatcaaggtactggctgatatggggtttggtgagggtactctttctgattcatagatggcaccttctggcagtgtctttgcatggtggagagctagctctcgggtctctttgataagagcattaatctcaatcatgagggctctgccctcacgacttgatcgcctcccaaaggtt

SEQ ID NO: 106216 - DNA, 2032 bp, Homo sapiens
tatgcttagacaatgtgcagtttgtgttaatttaaaattttgggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaaggtaatgtcaccacattgtccagcggcattgtttaacaaactttttttccccttttgccctccctgagaggactaatgtatgcaggatcccagggtttgcatccagaggaggctttgcgcaaagccacgaatcaactgtttgtgtgcctggttctagtggaaatttgattgaggtggttgaatggaaaacagagaaggtattgtaattaaaagcctcaggagggctatggcatcttgataacgtggtcattcccagtgaaatcccaaactagatagtgaaacttggcgtcttgcttttagtctgtttagaaaggtgaattcacagttcagcgctttattaagcaagcagcagttctcgaagcaattcggggaatccgtggccattattatcccggggctcaagtgtcttagtggtgaaatgtagttaacacatagctttaggtgagttcagatcaggacctttctagtaaggataattgctgatataaacctaagatttttgaaaggtttgatacatacttgcccttggaggagtaatttgcaataatcaaagctaatttaattaagcatgaacaactgtaactttatatattttcagagttttttttacaagttggagaacatacacatattgcgtttgaaaatcactttttgatgttccctgcagcacttattaagtacttaatgcatacttacagaggtgctattcaaaagttagtgttaggaaataaacttactttctgaaattataccctattctgtcaattatagcattacttaaatgtgatacgatgaattcagtgcttttcattttaagcgtaaccaatttagtatttttatgttagtatcgtaagttactatacatgtatgtgcttttattttaagaagtgaagaaagaaattaagatcctttccatttttaaaaactgtttatttatgtttgtggagagtatactaaagagctcatctttgtgcctaaacctcaggtttttagctgagctactgaatcagttccaactttaagttatgtaagactaataggactgtctcaggtttcacctcctgactttttgcccctctttctgagttaaataattaaatctttcttaaaggaagaacttaagtcttcaagaatatgttttgaaatgaaagaaacctgagcctcaaaaggaagagaaaaaaatgatacttcggcagctactgatttaaggaattattttgtaaattattttttaaagaaaggaggaaaagattgtccaagtgctgtgtgctgcataatatctatactttacgtgtaggatgagaactgaagagtatgttaacttttctgtttaacaccagatcctcatttacctgtggaacagacccttcactcgctcctcgcaagctgaagttagggtgcctaaaatacttcatagattactcgtaatcctttttttttttttttgagacagatttttgctcctgtcacccaggctggagtgcagtggcgctatctcagatcactgcaacctctgcctcccgggttcaagtgattctcctgcctcagcctccaaagtagctggtattacaggcacacgccaccatgcctggttaattttgtatttttagtagagacagggtttcaccatgttggccaggcggtcttgaactcctgacctcagttgatccacctgcctcaacctcccaaagtgctggga

SEQ ID NO: 106217 - DNA, 1529 bp, Homo sapiens
ttattctttttggtaagtagggaagagaatgtcatttagagttttaagtgaaaagattgtgaagttaactcttaatatatgtcagttacttcatagttacttgaatcaagaaaaatggtggcatttattagcggctgaaacgttctaagtttacagtccagactctttcctcttctcaggtacatgcttctcttactgacactatataggtagataaatagttacacctttgcttaaaaatctttgacgttgcctcattaatttttagcattaaaatctatatcttattttctttttttctagctctctcttttattactgttttttcttcaccccaaactttgtgtactagctgtatgacagtgttcactgtttctagaacaagtgcctttttttgctgttttgtcttctagaatgacctcttcttgtcatcccttaaggctcagttccaatgtgaaaccttccctgactccctttaactgaagaattaattgcttcttcctctatacttccatttaactttgtgtataatttctttatttcttttttttaaatttatttttatttttatttttgagacagggtccctctctgtcacccaggctagagtgtagtggtgtgatcttggcttactgcagcctccacctcatgggttcaagcagttctcctgcctcagcctctcaagtagctgggatgacaggcaccccccagcacacctggctaatttttgtatttttagtagagatgggatttcaccatgttgcccaggctgatctcgaactcctggcctcaagcaatccacctgcctcagcctcccaaagtgctgggattacaggtgtgagccactgcacccggcctgtatataatttcattatgggacataaacaacaaaataactatgatgcaaatgtactactgtcccatcagatgtgaactcttgagagcaagagaataggcactacattcatgtttgaatgagggaaatgtgaacaatggagcggtttgtatttctgcaaacctgtgcagtgttaaagggcagaaagtcattcaagttagttctcaatttgagatcatggactcaattatcaatatgtagtctttgtataagtcattatttattgagagcttgcagtttgcaaaacattttgctaagtgtttttggatcgtagatccaaatcttgtgattggtgatatgaaattatatatatgaactattacaatttcacacaaaataattttaaaaggttttagaataatcagagtgctttcttgtttcatttggtctatataacactcttagaaggtaagtaaaacagctgcagtctggctcgcttttgtccaaaaagagtttgatgtttagaggttatttgtacaagatcatctagtggtaactatgggagtttttttccccccaaaatgaaagccaactattagacatttattctgaactgtcttcttagggactgagcaattattatgaaaatctgtcttttgctctcttgaaaggtaatctaagctattgctttttg

SEQ ID NO: 106218 - DNA, 1100 bp, Homo sapiens
tgtggaagacattggctttgtgcctagaggcaaggggacttgtagagtgattcagtaaagaggacagttagaggtaaattcttggtgtgtagccaaatcatctggatagagggagatagacttgggagttatcagcccatgtagtgaaggttacaggaaatacactcccagggaagtttgtatatcgctagaaaagtagaggctggggaagaaccctggggatgaccagcatttgaacagctggcagggaaaaaagaaggcagacttaaaagaccatccagagaagtaggaggatgaggagagattagatttgtgaagtacaaagcaggggagagtttttgagaagagagttgtgaatagccctcaaatgctacattataagagttgaaagtagtccttggacttgtcaggtaggggtctgtctcatcaatggcttgagggctggctgttcagtagagtgatgaatgtggaagctcgccggcagttggttaagaaggcagtgagttagggagtgtgacagggagtgtgacagttctgtacatgcattactataagtggatccggagagtaattaagttatttccataagaaaggtagtgtttgtatacttcagtgatgatcatttgtttttctccagttttaattgttgctgctcccaaggagcctgtggtgattctgcccttgtatgtcgggggaaatgtggcattaaaaaagcagtacaggtcaggcactctctgtccagattaatttctcaatagagttatgtgtaaattgaaatcttactgagttgaataagtttgtgcaaatgggatgttggtaaggaaaaaattattcaatgacacttgttaaagcatggtaaggaagatttattcaggaccattgagataggtatagaaaccactgcagtggggtgtggggattgcggggcgagggtagagagagactgggctcactctgaatacagcatgggcaattgggaatctatagccaaggatcagtgtgagggtaagtggttggaaaattactaagaggaaacatcaggggtaagggggattctggctaaatcgacctaacaggattcttggtggagtcaggccagg

SEQ ID NO: 106219 - DNA, 2129 bp, Homo sapiens
ctacagcaataaatattttatacatttgttggttatactaaattaacaaaatcaaattagtgctagtgctagagaggttgtgatgacattaactttgttggtctagtctgtgtgccaagcattgttgcaaagccatctagatccttgtagatgtaaaatgttgaaataactttcatttttgtttccttgaatgtaatttaaatgttttagtactgtataaataaaggaagaaataaaccaaaagataaaacagttttagattctcccatgtgttgaagtcaaatctggtcatgccttcctctccactctctttttgtctgtctgactcaaactctggaggcacaaatccaacatgggtttttttctttttgggccagagagctgcatgcttgctctgctgtgttttgaatcctgcttttctagctcgcctaaatcctgaatccagttgttctttaatccaatgactcacaccttgggagtttccctcaccccactccaagaaaatgcaattaacttttccatttcaagtaaataattctgtcacgtgctttctactctttaccgattttgctttaggtgctcatctgaaaatatgcttcctgttgactttttaaaagttccttgtagagttcttctgtatgggtgggaccaaatatctgtgaatcactcccagttagtatagcatagtacagtcatcttaagagtaagtgattttttaatttgacagattgtctgccaaaaagtgttaaagtagagccaaaagcaagaacagaaattgactcttgctctatttattttcaccttttctcatcttttttcatctaacatcaaagattatttccatttctgatacacttttattgtatttgtattatttttgtctaattactagcctaggtttctacatcatccatgcttaaatgcttttcgttgttacatagggctgtaagacatttatactgtcagtagttgagtttacttgaagtcataggtgagaaggtaatgtgtgatgattaagaagtcaggaatgataaaataaaaattttctatttgttttatcgtgcttgacaataagttttgacttattaaaaatacattggccaggtgtggtggctcacgcctataatcccagcactttgggaggttgaggcaggaggtcacttgagcctaggagtttgagaccagcctgggcaaaatggtgaaaccttatctctacaaaaaatacaaaagattagctgagtgtagtgttgtgcacttgtagtcccagctacctgggaggctgaggtaggaacatcacctgtgtctgggaggtcgaggctgcagtgagccatgatcatgtcactactttccagcctgggcaacagagtgaagccctgaatcaaaaaaataaaaataaaaagtatatagtaccaatttacttacaataatattaataattttcttcactgtagataatctcctatcactgtaaatgatcttctcctataggtagggatacatctgtgtttgatccttttagtcttttgtactctagattgacttcactactttaagacctcagaaagagatgtcccagtaggttctgctaattttcaaaaagttaatacaacagaattagagagtctagattgttatctgatgtgactttttttaatctcttgtgatctctgttggctttttcaagtcattatggtttctctttgtatactggttggaggtattagcccttgactgtttccctggcctcttggatggtacttttcctgattttccttttacctttttgactatgaaattccttcaagcattttttttcccactgggttttcctcaaatgtgtgttcctaaatgttcagtcattgttttccctgttagtgttatttttggatcatcttatatattagaataattttggtgaccattcaaatgtggatactttttagatatattgaaccctggagtctgaattttctgctgtctgcttacctttacttactagatgtccttatagtgaatctaaaagcaacatatccaaaactgaagtgattcattcactatccaccattgctgcagtatttccaaatacagatactggtattatctgtccagtagcccaggctaccaactgc

SEQ ID NO: 106220 - DNA, 1112 bp, Homo sapiens
gagctgcccgccccactgcagcaggcagcatgcctgtgcacagtggtccgaccccatgctcgcttgcttgcacaccccttgccactccatgcctggcttgccgttggcaggcatgggatccaggctggtagcatgaaccgagtgcagcctgccagcccaagtaggcagaatgagcccagcagacccgagcaaaactcaggcaagggcaccaccagccacagaggtttctggccagaaaagcgacaccccaaggatcctgcaacaatttttctcttattagaaaaattctgttgatttcactttctctattagcattgctcatttatttgcttccatttagagcaaaacttcttaaaagatttatctatatatgcggcctctcattcctctgtgtccattttctttggaatcattctggtaaggcattcatcttccgctacgtccgcactgttcttgccaaggtcgtcggtggctttcagattatttccagtggtcagcgtttgtcccttaccttacttgatctatcagcatcatttgactgttgatctctcccacgttcttggaaaacattattcacatagcttccaggacatatcactttctcttggttcttttcataccttactggccattctttacaatttcctttggttggtcctgttttccatgaccttgaaactttgaactgctccatgtccttggacctgttgtctatctgtacttgttcccttggtgatctcattctgtctcttggctttaaattctgtttatatgctgacgacagcttaatttatatctcaagctgagacttcttcccctgaactctaggctcatatatccagctgcctttaaaaaaatttttattgtgataaaataaatgtaacataaaatttatcattgtagccatttttaagtatacagttcagggtattatatacattcataatgttctgtaaccattatcaccattcatctccataactcttttcatcttgtaaagctgaaggtttttaaatattagacagtaactctccattttttcctccctccagtccctgccagactccattctttctgcctccatgattttggacccctgaaactacctcaaa

SEQ ID NO: 106221 - DNA, 1806 bp, Homo sapiens
atttttaaggatttgtaagtgataaataggtaggcttcttgtgcctcctgctatcctttctgtttttaaagagggagggttacccaagtgatgagaagcaaatttggacaaccatcaccactaattttagaatattttcatcatctcaaaaagaaaccttgtacccatcccattcctacctgccacttcagccttttgtaagcactcatgtactttttgtctgtatagctttgcctattctggatgtttcatataaaatgaatcattataatacatcagtcttttgtgactgacttcttttacttcacataatgttttaaacgttcattcatgttatagcatgttatcaatacttcacccctttattgccaaataatattcagttatatgaatgtctaccacatttgtttattcatttatcagttgatggatagttggattattttccctttttggctattatgaataatgccaacatttgtgtagaagtttttatgagaacatgtttttagttctcttggatgtatacctaggagtggaattgctgagttgtatactaactttatgtttaacattttgaggacctgacaaactctttttccaaagaggttgtaccgttttatgtagctgaattttaaatcacctagttttcagattctaatttcatatatattaaaggagaaccttagctgaaatgagtggtttgaattaataggggaaaaattcacttgcaatagttggcaaagctggaagcatttttttaaaaagtacatttggaattattactattaatatttggcccttttttgtttttgtttttttttgcagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaaggtacgggtatggatcactttttttattacttgtcttttaaaggttatttaattttttattatcttacttgacattatgaaacattacatgcttgtgaaagcgatttaaatacagcattatatacagtgaaaagttaaaagtctcatactttccgtattgctcttctaaaattttaaattctgaagtgttatttagtagtttatattcttcatcacagtcagggaccagtcagctgcaatgacagcataccccaccaagacaagcttaaatcacaggatatttattattgatgatgagacttaatgagagatctggaggcagataggttcatttgttcagttgactcaatgagatcatcagggatccagggtcttactgtcttcctgttctactgtcttaaacattttagtttctcatgcttttggttgttgcttcatggtcataagatgatggctgcaagccccaggcatcattttcctcacaccagtatcctaggcaaaaaggatgaggcggggataaaatgccttcttgtgtggctctcttcttatgttgaaagaacaatcttttgcagaatcctcccagcagatttctccttaggtctcactggccacatgggtagatcgcatacatagttacctgcagctacaaagaagtctggtgaagttacttaatctcgtgaaagggagcaagaagatctatgattgacatagatcagttttgatttattccttcaggttgtgtgtacattgttaccccaaacaaaattagagctctcttagcaagaaagaagatggaaaggtagtagaggtaggcagctaatagtagctatc

SEQ ID NO: 106222 - DNA, 1030 bp, Homo sapiens
ttgttttttgagacaaggtctcactctgttggccaggctggagtgcagtggcacgatttcggttcactgcaagctctgcctcctgggttcttgccattctcctgcctcagcctccctagtagctgggactacaggcacccaccaccacgtccggctaatttttttgtatttttagtagagacaaggtttcactgtgttaaccaggatggtctctctctcctgacctcgtgatctgcctacctcggcctcccaaagtactgggattacaggcgtgagccactgtgcctggcccctaaatctcttttaaaccaagcatttcccaaactcatcagaccctcagatccttttttgtaacacttgctagcattttgggaaatgctgctatgtgtagttgattaatataagtattagaacaaaatattttcatcaggttgctttaattacttgcctgttgcaaatcaaaaggataacatgtctatgcatgtgtgtatctggttgtcatgagaatcacattaaaggcatcgttgactggactaaattgtgagcttagtcagacgtgggttatttttgtttttgttttttaaattgccttcaactgtgcagcaactctgtactgcccagtcaatattagcccttggttcatctcatagatttgcgcatcagctcatttgctgaactttcagggtaatgtgtctgaacaacagaattactgatgttgtatatcacaggttgtcacctctggaactagttttattctataacttgttctacctatttttcttttttaaaaaaacaactttctaccaaattaaagtgtaggtattgctggatcttcatgttgtattatgctcctgtatttattataggctatttatagtgaatgtcttgaggagccatcctctagaaactcatttatcataagagagagaaatccatctcttctgtcttttgcctgggaaaggagaaagctaggtggttcctacaaatagagatgaaccctaatgtcttaaaagtaagaaacatctttgca

SEQ ID NO: 106223 - DNA, 1023 bp, Homo sapiens
ttagtagagaggtttcaccatgttggccaggctggtctcaaactcctgacctcaggtgatccatccactttggcctcccaaagtaccgggattacaggcgtgagccaccatgcccggccaacattagctctattcttaaaattcagttttgttgagatataatttacgtataacacaattttacatgtacaattcagtgagttttgacaaatatatatggtctcataaccaccactcccctaatcatgatgtagtgtattctcatcagcctgcattagtttttaatcagagcttagtgaaataaataattctttgaactctggaaaatgtaatacagtatttgaagaataaagagaaataaaaaaccgtcaaccttcaagccagaaaacaattttttaaaattaaacccacatatagagaaactctgtacaagtgctactttcaggagttttgtctcttaaaatcttcaataggaaaaggaggaagtaagatgcaacagtgagaagctgtctacaaagggactgtactgatgtcattttgggggtggaggaagaaacaactatcaagaaaacaaaacaaaattttaaatattgaaatggaaacatgagacactagcaaacaattctgatacttaatagcagagaattgtggaagcagtttcacttgtctgaggtcttggttttctcacccataaaatgggggattgagtggcatttctcaactgtattatgcagaactttagagttttgtgaggtgtggttaggtgtgtaataggttggggaagggaagatttggaataagaactatattttaaatttgggaatagtcagaccttatgtttgatactggcagatggggaaaagtgtatttccccctcacaattttatttccatatattcaactgactttttattgactattattacagaattggagattaagacacttttcaaaatgattctatccttatttctaccttgaaattgtgattcgttatggacaagatgagtttctccagggtaa

SEQ ID NO: 106224 - DNA, 1120 bp, Homo sapiens
ttgaaaatggataattttttttttttttttttttgagacagagtctcactttgtcacccaggctggagtgcagtggcgcaatcttggctcactgcaacctccacctcctgagttcaagcgattcttatgcttcagcctcctgaggagctgggactaatggtgtgcgccaccacgcccagctaatttttttatatttttagtagagacagggtttcatcatgttgaccaggctggtcttgaactccagacctcaggtgatcctcccgcctcagcctcccaaagtgctggaattacaggcatgagccaccatgcctagccgaaaatggataaagagtactccttttctgtatagaaattcgtataatcaagtaattcatcatatccctcaaaaagtagtggctcctcaaagagcatttaatacattttggatttggaatttgtttttagaactatattgatgtgtacaaggtaggtttacatatttttgttttctaagaattttatacatttatgaaggattgaaaaatagttcacctttttttaattacatgaaggcaaatgtataaactttgtggtgtaagatattctggtgctctcatactctgtttcctctattgtccggatattagataaaacttctaaattttacttttcagtgtcatccatgcaccattaccaagtcctgttgacaaagtaagttgctaatgattattttttccaaactgactcagctatgttgctttgaaaatgtttgtttttaatatgctttacctagaaatttatttctcttttataacaaaatatgtagaatgcatatagctatatagttattataatcttctgatcttcaatatctggagaatctaagatggatgtttcttcagaaaaaggctttgttatctcagttaaattattcactgtgtaaactaggagtacctgttttgtgtctagccagggataaggagtattcgctgttactttttattctgagatacaagtctgtctagaaatttgtttaagtttctacctaaatagttcactcaacatttcccaatacagggaggtaatacagaaatacaggcttacaaaaattgttcttttattttctttgaaggttact

SEQ ID NO: 106225 - DNA, 2088 bp, Homo sapiens
cttaaaagcagaattagggccaggcatggtggctaatgcctgtaatcccaggactttgggaggcctaggcagaaggattctttgaggccaagagtttgagaccaacctgggcaataaagtgagacccctttaatttaaaaaaatttttttaattaaccaggtgtgatggcgtgcatctgtagtcccagctacttgggaggtggaggtgagaggattacttgagcccagggggtcgaggctgcagtgaactttgatggcaccactgcactccatcctaggcaacagagcaagaccctgtctgaagaaaagaagggcagaattaaacaacttatattttattttgcaaattcacaaatataggataaaaaaatggctggatgcaaatagaaaagaaatactgtcttttcaaaaaagaacaaaggattaaaagtagatcttatgaagaaagataaaagagtcaacattaaatctagagaaaagcctttgtacaagaggaatttttttgttcaagtatgaggaggttccaaaacagtttttaaaaatctgttttcaaatttttttggagacagggtctcgctctgtctctcaggctgaagtgcagtggcatgatcagaactcactacagcctcgaactcctgggctcaagtctttttcctgcctcaacctcccaaagtgctgggattataggtgtgagccgccatgccgagccccaaaacaattctttatccatagatgacttttgttttgttttattttattttattctgttttatttttgagatggagtctcactctgtagcccaagctggagtgcagtggtacaatctcagctcactacaacctctgcctcctgggcccaagcgattctcctgcctcagcctcctgagtggctgggactacaggcatccaccacccacagctggctaattttttgtattttagtagagacagggttttaccatgttgcccagggtggtctcaaactcctgagctcaggcaatacacccacttcagcctcccaaagtgttgggattacaggcatgagccatggcgcccggcccatagatgacttttaaataaaaaataactgggagagattttgattgcttaataatattaatagcaagtaattatatagcacttattatatgccaagcttcattctagcactttacctatattatttaattctcacaacagtcttacaaggtgcatattttattcctatttttacagatagagtaactgagaggcaggaagatttaataatttatacagtatcacatatcaagtatatggtagagctgggatttgaacctggacagccagacctcagattttctgctttgtgtaactactgtgctgtgctgctggattcacagaataatttcttggtgtagagcagatactgcttcaagttaatgccatatttaaagaaccgtataaatctttaaaaagcaaacaagtgttttgggttgtttttttttttttttctggtttttgtgggtttgggctagattatgtttcttattctggtgagggagcatggttaaagaaaactcctggatcaggagattagagactgaggtattttttgtttttgtttttttttttttgaaatggactttcgctctgtcacccacgctggagtgcactggcgcaatctaggctcattgcaacctccacctcccgggttcaagcagttctcctgccccagtctcccgagtagctggaattaaaagcatgtgccaccacacctggctaattttttgtatttttaatagagtagagtacatttttaggtttcaccatgttggccaggctggccttaaactcctgacctcaagtgatccatccaccttggcctcccaaagtgctgggattacaggtgtgagccaccgcaccaggcaagattgaggtttttatcttagttctgctactcaacccacttttgtgaccttgagtgagtcattttatgtgggtaggccttcagttgtcttttgtttcaaataatagaaccaaacctgtgatcctgggtccctatattcttttttgaggtggagtcttgctctgttgcccaggctggag

SEQ ID NO: 106226 - DNA, 1024 bp, Homo sapiens
agtcttttctgtatatgttcttattgaactgctaaagttctaatgtaaattgtgaacattttaagtaaaaactggaatagatgcattttataccttagaactaactaaaagaccattcctggacatattagatttctgttaggatatagttcatggagttaaactctaaatggaattgaattaaaaaggtgaaattacaccatctagtggaagtagattctaaagatatggttggttgatggttttgtttttcagtaaaactttttgcagcatctgagtgatttcctgaatgttaggaatgttttaggaacttaaacttggcaaatagtctcttaagtgaagctgtgttttaatatggattctgaggtgtatggctttttattagattctttaaccgatagctttattataacctatagcttatattaaaatgtagtacctctaagtagacaaaattttccgtagtcattatttatcaaggatgtggagagcaataaattaatgctttaaacctcaagtactatgtttgaagtgtatacttctctgttgaggtgtctcagaggcgttagggtcataagtgttcctctggataatgacaggaatagaacaaggtgaagaaggtatgccaaaaccacaactaagtgctatgagcatttcaccttgattctgagtaaaggagtctcgcttaacagctattaactgttaacaagccacctaaagtttagactttgtacaccaatgtctttctctgtaaaatatatctttgggctgggcacggtggctatgcctgtaatcccagcactttgggaggctaaggcgggcggatcacctgtggtcaggagttcgagaccagcctgaccgacatggagaaacccccgtctctactaaaaatacaaaaccagctgggcgtggtggcgcatgcctgtaatcccagctactcgggaggctgaggcaggagaatgacttggacccaggaggcggaggctgcggtgagccgagatcatgccactgcactccagcctgg

SEQ ID NO: 106227 - DNA, 1023 bp, Homo sapiens
cctatctgcagggaatatgttccatgacccccagtagatgcctgaaatcacagatagtaccaaaccctatatctactatgttttttcctatatatacacatacctatgataaagtttgacttataaattaagcatagtaagaaattaacaataataataaaatagaacaattacaacagtatactgttatgtgaataaaagttatgtgaatgtcaacattctgtctgtctctctcaaaatatcttgtactgcactataactgaaactgtggaaagggaaaccagagataagcggggactgctgtatgttttacaaagtactatcaagtttcactactttaaaatacatcaagtgggatgtaatatgaaaatattttagaatatgctgaaaattgatcactcctcaaaagaatcatgatgagcttattagaatctgttttgtgatttgtaatactaggaggccttacatcgggaacaaatgttggaacagaagttagccacgcttcagcggctactagccatcacccaagaggcttcagataccagttggcaggtattccagttgttttatatttaagaaacatttaaacatagtttaatattccatacatgttaaataaactaaaatgtagcaaacaaagacaaagttatttcctaactaatgaacaagttgttgaagatttagcattttacagtggatgctggtcagttttacgcttttatatcttttgttgtcagtagcaacctttttttatatacatgtgactttataattactcgggttttacttacatttaatttttcttcaataggctttaatagatgaagatagactcttatcacggttagaagttatgggaaaccaattacaggcatgctccaaagtaggtattaacctcaaatgtgtaaaatgaaatgcatagttttttatgtaacatcatttctttgactatcattttgagtatatgctaaaaacttcatacatttccacaattcttttaaatcttttgtgctgagaaacgtc

SEQ ID NO: 106228 - DNA, 1066 bp, Homo sapiens
tgtgattacagtgagttatgatcgcagaactgcgctccagccttggtgacaaagagagaccctgtctctaaaaaaacgaaaaaaggaaaaacaatggccattgttttttgtaactttggcatcaaaaaccaaataccacatgttctcatttataagtggaagctaagctataggtatgtaaaggcataaagagtgctataatggacattggagactcagaagttgggaaagtgagaggggagtgagggatgaaaaactccctattgaatacaatatacactactcaggtaatgagtgcactaaaaccccagacatcaccactacataattcatccatgtaaccaaaaaccacttgtatctctaaaggtattggaataaaaaaatttaaataaccctgaggtatgttttctacggggaaagcaagataagtgattttctccccttatttattagatttcagaataatgaattggtggtttttcatctaccaaagactggccatgaagtgttttctcactccacttagatttaaacatatttgatgtatttaaatctggtgcagttgtttttcttgttttagagacagggtcttgctatgttgcccaggctggtcttgaactcctgggctcacgcaatcctcccatctcggcctcccaaagtgccacggccagcctatttttcttattgatgctcaaattatcccatctttggtctgtgtaaatgtcttcagagtgatagcttcatgctgtcatttcagacaagatgtttcaggctcattttgtacttttcctgccccagacatgaagtctgcttttcccccatggtactcttattccttttgttttaaccattgtttcagaatgcttggtgcctttgaaggtaattgattatttttgcctacaaatgtgaatatggtggcttgcagaaaatatgacaaatataaaagtaactaattttgtatattttagggaaattctcaattgcctataactttttttttctataggaagtggaaattagtaagtttgtgaaggcataatttacttatgcaacttgtaaatacatc

SEQ ID NO: 106229 - DNA, 1006 bp, Homo sapiens
ttgtattgctacctcatcccatagtgcctgattcactgttgtgtgattaatttgatatataaagaaagttactaagtgtcttttaattttttattaaattgattgctggatattattaaacttgctttcaaggattgataggcttaaaatattttcacagctaaaagtcatacccattggcctttcaaaaatgtaattatataaaggcagcatccttttcctgcccctgctctccctccacttttatttttttgttgtttttgttaattcttagttatgttttctgttttagtgtgaattgaaattcttatgttatttgactcagctttatttaaagtccagggcagatgttgatttagaatagtccatagaattatactttttataaatttcatttagaaggaattctaaataacaaatatacacttattctaattaaattgcctgtaaacttgaatcgcagcgaagtctgagtaatactgaagatgaatgtacccatctgaaagaaatgaatgaaaggactcaggaagaattaagagaattagccaacaaatataatggagcagttaatgagattaaagatttatctgataaattaaaggtatgtatttactctgcctgaaagtatgttaagctaataatccctaacacactagatagcttaagattttaggtattgctttagctgggcgtggggtggcgggcgcctgtaatcccagcttctcaggaggctgaggtaggagaattgcttgaacccaggagacggaggttgcagcgagctgagatcacgtcactgcactccagcctgggcgacagagcgatactccatctcaaaggaaaaacaaacaaacaaacaaacaaaaaacagtttgggccaggcgcagtggctcacgcctgtaatcccagcactttgggaggccgaggcgggcagatcatgaggtcaagagattgagaccatcctggccaacatggtgaaaccccgtctctactaaaaatacaaaaatta

SEQ ID NO: 106230 - DNA, 1009 bp, Homo sapiens
atcaagcctttgtctttatcatctttactggtttagaaatgtcaggttagccgggcgcagtggctcatgcctgtaatcccagcactttgggaggccaaggtgggctgatcatctgaggtcaggcgttcgagaccagcctgaccaacatggagaaaccccgtctcttctaaaaatacaaaattagctgggtatggtggcgcatgcctgtaatcccagctacttgggaggctgaggcaggagaatcactcgaacccgggaggcggaggttgcctaggcaacaagagtgaaactccatctcaaaaaaaaaaagaaagaaagaaatgtcaggtttacagataatgttctgtagaacatttcttttctacagaacaaacttttcttagaagtttaagtgaataaaggcattcctggggctcgctcttaaaacagagttaggtttgttaaataactgaattttcttatttttctaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaaggtaagtagctaatccagaaattgattttattttattttttttcttgttatctgtgaaatatcttttttttttttggacttttatttacagtacggttagaacatcttcaggagaaaactcttaaagaatgcagcagcttgggtaggtggcatccatatttcttacttaaacctgaattttatccttaaacttttgaccttgtttactgtctcacactgcattttttaagggatgttttatgtattaggtataaagtatctatattcttttagaaaattttctttaaaaatatgcttgattgccaccagtgggcaccattgttttccttgagatgagtgaaatttctgctctgagatcttctacctcggga

SEQ ID NO: 106231 - DNA, 1024 bp, Homo sapiens
tgtctctacaaaaaatacaaaaattagctgggcgtggtggcacgctactgtaatcccagctactctaggaggctgaggcaggaggatcacttgaacctgggaggcagaggttgcaatgagcccagatcgtgccactgcaccccaacctgggcaacagagtgagactcttgtctcaaaaaacaaaacaaaacaaaacagtcaatcagtcatcaccctcttgattttatattaataatgttagtattaacccaagctgggaacctgctattcattccttcagttaagagaatcgttttatgtacatggaaccatctttatactatttagagttgtaaaattactgattcatttttttccagttccagttggttcagatgaaaataatagtagactgttttcatattgtattaatataattgttaaagactccttgattttaagaataaatattttagatacttaaaggtaactccttgccataattattttttccttatttgtgtgcttgcttttttggtggtgatatattgagttacggtatgatagtgactaatagaatattttaaaagaaactaagcaataaatttctagatgtacacgaaaacttagttaagggtggactttggaataagatgcgtcacttaattccattccaaatcacttataataatgaaccaattttcaagtatcccagtattaccaatgtccatacccatattatataattttaactaaattattctttaaatagtagagagccaaatatagttgtaagagaatatttttaaatatctgaagatgttaaaattaataatactaatactttcagtgaatcccattttaaaaattaaatataatgtagctactaaaagcacaggttttgtactgtaaattttttgtgtgtcttatctaataagcataagctgaatgtatcttagagagtaaaggacagtgttgtccgaaataaacataaggctgggtgtggtggctcacacctataatcccagcactttgggaggccaag

SEQ ID NO: 106232 - DNA, 1593 bp, Homo sapiens
agtggttctctatctttttatattaatatcagattttatctaaaccagtttagtaaatattttaatgtagagttcagataaaagtgtgattgttagctttgtaagtaatggtaggatgtccctctttaataaatgtcatcttaagttctttgatattagtctgaaatatgtttcaaatatgttttgtaaagtcctttagttaagttaaaatatcattccaaatgagtttatatatatataacatgatgatgtagtttgagtttttaaagtgttaccatagctaaaatgggatttatgaaaaacaactttttatcctggcaattactattatactgagggctcccgttttgcttttcctggatccagttgtcaaattcttatttattagattttttttaaatttcaaatttctgttgctgttagtatttttttctttttgaggctatattgtatcactatatagtattctaggtatgtagtgcattggtctctccaaaacacaagttttatcaacctttttcctccatgtttttgtcttatactgatggtgatgatagatgagaggctctgcacaccatgtaacttattaaagcataatgataaattttagtatagaattaaagaaggtagccaacaggaaggatgtaaagagaggtaaggcatgatctaagtaggtagtgtctgcctctcatgcaaagttgagacgactgaggagtaacgtggcctgaggtggacgagaggggaaggaggtttttatagagagaatggtgccaactcatgtgtcccctttgacagattctaatgctttcacactttccaagtagtcattatgtcagaatatgtttttaacacttcaacttccaaaatagatttggtcattttgaaagatataaatacacgttaaaggacattatccagattcagaagtaactctttaaatcacaataaagattattgtaagaaaagaactgaaacttttatttaaccactatgttacatttttattgtctccattcatttctttaaatgaaaaataaattctgtttgacttgagcaaaaccatttaccaagctcttactttgaaatgaataggcactgattttggtcatttgggcagagataaacaatttaatgttttaatactgtatgaggtacagattaagtgactcaaaagggaagattatgaaatgaatatgtaaaacttattacatcaatttcttaaaaatcttatggtattactttatgatattcttaaagtatttaccttttgcctcttaactaagatgaatagctttgaagagggagtatgatagaacaatcacttgaaaattaatttaatttaataatgacaaacttaaattatttaagggtatttgttgagttctagtggacaaaaggtggaagaaccattttaaagcaatatatttatgtgattttcttgagctctttggataaaaactacacctttaaaagctaaccattcagtgtacaaattaataataattttcagtcatttaactccaaaatatgtctgctttagtatcaaaatatattaagcctttattagtcttacttagtacccatgttaatact

SEQ ID NO: 106233 - DNA, 1023 bp, Homo sapiens
atctgtttccatattcttgaaattggtccctttcactttgttttcagtctatctttgaattctaaatgcttttttccttcttttttttttttttttttttttaaacagagtctcgctccgttgcccaggctggagtgcaatggcgtgatctcgactcactgcaacctccacctcctgggttcgagcaattctcctgcctcagcctcccaagtagctaggattacaggcacccgctaccatacccggctaattttttttttaatgtatttttagtaaagatggggtttcaccatgttggccaggctggtctcaaactcctgacctcaggtgatccacctgccttggcctctcaaagggctgggattacaggcatgagccactgcacccggcctccttcttaaattttaggacaaatagcttctggaactgtttttatgaaaaggcacaacatcttctatagcaagagttactttaactgattaaattttgctgcagaaatgagtaaccttatgaaagtctgtattattaaaactgggaacctcacagagcctctcctatgaggttctatgtctctatttctgttttgttaattatttcagaagggaaataattttctggtttgaataccgattataacaatttgtgtattgatattctaatctcagtttcttcatcatattttctcttggtgatcttttaggtaatgttaactcatttctgtttatgatgtttagaattcaatcagagggatcttgatgtgaattctgatgcactctctcactggcagtatgattgtggacaatactgggcaaatttacctctttaaaccttgatttcctcatttataaagtgggatggcagtatctctcatagaattatgaaaattaattgagatcgtatttactaagtgctctaagtaatgcatgacacactgaaatgtacattagttagcaggcagaaaacatgttggagaggtgtagaagctgtgcataattaccagtatgcatgctatttaaaaaattt

SEQ ID NO: 106234 - DNA, 1035 bp, Homo sapiens
ccaactgacatacaggagtaaataaggggacacagaatagatatatcctcttcaatgaaacgtggaatatgaaaatatgactttaaattataaaaaagtagcattatacatttacagaaaatcccccataaaacaaaacaaaatttttttatttctttgaatagcttttctaaaatgattcatttactgaaatacattatataggcatctctgctgaattatgtcagcagagaacagtaaactatcgatataacttaatttttattacttcttcatttgaataaataccttttcataaatcttttattttaacttaatagccttgatctaaagaggattgctttatttcttctgagccctttttataaaaatatctaggcttttaaaataaggtgaaaataaaaggcaaattgtctgcctgcccctagttttctgcattaacgtgattgctccgtcatagttccagttctcttagttccccttccagattcaagtttttattcaagcttggtcataggagtaatgttatcatctttaaatttggtcatggaatgtgttacactgcccagctcagggaaatgctgctcagtttgggcttggatggtaacgtttattttccttggcagagaagctgatcgtcgaagggcatctaaccaaagcggtagaagaaacaaagctttcaaaaggtttgttttctgtttttctatgttttttgacagttcttttggataatgaaggttagtgtatattttcaaggttatagtattttaaccatcagtttacttcttatagctcacaaaatagcaagccagtaacagtatcagataatatataaaataatcagacttctgttttaagaagggtatcgtaactggaatgtgtctttttaagtggatgtatatttatggttttttgaatgttagtacttgatataggtttctttaggtattaaagatttgttgcaatctctgtcattcccagcattaatttcagctttgatctcaaattttaatcaaacacaatgtaagtcgtttg

SEQ ID NO: 106235 - DNA, 1019 bp, Homo sapiens
tgaaattcatcacccatttcacaagttaagccacaaattctgggggtattcttatatggaatagccataacaagttatattttaatgttgtattaaatattttgacagtaatggttttagatgtgtttctaatttctttcaaaatagaaaatatattttaatttccttgattttaaaacaatatatatatatatctacaaatttttcagtgtatgactatgtgaagttaaaaagtaaatgtccaccatgtccctatccccaaaaataactaatgatgtctctgttgtagatccttccagaccttgaataaatatatgcaattaaaaattcatagataaatgtataactatttttaatctacatggggtcatattatacatactgctctttattaggctttttacttagtagtaaatatatcttgaatagttttcattccataatatatgtatttcattttcccataatgaacaatacttcagtgagcattatgtatcgcatatgtgctgtgttacttcctttaggaaaagtactagaagtgggcatgcatgtacaaacagtgaaatcaggtctgtaacattataaaaatatatgctttataaatttataatctcactaaggaaagaagatatatacatatacacagaataatacaaaataaagtatgattaattgaggaaacaaaagacacaaagatacaattaaaaggagcaccatggtggagaaatgaagacttccttagagttgatgggacttaaactgtatattacagaatgaataggccaagtagagaaaatggctcttttgaggttagggaaatattgaatcaaacaaataattgcaggacataatgcaggcatgtattagccctataatgaagctagcatgaccagagcagagctcctgtgggaaataatgtagggaccagattacggctaaattctgctatgtaaagcttgactgaggccttgtggagaatggggagataggatttccatataggatttcattcagagaaa

SEQ ID NO: 106236 - DNA, 1521 bp, Homo sapiens
ttattttaagtggcacttttttataagaactgatcgtggtttttttttaagagttttattatttgagtacaaatcttactaaagcagccttcttactagtgtttttatgtaacagagccttctcctttaatcatctttatacagtgtctgcattgtcctgggaattgtactatatttgttgcagttctttgaatactttagcaaagcttgcttcgtttttgtttccagttggcaagtggacagccttgaacaaaagccccagccctcagcaaagcagacatgatccacattataatttaatatgagctacgtgtaataaccagcattccattttggacaagggtggtgaagaagtaagagattcagtgacctgacctattttaaaagtactttgcgtacctgtagattttgagcattcatagcctgaagcagttttattgatataagatatttaactgtaataagattttacttttatttttttcttggtagaaaatcagacaagagcaaaagaatctgatttttcagatactctgagtccaagcaaggaaaaaagcagtgacgacactacaggtgagttttaacctaatgtttacagacctgcagctgttaatggcagtttagttatataggtcaatgtgagtggagatttcaaagtatgtgtttggggaaaaaaaaaacgcttccatttatcaagtcatcccctttgaatgctggatattttgttaaaactactttcaactacccgaatataatagctgtatcaattccaattgtttgttttgataacaatagcttgctgatagatctgaatactgtctgtaattatatatgtatttttttcctctctgtagacgcccaaatggatgagcaagacctaaatgagcctcttgccaaagtgtcccttttaaaaggtactttaacatgtttttatgacatcgtaaaccagggtatcaaatcaccctttgccataaaatctgttctagatattatgtgaagttttaatttttagttaagagattaagataggttctgtaaagtagcagggactaaaaatttaaagttttggtgtttatacccaatatttcaaactattgttgaataatttggatcagtcaagattacgagggacaaagtgttaagtggtagaatatgaaatgcagctgtgttttttgtttacccttgtgtctctaataggaatttattagcgcttttaacataattagaataaggtgaaaatcttaactttcttgaaagactcaccggtttactctgttatcatatggtagcagttgtaaatttccttattttctggtcttcttcatcttctaataaatatccccaggttcttatgacactcttctagaaattttgggctaagaaactttaggtggatggccaggcatggtggctcacgcctgtaatctcagcactttgggaggctgaggcaggtggatcatctgaggtcaggagtttgagaccagcctgaccaacatggagaaaccctgtctctactaaaag

SEQ ID NO: 106237 - DNA, 1171 bp, Homo sapiens
gcggcctgatcacttgagcccaggagtttgagaccagcctgggcaacatggcaaaaccccatctctacaaaaattagccaggcatggtggtgcatgcctatagtctcagccactcagaaggctaaggtgggaggatcacttgagcccagacggcagaggttgcagtcagcccagatcgtgccactacactctagcctcggtgacagagcaagactctgtctcaaaaacaaaagcaaaaatctatcctctggatttaaggaatttcaaggcaaattagtgatagtacattttttaaaactttgtattttccttgtgcctcaacatccccacaaacaggccgtgaacactctgccctggcaaccagatgcaccagtatgataaggctggtccctgccacaagttccccttcataaccttccctggcagtgccctagtgaaatttaacgaaatcacctcatgccttttgtttgtgtatcctgacccccaatacaagcatttgcctacaggtcctcactctatcagttatacctatttggctgaacccattctttgggcttctcccatatggttccctgcatggtgtaccttgcctccctctctaggacctttgagtataataaatcctttaatttcatttacctctccaagtataattcccacagctatgttggagtgatccttgaggaccccacagggagacttactccctcccccatttaccacacagagagttatagatgataagctgattattggtggttgttgccatcagcagtcaaagaaaagagaatgcccagggtttttttgtttgtttgtttgtttcagaggatagagaagaaaggcattttgagtttcatgggacaagagtcatttgaaatgactctataaatagtgtgtcttaccatatgtgatatattcagtgattaagaaaaactaaacctaaatctgatcaagactctagctccaactgccagtttgcaggacatacaaagaactaggcacatattctaaatgatgtgatggggatacaaccagcaaaatccagaatgtggaagattctacaggacatacaacccagtttctttagcaattaaattagaaggggaaaaaaaggaaaggggatgggggaaatcctataaattaaaagagatttaagagttatgtcggccag

SEQ ID NO: 106238 - DNA, 1056 bp, Homo sapiens
tgtgctaaaatttagctgttacttgaagaaaagtttctttttgttttccatatccagttaagttccaagtgaaatttttctgactggttatcaagaaatttcaaaattgatgaagaagtatagcattttgctcatctcactgaatttcaagtcttaataagcaatgagttataatctgtcactgtctgtttattttgatgctagaattgtgaatatataatttatgttaatatatttttataatgtcatcaccatgattactaatatatataactgtatttgtattttctcccaactactaaaatgcttactataatttgcttctaagttttatttaactcagttgttctatgttgtttatgcatgtgcaaacatgagagagattaccagtcttttattgtagattatagtgtgatactaactcttgcttttaaaataaacatgtttttgtcagatgacttgcagggtgcacagtcagaaattgaggcaaagcaagaaatacagcatcttcgaaaggaattgatcgaagcccaggagctagctagaacaagtaaacaaaaatgctttgaacttcaaggtgagatcaagattactttggttctttagggatgtgtggaggcagcacaatataattgggtggccccaaacttggagtccggaggcatgttccagattcacaactttatgagatatgtgatcttggtatatttacttgacctctctaaacttgtgtttcaggtcagtaaaatgaggagagttacagttgctctaccttcacactgttgatgtgaaaatcaagtaagatctttactaactgaaagatcttaatagttaattgcatattaagtacaacagaaggaaaactcaaatttctaaatttttattatgcctaatgttagctaatgtcctggccacattcttttctagtagctcacttatctataggtcataagccagtggagtctgtgcagttccctagagcttacatttctgtatcattcatagtaactacctggttgcagacaattagtatctcaaagagtcttaaaatgagaa

SEQ ID NO: 106239 - DNA, 1061 bp, Homo sapiens
tatatatactataactatttttttgttgaaagagtttcatcaacagaaggatagggaacactgcatttattgtgatcactccctatttaatgtttgtttttacatgtttataaatgcataggaaaaaatccagaaggaatatcagaagtaattttctgtgtgttggggagatgaagatcactttggtttttttttcctctttgctatctgtattttgacgctttctgcatcaaacgtggattgtttatacactttaatcaaaagcaacagctctgacaacccaggttatgcattagctacaatcctgtatggattattcttttattctaatgggccaagaaaatgatggatatacttttgcagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaataaatgtattttacataaagctgttaacttttgacaatgataacttcttaacttgtttaaaaaagaaacatgcaggctttttttttctttgttagctatcagttgtataaaccaatgtttttaaatcggagctaaaaatgtattttcaggtctgcaagttctacttaaatttatatttttttacggttttatattttattttaaaattgttaaaaattgcttgtcttataaaagtgaagtggaaaaaaatactattgttcaagtacaagctgatagcagtccttgaggtatacatgcaaagtaacaggaatcatataattaaccatgtaaaatctacttgcttttaagggggcaaaaagtatgttctcctct

SEQ ID NO: 106240 - DNA, 2058 bp, Homo sapiens
aaattcacctcatagccaggcagccagccaaacacatgttctgtggccttttactttcttcctcccacccccttttcaccttattcataaatgtgcatgctcacttttcatgtcattctgcttaaaaccttgagttgagtggctttttaaaaatttgtgttgaagtcataacagttgattttggaacagaaaccctacccagtttcttcctgagcaagagaggtgcatttcacttcccaaagccttgaagttgacagcagggcagtaagagctgtcttcagtcctgctggcctcataccactccctgcattgactcctggccagctcggggaatggagaagcctgatacaacttgatctacagattagggaccaccccagttgtagactttcttaaaaggattctttatgaattagaaggaagttgaagacaactctttgtctttaataatgaactttcccaaagttgtttctagaagatctgcttaatcaatgcagtttttctttgcacttttctttccttgtagtgtcctgaatttggcaatgattgttcttctgtcttcatgtttgttcctaatgaaaaaatactgtaacattttttattttcttgcggacatactgattttgtgatgtgttcgtttttaccttactaaagatatgtgttttagaagaaatctcattttatttggttggaacacaaattttgtgccaaagtaaatatcttagtatttaatactgtaagcactttgtgtccttccagtccatatgccataattctttcaaactctgggaagaatgctgtggttggaagattattctgttgtatgttactatgaacgcattagtcattttgttgcattacttgtttgcctgtttttggtcactgagtaatcggtgcaagatgctttaactgtttccacaaatggcagtggcatgttgtcacagcatctaaattgttgatagtcttggattgcattaaatgcagcacatttaaaaatatgtctgatcttgtcagtatgtttcttttctattttcttgttcactgttttccattgtgaaatgatgtgtagtcatcacactcctttgtaatgtgaaattgctctctttctgtttgtccagatgttaacatgttggatactatatactatagtttagttatagctatatactataactaaaatgttctttaatgaggttcttatctctgtgtaatccactgcaaatgaattattgccttttattgatgcacatatattccccttcagcatttcccctttgttctcctctctgtcatagaatcatgcttaatatgcacagtgtctaattatgtattttcagcactgtaacagactaaaatattacaagctaagcaagcccacatatgattctttttatgaagaagaaccaaaggtgttggtaatattgtgtggtatttccctcttaatcaggaccaagctcatttgtcacctcagagttagaaagcaagatggagcaaaaatgatagccaagcaaggctgcaataggtcacctttgttgcacaaattaaaatttatatatgtggcagcttttatgtgaatatttaacaaagaaaaagtacatgcaaaaagtaaatcttggctgggcgccgtggctcacgcctgtaatcccagcacttttagaggccaaggcgggcagctcacctgaggtcaggagttcaagcccagcctgaccaatatgatgaaaccccgtctatactaaaaatacaaaaattagccaggcatgatggcatgcgcctgtaatcccagctactcaggaggctgagacaggagaatcgcttgaacccgggaggcggaggttgtggtgagctgagatcaggccattgcactccagcctgggcaacaagagcaaaactccatctcagaaaaaaaaaaaagtaaatcttaatcctcagtattaaaagaaaataatgatatatcatctttatatttgactttagaaagcatcactatattttaatttagtaggaatatctgtaatttaagaatttataggccaggtgcagtggctcactcctgtaatc

SEQ ID NO: 106241 - DNA, 4397 bp, Homo sapiens
catgagccactgcattcggcctgctctgtcttcatgtgctatatttcattagaatgttaggtacacccacattgcccattgccttcagctgtttctttctctttttttttttttttcaacggagtctctctctgtcacccagcttggagtgcagtggcactctcagctcactgcaacctctgcctcctggttcaagcaattctcctgccttaacctccagagtagctgggattacaggcatgcaccaccatgcctggctaacttttgtatttttagtagagacagcatttcaccatgttggccaggctggtctcaaactcctgacctcaggtgatccacctgcctcagcctcccaaagtgctgggattacaggcattgagcctaacggttcctagctattccttttaaactgatagtttcccaacttgcataccacagtctatcagattgtgttagatgtctttaaaatgtttgaatctgtgtaaaacctgagtggtatacttctattatttcattctttcttcctacctcccaccctactggggtctgaatcctcttatctgattactttcatagcataaaatgattttaatatgccttcccttctttagccttccatattacaacccgtcccagccgtattcatcggcctattcctggctttcctgttttggtgtttcggtccattgtggtagagaaaggtacaagcactattgttgagtccttgtctgtttgtccccgtcacctttttgtgccatatttgtaatatagtgcatggcaagaacacacaggtattttgttacctgaagcaaacccttcatttagtatgccgtgtatttgtgtcataccaatgaactgaacagtcaactaatcccataactttttgtcttgtttactttgtagtaatgctaaccatgagttaattccaacctaaccagttgttaatatgcttccattaactgagtctttatctctagcaaactggagtgcactatgaatttctgcaatattagtaccctctttccaattatgtgtttaatcagatttgaatgagaaatgaagagtttgcctccttgaagttttcagccagccttcttccccttcctccttatcctcttccttttcatagtgtagattttctttgtttcaaccctttgcctgtttatactatggctatgaagatgaaaaataatgagattaacataatgaaccattggctcacaatctcaaccctattgtgtacttgcaaggatataaatgtatcccatttctttctgagccctgacctgcaacatcagaatatttctttaaaaaccagtttttctcaataacacttctggaatacaagtaaaaataaaagtgtcaaccaaagcaagttgatcttataaagccctctaaaagctagcaggcaacagcccatccatgcttgtttctaactggcatgcatgttagtagagcatatgcggtgatcatgtggctttattacactgaacagagtctataccagaattatcagacaggcaggatccctaatgttacttttccatcttgaaccctgtttgattttgtcttctgtggtttcaagttggacgaccaaagcctagaccattatcaccttagccactatccccttgcataaaatatcccaacatgtgagtctggttcttatcaagaaataaacattttaggcagaaacatactacaggtgtctatatacatcagttatattggaatatatggataccagagtaaataaagcaggcagagcccacaaattttcttagaagtcactattaggtttcaactgtaacaaagttgaaaacttcccaggactttcttgggacgtgttagacttccaaattggtgttcctgctattatgactcttcttatacctgcactccctcacttttttttttcttttcaaactttatatttatgatgcagaaataagatttttccaatattctgttaagtattcaggactctctggaaccaaggggttaataggtatgaaaagagaggggagaatgtgatattgactcttggtttctttccacacagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggatttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctccctacgcatgtttgagttgaatatcattgaagttcttaatgctgactctactattgggttgttaatagtcttctcttgacatgactctttatgcaacataacatacatttggtattcttcagggtttaaaagaaaacactgagctgtttcctccaagttttattaaccttttatttaacttactgctttatttttttctcttttaatatggttattgttaaaatgagagtcacttgctagactggtctctttaaatgtaaggtctagtatcaatatttacttcattcaagtggaataaatggctttttgtagttacttccagttttcctcaagaatagaaataagtctgttcataagcaataccttcagttttgttcagttcacttccacgttaaataaagaataggattattcactggtaataatagagtcattaagaaatattaagcattgcagctaaaaattg

SEQ ID NO: 106242 - DNA, 1002 bp, Homo sapiens
ttatgagattctgtaagcacctcggtttcagatgtctgactctgaggggatgggtcagtaaatgacattctgtatagcaagggcctggccacagctaggagcagtgacacagataagtagcttctggtctcatgaaaaagtaagatgtcaaatgacaataaaatcgagtgcagagtacataatcatttcaattaggtggaagttatctttcaggagaggctgcaggaaactgtaaatcactgagataaagtggaaggcctgtgagtagcatgttttgttacatgtaaaagaaaaactaaaagatgagactgtgagcttttgggaatgcagtttccaggatcctgaagccaaccacatataggtggcaaagaccccgtcgccctttcctggtcagggagggaagggccgtttgactttctagaattgtctccctggattgagggtgtttgcagttaattgttttgtggaaataagagcagagcaaacaccccacccagggcagggacaggatgtagattcctcaggcctgaactgtcaggctcgaggccacacacttgtggatgccccacaccctggtgctactcacagcctgcaggatgaacgctgtccctcagcctggtacctgtctgtccgtccgtccatccatccatccatccatccatccatccatccatccatccactagcttatttcctttattcactcagcgtttattgtgtgcctgagcttgtggcaggtgcagggatatggctgtggttgagatggatacagatcctctgcatggagtggaaggtctggtacagaactaaccaggtgtggggcatgcatctgtgctccagcaatgccctgagatctccatgtacttccccaccctggggagcagggcagctttgtggaggaggcaaagaccaagctaagcaggagtgagctaggcttggggggctcaggggaaaaaaggggacactccaggtgaatggggacaagaaaaggctcacagaccag

SEQ ID NO: 106243 - DNA, 1065 bp, Homo sapiens
agtcccactgaggcccgacccattctgtccggctcccagcccccgcgggtccccccaccccggggctgaccgggtgattcaggcagccctacatcctgctggggtggtgggcttcgagcgcgggtcccaggacgcagtggggcgcagtgcctgcggcaggcggcaggaggcgagcgtggcccaggaactcccgcgggagggtcgggacggggcggggcttgggggcggggcggctcagcgcgcaggcgcggggccaggcgcctcgcgcggccaggggcgggcggccgcagagcagcaccggccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcggtgagttctctggccgggcccaggcgcccactgtggtgccgacccgcccccgcgcgtgcacccctgcggagggcgaggatttcccgcagcgcgcccccacctcggagataagggggagtcgtccccaggggtgggttatagggggcctagaccccctccccggtgtcttcccctgggatgggacctgttgtgatcgctccccgccatccgccccagcagtgcacctttggctggctaagggttgagggtttgggctggggtcacaggaggagaggtggagttgttgcatttctctacacctggggcgcccctatgggagctaggggactagaaaccctcgtt

SEQ ID NO: 106244 - DNA, 2165 bp, Homo sapiens
gagcccaactagcgtccactgtgtaccgtcagccttctaagttatctccgtccctacgcatcctgccatctggggtgaggctagacccattttacagataagggggtccggagggttaattgacctgtccaaggtcagcaagtagggcccagctgagaactgaaggaagtgggcaacagttagaaggaggctttgttttcctctcctctcccaaacctacaccagggtcttcctgaaaggagggagggaattggtgtctcttgctggactgggccttctggtctggggaggaagaataaggatgaagtctcccttgtggtctgagatagttggaggcttcccagagggccacaaggctactgatagtgtgggctgtgatggtaggggctgtgatgtgtgtgtgcatgtgggcgtttgtgcagagaacgtgtgtacacacatagcatgtgtgtatagcatgtgcatatgcaaagagtttgcatgtacacggaatgtatgcagagaatgtgtatccacctacacgtgtgtatgggtgtgtgtatgtgtgtgtgtgtatgtgggtgggtgggtgtgggttggggcagaggagggttctgggtctggatctcttcctaaggagaaccagggactggccctggcctgtgatttgggtctcttcctgaggaaaccaggtcactatagtgaccctagtgacaggaagaaagggagatgggtgtggctgccaggactttctccagtggaaaagggattccctctaggctgagcctcccctgggccttagggcctcacccttcccttcccccacacctgtcctggcaggtaaggctgcttcctgcttcctgggcccagatggcagccgcaccacccagctgatctccagcagccctccccctccccaagggtggcttccctgcagaagaatctgcatggcacgctgttgtcttctttctggggtccatctcctgtactggggagggagaacctcagaatctcctggaattctttaccattcagaaaccagcctcccctctgaagaatcccaaggcccagctgggctcaatttggatctgttctttgttttaaaaatgtgtatttatttaattaactgaataaagaaacttaaagtaaaccagaagtatccaaatacgacatgaaatctctaaaacaacaacaaaaccaaaccaaaccgcagcactagcaaatcacagactgcctgatctacccactgtttacagaggcagcagctacttccagcactgtctctcatcagtgcccggggctgtgggtctcattctagattttgtctacatttttttacatggttctcctgattccctgctccccctccccaccaccgccccgcctggagatggagccttgctctgtctccaggctggagtacaatggtgccatctctgctcactgcaacctccacctcccgggttcaagcgattcttctgcctcagcctcctgagtagctagaattacaggcacatgccaccacgcccggctaatttttgtattcttagtagagatggggtttcaccatgttggccaggctggtctcgaactcttgacctcatgatatgcccgcctcggcctcccaagtgcgggggttacagccctgagccaccgcgcccagcccggtcctccttttattttcgaatccactcaggccctagctactcccattgtcccgacgttccagggttagttagcttcccttcctctgtgctgggcctgtgggctgttggcagcttcttcctgttcctaccacaacttgcattctatttttttcctttttaatgatttcttggatcatattccccagagtgacattcctgggttaaagggtgtgaccacatttatgacttgtatcattggctgcctaattgctctcccgagagatcttgcaacaaacaggttttccagcctctggagaccacagagagccctggcaagtgccaggactgctgtggggataaagcaggaggcttcttccctaagctcttgaggctgttgtgggtaatggtccttcatccttcaaggcaaagttacctccagcttggactaaggttcatatattcactgcttaggttgtgttacattgtgctgacaatgacactagcttcaatttgggggcacctactgggtgttaagtgtgt

SEQ ID NO: 106245 - DNA, 1048 bp, Homo sapiens
ggcatgtgttgcttagaaaatggcgcctgttaattaaataaggtgctgtctaataattatctcaaaagtaatgccagggctggatgccgtggctcacgcctgtaatcccagcactttaggaggccaaggtgggtggatcacctgaggtcaggagttcgagaccagcctggacaacatggtgaaaccctagctctactaaaaatacaaaaattagctgggcatggtggtgcacacctgtagtcccagctactcgggaggctgaggcaggagaattgcttgaacccgggaggtggaggttgcagtgagccgaggtctttgtgtaactgcactccagcctgggagagcgagactctgactcaaaaaaaaaaaaaaaaaaaaaagtcatgcccgaatggtttgcacaccgaagggacgttcaaaattaggggagaacagcctggttgtttgtttctgtttggttgatcatactcttgccatggttagtattattatctttatttaaagatgggaaacaggagtgaagccacttgtggaggtgacccagctagctagtaaatggtgtctgaaacccaggtctgcccagctgttgaattggagccttaactgacttgccttccagtttcagagatgagtaaaatacagcttttctctccacatcagagggtccctgcaacactaggtttgcaagtcttaggtgttagggtggtggctggatacccacactctgaacctctgaccttggacaaaatagggatgtcagggccttccatgattggcaggatgaatcctctgggctgtgatgaaggtctcacaagttgagagtcagccgggaattaagtgggatcagtttgcctcttgtgttttcctcattgtgttttggttggttggttgagatttcctactacccaatggatgatgttttattccatcgtcagggaaggtatcattgaatgaatacagggttttgtatgctttggataagaccagacagttgtggagtcattagaattgtgtacatgcctccagctctgagataggtggtgtttca

SEQ ID NO: 106246 - DNA, 1034 bp, Homo sapiens
tggagtgcagtggcgctatctcagctcactgcaacctccgcctcccgggttcaagagattctcctgcctcagcctcccaagtagctgggattacaggcatgcgccatcacacctggataatttttttgcatttttagtagagatgaggtttctccatgttggtcaggctggtctcgaactcccgatctcaggtgatccgcccgctttggcctctcaaagtgctgggattgcaggtgtgagccatcgcgcctggccagtgtcaggatttattctgtgggaggggaggaggacaaagaaaaatactgagctatgtttgaagctcctgccctctaagagccttagagcagctgacttaaatgtgttcctttgataaactgtagatggttgttgtaactcttctgcaaactgtttatttttaaaaacaatttgatgagattttacttatgcccattgtttgagtacagcatttaccaaagaacaattttggccagatcccatgcagtagaatgcccttggccaaaattttcttgtactataagcaaagaagcagtttggtttttcacttaggcaagactgcctatcagactgagttattgtgacagagccgctgactctctccctttccccattatcaaaatctggcttttctaagcagcgcatgtaaaaagcttggcaaggaggacccttgtcctcctacatattattctttggctcttcttggtaccaagaatacatacaaataatgctggctgtgtactgaatgttgaggtgtgcactgttgaggatattcatcctctaatataacatctagtatttctcacaccttccgtctgctgagcattggtctatcttacttatactacttctaatcctcgtgaactctgcaaaactagtggctttacatctatgagaaaagaaaagaacttttatcggaagaaggtgagtccttttaaagtatcaggcctggaaagacattaaatgagacagcgaacacatcctgctaccctctttgagctatgtattcattgactttt

SEQ ID NO: 106247 - DNA, 1049 bp, Homo sapiens
tgggttgtgtttgctggtgagcccagcaactgcacccttctttccaggcctagcacccagcctttatcagtctcatggccctggcacaagtgggcagcctgcttccaatccaagcaggcagctttccgctcatctgcaggtagcctcgtgctgtggcagcacaaagttgtgtgagccagagctgaacttgtgatccccacgggcatctcctgaggcgcacctctcctgagagagaaagctggtccgtccagcccattcagggctcagcctccccagccgtcgcagggctggcttgctgaaaggtctgggtgttaacacagcactcctgttctctctctctgaaggccctttatgctggcatgaattccttttctcatagagatctgaaagctcttttgactaaatgggtcacctttctgagtattttcataaggctgtcagcctttaccatgccagacaagttttctggaatttcctttccagaaaaaaaaaaaaaaaaggctactaaagaggttggagttatttggaacacagggtggaattctggcattcgaactatagggaaacgggtggggatttgtggcaggcactatgtaaatttgccgcaagcccataaattcagactttaagatgaaagatggcaagcagcagtcagctttccttcaacaggcaggaacggtgctaccttccgcctgtgctgagtgtgactgagggagaggcaggcctcctagggaggccggggcaggaaaggtttcttggtggctaaaataggatttctcagtttcccccgtgtcccaagaaaataagttcttatcatgcttgtaccacacttcttgtgcgtatcaccctggtttccctgcacctccttgaagtggtttatcagattccagggacacaagaatggtttggcatctacagcctattgtgggagcaggggcccggcctggtgcttcttgcccaggaacaaactgattgttcccttggtgtggggtaaagcaggccagagtatgggaccaggccctgcctcccaggggacctgaggtgcaagg

SEQ ID NO: 106248 - DNA, 1031 bp, Homo sapiens
cctcccaaagtgctgggattacaggagtgagcccctgtgcccagcctgaaattcaattctaataaatttttattggagcattaaaaagttacatctgtagttgttactctttgcaaaaaattgcaagaacacagaaaaatataaagaaaaaaatcacctgtgaagaattttaatgaatctttttctacttttaggggattttgcttacagctgccttttaatcagaatagggaagaaagagattcctttctcaggaaaaaagtgactgtggactggaaatgctttgtgaaataattttggtcatactgatggttataacaagattcgtcttcaattgagttattgctgagctttgtccaacattaaaatgaaaggtctcatttgagtctcattgtggtttgcaagtctcccttggtctagaaatatgtttggtcaaccacggcatggaggtgttccagccactttctgtctcttaaaagtttttaggacctacttttattgggactgccagggtctcttaataatagttattatacttggtaactattgtgaccttgtctcataggcagcccagcatagaaactcatttagcttttagttgctcagctccattagctgtttaaacatgtttcagatgtgagcctgacaatgtacttgggcagcttggttcacccttgactgcctgggaactttgagaagtctgaaaattatatgtagccctaaggtcttcatggtattgtttttttggaggcaccatttcccaatagccctgaggacaccaggcccatgaagccatcctgtctcagccaggaggcagaggagatggaatggaaaccacttctggatacagatccagccacttccggagtgcttcagagcatgggtcagatagaccttgctgctttctagctggcagacttggggaaggttgtttgacctctctgagtttgtgtcccagactatagcagtacccccttactggcgttatcgaagataaaatgatataatcctgataaatcacttgacccagt

SEQ ID NO: 106249 - DNA, 1009 bp, Homo sapiens
aagttttcagatttatttttactttgcctggtgtgttttttcctggaaagccaacttctacatttggagattaaaagacaaactttctcaaactccctgtacctaagtggttgctgcttttcttaaatgttttgacaccaaagagaaaaattggtttctggaagaaagtgtgttttcttttattgccaagaaaattagtgcatgttaattaatatagatgctcaggacccagagttgtaatgaacttttttcttatatttattttctagatgtttgacttattttaacagttttcattttagcaataatgtttccttcccactcccaaatttattggaaaccctcaatcaaccctatttatttatttattttagagatgggatctcactatgttgtccaggctggtctggaaaccctcactcttatagatagtatgaaagaagattatagccaactcttatataaccttccccagagcctccaattgttaatgttttgccatatttgcttgctctatcacttgctctaaagatgcatatcacacactttttttttttttaatttatttttgagacagagtctggctctgtcgcccaggctgtagtgcagtggcatgatcttggcttactgcatcctctgcctcctgggttcaagcgattctcctgccttagtctcctgagtagctgggattacaggcacgggccaccatgcccagctaatttttgtatttttagtagagatggggttggccaagctggtcgtgaactattgacctcaagtgatcctcctgcctcagcctcccaaagtgctaggattacaggagtgagccaccatgcctggccacatgcgtgttttttattgaatcatttgaaagtactcagctcgtatcatgacccttcacccccacatactccaacaagcatctctaagaaaaaggacattctcctaaccacagtgtctctgcattcccaggacattcttctaaccacagcgtcactgcatacccaag

SEQ ID NO: 106250 - DNA, 1063 bp, Homo sapiens
tgggatgcagtcactcctttttgttgtgtatatttgtgaaatgatttctttcaatttttgagacagggtctcactctgttgcccaggctggagtgcagtggcgtgacgtcagctctctgcaactttcacttcccgggctcaagcgatcctccaacctcagtctcctgagtagctgggactacaggagtgagccaccatgctcggctaattttttttttttttttgggtagagagggagttttgccatgttgcccaggctggtcttgaactcctaagctcaaagcaatcctcctgcctcggcctcccaaaagtgctggggttacaggagtgtgccactgcacctggccattattatggaaaattttaggcgtatacaaaagtagagacagtggtgtcttacatgctcatgaacccatgatccagtgacatccgttaatggcattttggaatcatatttcatctgtttttgtcctcaaatgttttgaagcaaatttcagcattacatcatttcactcttaaatatctcagtatggttctctaatagttgaagactccatttacatttatataaggagcataatttacacttgtgtaacccaaaggaatgaccaagcctgtgcttctctccccagatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtaagtggccagggctgcctaaaccatctgtccaggatgggggtgtgtgggtcccaaacattctggttttcaacgggaatgctatctttgctttgattagcgtatttctccaggtcttagcccattataagcccattataaggaaactaaaactggctctgtgtacccttccaagggcagat

SEQ ID NO: 106251 - DNA, 1043 bp, Homo sapiens
atttacatgttatttcttttttatttaccttttttaattagtagagttaatacagatacagaccatgagtatacaagcaaaggaaaaagctggttaacctgtgcacttttttgtaacatgctctaatcccatgtgtgcttgtttcttcattttcctgccttgctatagcttatccttttatcatttttgaaattttgaccagaggagtaaatggacttttggggaatggggaggacaatgaacttttggaagttacatgcagaattttttggagaggggcccctagctttcaaaggggtctgcaatttctcaaaaatggttaaaaacactgatattggtgtgttggtttaaagtaatttcacttaattgagaagctgactcagtttcttaatatttgtagtgcttggtttaagaggcatttgcaaacacttcaatagttgcaaagtgatgtgttctgggtgttcatccaccatgtcattatcctaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggtgagtgctggtcctctggtgttgtattggagacatgtcctctggtgttggagatgatttcatggcttcaagagtgatgttcttagaatcaaaaatagataggtgtaatcctcaaagagaccccaagcctcctttgtaacacattttatgactgttttattctgccttgtttttctaaggctttaagaaatgtttctgcttagatggaaagggcaagtttgctgcttggtgattttagtgcagtagcccattgctcccatttttcagaagaggaatcgcggggtagggagtcgggggagtttggtcttgccccagatcaccacagtcagtgatgggggtgggccatctggctgctgattcatttctccttctgttacactaagcctgcctcagatttccagccggagtg

SEQ ID NO: 106252 - DNA, 1083 bp, Homo sapiens
tatatcacattttgcttatacattcgtctgctgatagacatttgggttgttacattcttttggctattgtgaataatgctgctatgaaaacatgggtgtacaagtgctgtttgagaccctgctttcaattcttttagggatatacccagaagtggaattggtggatcatatggtaattctatatgcagcttatttttcaggaggaagtggcctcactctgctttttaaagtaggagacaaaatggtcatattaggtgacagggtcacaaggccacatgggtggggctgtgagatatgtccctgtcatgtggttagatgaaagccggggtcagttttggtcttctctgtgtgaccacattgcttcatttctgccacctgagcccaggaagagagaccgtttcatcttctagtttctaaaagatttgaaagtgttgttttattttttatttcctgattgtttaatagatgccagttgccagccagttagcatttgttgatccattcactgagtcccaccttgcttagttctagtgggttgaaaggagagagggctggggtgaggtggacctccagccacaaacagatctttgtggtgggcttccttgcagggttagctatgtgaaaagcattcgtccatgagctaatcagaaatctttgtaaaaatctagttctctatgaagcatttactgtagagcaatccttaagcacccttctatctgagtaatcagaggggtaccagttgtctcctttcatggtaagcaaagctccgcagaagtttacagagttggggtgtggttcaactttctaaccagccatggttagccacgggtgaccaacccaagcccagacctttgacaagctgcagagtacgttgtttcttaggctgctggagtcacacgaagtggaacttttagtattttaggtgcatgtttatttacttacttatttttgttgttgtcgttttcagatagagtctcactctctctctctgtgtgtggagtgtcgtgatgccatcacggctaactgcagccttgaccttctgggctcaagtgattctccctcctcagcttccctagtagttcg

SEQ ID NO: 106253 - DNA, 1026 bp, Homo sapiens
aaaatctgtctcgatgaatttgctcgatcatcttaaaataaaaaggttaattaaaaaaatgattgaatataatttttaaaaatgtcaggcaatacaataaatgctgtttaatgagaaataagcttcgctcctccctgctgtgttgcttccatcaaggcaagctctgctactacttattaaccacattatttccacaattttatatagactcctgactgaggttctctgaatatcaaaattggatattacttcaataacatgggcaaaattaaggctttcgacctgcctgattttccttgtcaaggcagtttgtccccatttcccacatgggatctgcagggctgggtcccatctctcagttccctgaaagagatgcagtgggcgatggctcatgacacaccctcgcctggcttctaacatgtctgtgtaaacctgtggcaggaatcgagcccactggaaacatggtgaagcagccagccaagttcactgtggacaccatcagcgccgggcaaggagacgtgatggtgtttgttgaggacccagaagggaacaaagaggaggtatgttggaggatgctgcctctcctttccagcacctcatggagcttttggggcttgtaatgcggccagggactgtgcctccattttcatttcagctcacaaccaaaagtgttttttaccaaaaggatactgaggcttatagctgttaaagtaacctgcccaagaggtgagccttgaaatcaaatttaaattgattgccagggacacagtgtttaatgaaataaaggatactttggatttagcaaaggtgccttgtcagttgaggtttatgtatgtatttatttatttatttatttatttattgagacagagtttcactcctgttgcccgggttggagtgcagtggcacaatcttggctcacggcaacattcacctactgggttcaggcgattctcctgcctcagcccggctaatttttgtaacccaagtaactgggattacagggacctgccaccacgcctggct

SEQ ID NO: 106254 - DNA, 1020 bp, Homo sapiens
tattcttggcatttagcataatttgcaattctaagtttacagatggatggtccatttcccccaccggggcagggattgtatctgacttgctcatgttttatttttagtacctaacactgggccctgcatttcataagctttcaatgaactattgagtggataaaggtttaagtttcttgcttcatattctctcttacctagagagtgccagcctgacactggacactggagagtcctgactctgttatgcctctgtgctgcatggttttgtttctgtgacttcaagcagtttctctctaggggcgttgtgcaagagggacaggagctcgccagcaccttcagtgtttccgacctggcagctcctgcagaacccctgctgacacagcatgctccttactcacacccggcaccttttctaactgttgcccaccttccctcctaggcacaagtgacccctgacagtgacaagaacaagacatactctgtggagtatctgcccaaggtcaccgggctacacaaagtaagatgaagcagcatggctgtggcttgggctgctctggggctaggagaagaaagatagcccaggaagaagagtgtttttcttaagtgaatttctgattttcctttctgattatagaaggatctatgctcatgatagaaaattggaatcactaggattccctctactagctaggatgagttgtttgcaatgtcgtaagatttttccaactccatctaggtaactaatggttgcagctgtgtgtctggagtgtagatgctgtggtgactacactatagatgggttctttgtccttgattctttttttggagacagggtcttgctctgtcacccaagctggagtgcagtggtgtggtctcagctcactgcaacccccgcctcctgggctcaagcgatcctctcacctcagcctcccaagtaggtgggattataggcacccacaaccactcccagctaatttttgcatttttagtagagaccaggtttcaccaggtcaccta

SEQ ID NO: 106255 - DNA, 1038 bp, Homo sapiens
tcaagtataggttcacatgaaacccaacccaattaccccccaaaaatttcagagatgagaacagtgactcaagttttagatggaaatcattctactttgtcccaaatccatgtatctaagaatgattttcgtcccttgaaaaaacagtttggctgtggatttgaaatcctggaactgcatattttattctgagggatagtggcccattcagcccccgaaaggactcaatgtccagagattgaaatgtgtttgtttcctattaaagagactaagtgtatataaggtcagcatttttattttgctaaaggtgtgatgtcccagacccagctgtatggctgaaggggccaggtgggagtcccattcaggctgttaaacttggttccagggctccttattctagacaccttgtgtgtgccatcatgggagggtaggagaggtgatcatcaatgtatgtggcttgatgtcagtcttgctgggcacagagaagtgattatgtatttctcacctatctgtcacctataggtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggtaacgtgcctctcctccatggatctgacctttgcgctttcttccagaggctgaaatataatcctcggggacttgaaggcctgaccttttgtcttttaaatcaaataaataatcacaaagacaattttttcaaatgtgttatattagatttttcaaaaccagcttttcttctctaaaatactcaggcttcacttgaataagacatacttcttgaattgttggcttcttttccatgtagtaaatagaaaatgcagaagaaggaaacattcaaccataaacccttcaacccctagaaaatagttgttaacatcttggtgtggacctctctgagggcctgtctcctgtttacttgt

SEQ ID NO: 106256 - DNA, 1018 bp, Homo sapiens
aaatgttagactctctccctctgactttgttgcccctttttttctgttttgttttgttttgttttgttttccaactgtactaccttttctaacccacacttgcctttccctgttctgtcctctgaatctgcgtctgcagacgtggcttcctcttccgaatcctacctctgggccagcctggaccctgaagctgttggcttcctagttgagaccactgggccagaggcctcttgcttggtaagggctggttgggtgggacttccttgccagttctttgtgctgcttgtgaatgttagctgggcccgtgttctgtgtgattttaggaaactctgtgcaggtgttattattacagcctgtccagccggaacccaaacccactgtctaattgcctttaaacacatctagggcttttttagatggtgaaggagctggtggtgcccttcagactctagccccatttaatgtttatatgaactcagcaattactcttttgatgttgagactgttgcacatgttcataatttccatgagtgtgtgtgtgtttcttaagacacattaaagccctccgaggaagtcctgtcattgtattgtgactgacttctggtatgaccaacttttctccccttgacaaagaaaaaacaggcaaaaaaaattctaacatattcctaagcaaagctcttttttacataagagagcattttgaatagctttcctaattctactattgttttccaacctttcctcactcgtggacttcctttttcttttctggcctgtacatcctatactatttagcatttaatgaataacctttttcttttaatttactaacatcctctctcccacctaaatgattttacatatgtaaaaaaaaaatatatatatatttgcaggggcgcggtgggaaggatacagggtctcactctgtcttttgggctggagtgcagtggtaccatcatggctcacttgtagcctcgacctcccaggctcaaatgatcctcccacttcagcctcttga

SEQ ID NO: 106257 - DNA, 1046 bp, Homo sapiens
acccggaaatgaaatcagcaatggtgtttactgctaattattgcctttatagccacccacattctgaaggccttgtaacagacagcacgaaaagattggtctgcctcagccaaggtggggctgaactggtctctttccaagctgtgttggttgtttttgcctggttgttcaggcggaagacaacaacatttagacacttaaaaatggctgacccaggttttggaacccagacaggcattttcaagtactgcattttccaagaagacttgaaaaagtccagtctatccaattactgagcccttgagtatggcagtgaggtttgaataatgtccagcactcggccttaactccctttcacaaatgaaaggttaaatgctggaagcaggagcacagcatggatttgctgtgctctcctgttttctttgccaaagtcacttttctccagtccttctgtggtgtcactggacaaagttatattgtgtctgtatttgctagcctggtgtgctccctgagtgggacccctggtcttgggcaactactgcatactatttgtgcaaagcaaatattttcttggcgggtggctccaggttaccttggctttcacgactctgactaaagaatgaaagattgaattgatgtcaaaactgtgcttgcagcctgcaatccaaatgcctgccgggccagtggccgaggcctacaacccaaaggcgtccgtatccgggagaccacagatttcaaggttgacaccaaagctgcaggaagtggggagctcggtgtaaccatgaagggtcctagtaagtgttcctttgtttctctatctcaggtgtggttttggctaactttgcagccatggcatatggatttcatcccacggccagttgtcctcaataatcccagaaggctatgtcaaggatttgaggctatctgggctccttggggaagacggcagtgattgattagtaatgtctgccctggatgcggccagtgggtggcttgacagctttacattacatcaagacttctgggagtagaaaaagcagtgatgt

SEQ ID NO: 106258 - DNA, 1050 bp, Homo sapiens
ttaaactccgaataaattcagttagccttgagaaatatttgggcattattgggttccgaatacctaccacgcttttttttttaagcctcccatgccaaggttacagcacattcattcatgtatgagataaagcccattcaaccaagttttctggttatagcataagcaggatatagtgtgtggactctctcactttccagggtcatagtctggggaggcctgcacacaaaggtaaagggccaggaggctggtgcaaagcagcgtggcttgagtgccaacccagtggccacctgagctcccagaagcagtcacattacattatattgttgacataacagtagctatgggtgagaggcctgcaggaggaagggcttggctgcagtttgggatgccagatgaaaggatcaggcaagtggaaagaatgtgcaaaggaactgcagcttatggctatagtgacaccttactttactcttctttgatgcttcttctattcctttccctgtagcccctttgaagttcaagttggccctgaagcgggtatgcagaaagtccgtgcttggggccctgggctccatggtgggattgtcgggcggtcagcggacttcgtggtagaatccattggctctgaagtggggtctctgggtaagtggacacagctgaccagcatcttctggaggactgaggattacagggcttccgggctgtgtcaggctggatgttggggccttgcctagcctcaatacctttagcttcctggcctcctggccaccctaagccatctctgcgtgctgctgtacatttgcagttgcctctgataccagcattgattcattcaggagaccttgagggcagaaaccttatgtgggtattgtgcctaaaacaatgcttggaacgtagtaaacacttagcaaatagtgttgactgacctttatagtttagatgaatgaatgaatgaattttgctgaaatttggatttggaagataaatatttcctttggagcacagctgaagtatattttaaatacatgtctaatgtatatatgatcattt

SEQ ID NO: 106259 - DNA, 1156 bp, Homo sapiens
acccttctgtttacctgtggtaatagaagtctgctcaccactcgctaagtcagagtgatgctaaggttcaccctttgttgaaggctccctgagctctggctgttgcttcaggggctttcctactaagactgtgtctctgctacaggaaatccccgccagccctttcagagtcaaagttgacccttcccacgatgccagcaaagtgaaggcagaaggcccagggctcagcaaagcaggtaagatggcacgtctaggttgtcctgggcccctctgccagccggtggcactgggcgtgtttcatccacggccttgaggaacttcatctccaccaacaccaacaccaagctggcaggttttctgtgcagctctgatgcagcagtggctggccaggcccgttgctggctgtcataatagacctggtgctgttgaacctgtctgacgggttctcaaagtgaaactactccagctggtctgtctcctcacttcacagtatatctttccaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacaggtagggtccttctcccctctgctcccctggcccccagccaggcccctttctatgcagtcggtgctgggtcactgtggacaccaaggggtgtgagaggtgctctgccaaagtgctccctgatgggaggcagctcctggcactttgaacccctctgggagcacctataggaagcccaatgggttctatcaggtgaactgcagaattccccaaaagcaagcaggaagctggtcccatatctccacctttggtttgcattttatcagagaaatgctcagttcttgatattcaggccctaatatctatctttctgttacacatgtgcacacatgtgcacacacacacacatacacacacacacgtgcattccctcgcggcctcaccagctgccttttagtcttttcattaattacccacagaaaaagagctgctacacctttgtgtttccttcctggtccttttagcttagtttaccctttttatgag

SEQ ID NO: 106260 - DNA, 2967 bp, Homo sapiens
tctggatattagttccttatcagataaatgatttgcaaatatattctctcactccttggtttgccttttcacgccgttaacagttctcgtgtgcaggttataaacgcggcttcttatctccagacttgctcttcctgtgctttaaaataaaaaatccaaaacaaaacattcattattagtaatgataaaactaacacttttatagatagagcattcttttctcatcaggccactcaatagtaagtaggtaattattttcctgctgatggttctgagggttggtgggagccttactactgggtgcaccacgctgaatcttctttgttgccaaattctccatattctttaggagaaagcaccagaaagccatagctgtctgcgtacaatgactgggatcacaaggccatgacgtcttctaaaaacattttgtgacttctgctttattctatgtctatatgccttttagtgttttggctgagccgttagaaagtaagttgcagatatcaggacagggtcagggtttgacctgcatccttggaaaggactgcagaacccagtaccccagacgtcccctgctgctggttgaggcagaagtggagattaggagcctaggtccggttttgtcccctttgaagtaatgctggagtgggaggctccttacttcagagtcaccccaaggtcacattcatccagttctctgatagcagcaggtttgagaactgctgccatgctgagtactcacttagggctttgtgtccggatgctcccaggatgcattcaaggagccgggtgggccttggtggcggtcgttgccaccaagtggcaacatccaagctgcttgaagccacccacaaccccacaaccaagagaagagaagaccaaagtcctcaggtaaatcacaagtgtgaatgacttgcagggtggcactggggtccttcttgttgtttgttgcttggagctgggtttattgtttcattatttgggcaacttgcaattctgcctatttttctatggcaaagaacacattaaatctctccttagattgaatttccttcccacccccacccccagcacagagcctggccctataagtgctctgtgtggattaatggctgtgagtgagcgaataaatgacatggcgcctggattcacaagcggagatggcctaagaacgttgtaatctggtagaggagtgatgccaacacctcctcattctcctttgaactctgttttctgaagagcagctaaaagctcaagactgggctaaggaagtgtgcccttggatgtggttaagagacctgggtcagcccagaaagccaccccctgacacgggggagggagcatactttgagggctgacacccacaggcacaccttctcatggtagttttagggtataacaggctggaaatccccagaaaggtggctgcttgggcatgggtgtgtcctggcctggtgtgggcgcttccccctcagaacacaggctgtgccacgtggggagccgaggtcctgcctgagtaacccaggtccctgattgctggttttgctccctgacacctgcaggcctgccactccacctcgcaaagtccctgagtgacagcttgcaggtgcttgcctgcctggggtggatgagtgatgtggatggctgtaggatcctgtgagtcccttgaggatgcaaaagtagagcgcgttttgccttagaggaatggacttgttggcttggggcttgaggaccctcccagaggtcaaagactcggttttatagaagggaagtgatttccctgaggactttggtcttctcttctcttggttgtgggtggcttcaagcagcttaaatttctcaccgcacgttcccctgcgcagagcagtttgagaagctggtggcaatgtctccattacgtgctgtgctgggagccactaggattggggaccactccatgtagtactctggcacctttagaaatccctgtgagctcacagaccctcacagagtaacagcttctaccttgaaatgttcttaacgtggtggtcctggctgctcctggagggccctaaaagggatggtgctgagggtggctctctcagtcccatcctcttctgagctgtctggtcagtgtcttgtgtatgtatattttgaagaataagattcaggtttcagaagcatgtagaggagagtgaaactgtcttgcagcctgcgaagtcgtggcgaaatgcactggccatcactacccagacatccctcacttcatagccctgttggggaataaacacagtccattccttagttggggcctcaggggacactttaaaatgctgtaggcattgtaggtgtaaatctccgagattttttccctcccccttcttaggttatttaaggtacagttcattttctatctgagtttttgttttgtttttgactggtaacaagagcatactttcttttatgggatgggtgggcttaactggaagagggtttttccctctcttttttagcacttcagagaagaggccagaaaactttatgcgggtgagggaggaggtatccccaagacctctggttagcctgaggtctgcttagtgagcccctgaattgttaggggctgtggggaaacggaagctcgggaagagttggcacgttgggaatgccacgttggctgaagtagcgagtcagtcctgccttaaacagtacaaaaaggagacctttcctgccccttggctggctcccagctctgttgaatttgacctgtacacattttaccaggaaatgttgttcacatgaggcagggggccaattggttttgtgtgcagtgcttaaaaatgctggaaaattaatcctctcttcattgatgcaaccagtttttttttttttttcttggcctttacccccttccttattacaaaaggaatgtgacaaaatatacataggccaaatgctacacccttttaacacttgatcagcaacagcttt

SEQ ID NO: 106261 - DNA, 1050 bp, Homo sapiens
agcagctaggacacagatttgggggccatgggtatgaggcccagctcgcacccttaccaaggtgtgtgacttggggcacgttcctttaccagtctgagccacagtttcctctcctgaaaaaatgagatgacagtaggaactaccccttaggactgttttgatcttgaattgaggaaatgcataaaagcacatagcatggtgcttggtgtgtagaaaatgctcattaagttgcttctgttattattagctgctcttatttgatctaatttttctgttattcttgccttgtggtcaaaagctagaagaaatagatctaagatactttctacattgattggaatcaagtctcccctgtccgtgagaagaatgagggatcttgaggggattttaaatgccaagttagctttttggtacccaaaggtaaactgagttttctctcttgttccagggcaacatgcaggttctggtgacttacggtggcgatcccatccctaaaagccctttcactgtgggtgttgctgcaccgctggatctgagcaagataaaactcaatgggctggaaaacagtaagtgcctgaatggagagcagatgggttgttgatgaccccccaacgtggctgctggttagattttcttcaaaaggtgaaatttgcagagaagcaaattctatgttaagagactttgcagttgcacagactttggttcgaattaaggccgtggtgtgaagtaactgtgactgtgtctgccccttagccacaccgagactcagctttctcatttgtacagtggggggtggtcggcggggagaggttgagaacacccatgggaatattttgaaaattatatgagctaatggttcagaggctggcacgtagtcagccccctggcattgcagtaggaagttttcattaaaaagagaatttgggctatgttgctttctgatgagtttctaactgtgccagctatccttggcaactgaatccgcactaaggttgcgagtcaagcataaatgccaaatccctggcactcagaagtcactaccaccacacc

SEQ ID NO: 106262 - DNA, 1603 bp, Homo sapiens
gctcccagttgcagagatccaaagtgagagctcactgttggcttttgtggctggagcagccagctctgagtgtgtaaacgtccactgcccaaccctgtcatgtgtccccttgtcactcctttccccaagacactgagagctttgactccagaacaggaaaagcagggtgccaattaggaaagcctcttttccggtgggaagtagcgatccgggacctccttgcctgtggttcggcagtgtccatcttgccaggccctatgttccttcagagtcaaggttctctgggttgtggcaggggccctgtgttcccagtgcttttgttttgggtaaagtcctttccctgttcttgtctaatctaacacttgggcttcctgcagccctgctttgcagagaccttttggaaaccatcacggtacagtcagttctcagcacttgcttcaatcggctcgcatttggcagctctgtgacttctgctttcttgagggggaggggtgcctataagatggagttggctgccaagaattagtaaataaaacattgacttatgagggtgtttggatatcaagttaacaccaaaagtaagtaaataagagacgacagtgtcagattacaactttctggtcagcaaagattgtggggtcaggtaaatttcactttgagtcccagcttggcaggctgctgcatatgtcaccctggacaagttacttaacctctctgagcatcagtttccccatctgtgaaagccattggttaataataaataccccataggattgtggtgaaaattaagacaataacctatttgtgcttggcatataaaatgcattcagtaaatgatagccgttattgctgtcatcactaattgattattgtgccgacacttgttgttactgaggctgagatgctgatgatacttactcagctttgctgcttgtcctctgcagcagctgttgcttacagtggaggctgagataagtccccgtgtccaaagaaccattgcttctgtgctctggattgttcctgctgctgaaaagggtcagctcttcacctcagcttgtgtttcttttccaggggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtcagcctttgcttttgtcccagaacttgtctcattgctgtcaaacatgacaccatagtccttctctggttcttcctggcaaagaccttctgaaaatcgttttgtgatgaaagttagcacaattcactgtgaaaggtcccctgggtaggtgggtcacaaccctgctcctcctcttgctctctgactacaagactttggtgaggggctccctgtcccagagtcttctttcttcgcttgttagcataatcacagtcctcactacaaagcca

SEQ ID NO: 106263 - DNA, 2278 bp, Homo sapiens
acctggccaacatggtgaaaccccatctctactaaaaatacaaagattagctgggtgtggtgacgcatgcctgtaatcccagctactcgggaggctgaggtgggataatcgcttgaacctgggaggcagaggttgcagtgagctgagattgtgccactgcactccagcctgggcaacagagtgagattccgtcccctccaaaaaaaaaaaaaaaagttcatcgtcatttcttcatagtaaccctgactcaaggggttttggaagatttccagtggtctcaatggtgtgaatcctatgaaggtgtcttatttgttgaattagaggtgaaagcctccttcctcactcttttttagaaacagtttagttttattattatgcagaatttgttgagcaaattgcaacagcccaagccacagctagctccacaagagcccttccatgagccctcaacctgggatctcgtgtatctttgttggaatggacattaggtttccaagtccaggcctgtgatttagaagggtcaggttgggtaggagagaggagagtcttggaggggctgctccatgggggtcacacctctctcctgtgggttttcgctggtgattgagttctgaggcatttgctgcattgactgttgtagctttaactcgtgtgcacgtgtgacacataaagccccaagagaagggctgcctggctcagatgcacttccatgctgattatatgcatgggtgttgaaagcagtgctggctgagcagcgatcccagtgcagtttgactttattctttgctcaaataggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcgactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaaggtgggtttcatttaaaaaaaaaaaaaaaaaaaaaaagacaagctgggacttaagggctacctgaaacttggagctgcaaactcagccacctgcaggagccaggtgacatataaggcggtgctcacctgttccctctgcctcggggagtagttggggggccctggtgaaggttaagcacattgcatttctggggaccgtgctactcaacccctgttttctgtttctccatggggaacaggacctagcattgtcagcagaatctctagttttttggcaaaggcagaaatcttgatttttctctggaaactcaacatacaacatgttggcatttaattggaaaaaagtttaaaatgtagtgttgtctaacacctgcatgccacacagcaggttagtcttcaacctttaacctgtcctcgagcccggtgtgagcagtcgtgttgtcacttagccgtggctactctagaaaggccttctttgggatggagggggttaatattcttgatttgagagttagaaaaaccagttttccagttactgaaattggacttcatgtgtcctgaagtgccaagaaccttggttctggggtttgcttttgggtctggggtactggtggcagtgttagctatgtgcttgctctgcagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtgagccgccctgtcctcggactggaccctcgttcagagctgcccttggtcattgcctcctggtggctgg

SEQ ID NO: 106264 - DNA, 1022 bp, Homo sapiens
cacttcaggtggccgagacgggacaattgcttgaggccaggagtttgagaccagcctggccaacatggcaaaaccccatccctacaagaaatataaaaattagctgggcttggtagtacacgcctgtaatcccagctactacttgggaggctgaggcatgtgaattgcttgaacccaagagacataggttgcagtgagccgagaccgcgccactgcactccagcctgggcaatggagtgagactctgtctcaggaaaaagaaaaataaatgaagcataagcattgaaaatgaggggtcagagtgtctttacttacattatactaatgtgaaattccctatgtgagaggtgtagtaattgagttggggtggctacgtggaatagtttataaagggaatttgcatgaattttggcaataagcagaccagcataaataaatggtgcacatttcactttcttttccactctttccagaggcgcaggaattggtgggcttggcataactgttgagggaccatcagagtcgaagataaattgcagagacaacaaggatggcagctgcagtgctgagtacattcctttcgcaccgggggattacgatgttaatatcacatatggaggagcccacatccccggtgagctattcctcagagaggaccccagagaataattgattttgcaggaaaatgggtttgattttggttatctctctgagtggggaaaacaatctgatatttgtaatagctgcaaaaggagagtttttcttagggctacatctccaagattatctcaactcccagtagaaccggtaacatggcaaaaagcatcggcttagaattttgactggaaacagttgtgcgtgtgttggaggacctagttcttgattcaggggaaagctggttctttacaaagttgaaaatcacagtggctcacacctgtaatccccaaactttgggaggccaaggcatgcagattgcttcaggtcaggagtttgagaccagcccaggcaacatggggaatccc

SEQ ID NO: 106265 - DNA, 1022 bp, Homo sapiens
attagattctcataggagtgcgaaccctattgtgaactgcacatgagaaggatctagattgcacactccttgtgagaatctaactagtgcctgatgatctgaggtggaacagttttatcctgaaagcattcccccaccaggccccctggtcttctacgaaaccagtccctagtgccaaaaaggttggggaccgctgccttggaacacactcaggacaaaaccagtctgtcatatgatggttactacctcatagttgtaaatttctgctagacttaggcaccttgactaactcactgtcttatctgctgtagaaatccccttttccatcccactcttatgtgtaagaaaagtcagatgcagctgggttgacatgtatctttattgactagggtgtgtgtgtgtgtgtctatcaagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggtaacttggagttattttctgagccaaaccttaatcctaagacttaatttctgggccagatttaagaacaagggtttcaataaccgatttctgactcaatgcaagttgtttgttagattttcccaccaaagagtcagtaaatgtgcagaagcagaagcagctcacctgagagatttgagggtgtagctccaagaaccactttttggtgaattttcatgtttttttactacatctattcctatgtttttatttttattttttttaaagatggggtttcaccatgttgcccaatctggtcttgaactctcttgggttcaagcagtctgcctgcctcaacctcccaaagtgctgggattgcagacatgagacactgtgcccgtcccctatgtttttatttttaaatgttttaaattactctttggttcatttaagactaagttatgctgcatat

SEQ ID NO: 106266 - DNA, 1343 bp, Homo sapiens
cacaattcacattacctagtggcaaggatgctaggaagtggattcccatcttctgggagcggtgcacctagctaagagttatggtcctgttaataaagagaaaagggagactggatgtggtggtgtgtgagcagaagcctctgcctcctcccctccctacatttcagaggatttcgagctaaaacactcttggttcacctgacaacaaaattactaaaaattggccatgtctgtcatggtgttaaagggatctgtgaccctctactctccctaccaaaaaacaaaacaaaactagattgtattaagccatcaattctgtctgtttccactagaggcactaattggaaaatatgtcagggttttccatgaatgttttctacatcttgacaacatcctaaatagcatttctctatgatccacaggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtgagtacagggcatctcaaggtcaggggcacaggctttgcaatcagaaagccgggccgtagcccttctctgtgacttacaagctacatgatctgggcacgttgctcaacctcactgaacttcagtttgacatagattgaagctctttgtttttatttggagaacatttagatccaagaagctcttctaaggaacagagactgttttacagggttactgcaaagattagatgaggtcaggcatgaaaaatgcttagcacagtgctaggtacatgataactattattatatgcttttgaaatgttgagaacccaactctgatggcggctcccatgaaaagcagcacatttctgccttttatgagtagatagttactcaggattcattcaagagcatttcaggtcagcattagagaaacacatttaaggatctaggtttttttcatcatgcatatgtaaacctctcaggaattctccatgaatatttgagcatcacagtttctttggtttctttctttttttttcccctcctttttccttcagtttctaagacacaactattgactgtcacaggccattctttttttttttttttttttttttgagatggagtcttgctctgttgcccaggctggagtgcagtgacgcaatctcagctcactgcagcctcagcctcctgagtagctgggaccacaggtgcccacgaccatgcccggctaagttttgtattttt

SEQ ID NO: 106267 - DNA, 2110 bp, Homo sapiens
gaccccatctctaccaaaaaaaaaaaataataattagcctggtgtggtggtgcacgcctctagtcccaactgctcaggaggctgaggtgggaggatcacctgggcccagaaggttgaggctgtagtaagctgagattgcgccactgcactccagcctggatgacagagcaaaactctgcctcaaaaaaaattaaataattaaccacagtagacatttatcaagtaaaaaaagaactttttcctgattctgtgctgcagagatgccttgtgttagtttttacctacttacacttcacacacctcactttcatgcctggggtcacaccgtacatactgctttcgcaccttgcttccttccctcaatgtgtcataggtacccttacatattgattcattggacctgactgccatgttccactggacagactcaccagaatttatttgaccaaatcccttccagatggacattgggttgctttagttttgcacgaccacagacagcaccagtcaaggtccttacacacatcaattaactatggagtctcccgccagcttaggtctgcgtgctacaagtggggttgtgggctcacagggcatgcgcatctgacagttgaagagaggacaccaactgccttccaaaagggcagtaagaaagtgtccttcgctagagtgagtggctcactgcagttcaagatggagcagtgggggaagcagctctgtggtggtagtctactgagtgtatccttccagtatggttcccaactaatctccatttgccactgaccaggccacagatggggaagtcacagccgtggaggaggcaccggtaaatgcatgtccccctggattcaggccctgggtacaattttggttttttcctttttgtgtttctgtgtttactcagccttcatttcagaaaatctgccatctgcttctgggattgcttaagccctgtgggtgtcctggtcattggtgtgcccctcactgatcagcccatcacgatgatccctgctttttctgtaataagatcacctttgcgtcaccatccgtgctccacgaatcgccagccgtcgtgtctgtgatcacgctcggtgcagtttgtctctgtgtttaaagagaaagacagacagctgtctgcagccctcctgctgcctctcaaagccgccacttgcacattcagtttctgttcagggggaaagccacccactgctactctctgccacttaaaatgcaccttcttttccaggccacaagcaactaaacctttccagatggagcctcttgggactcatagacattgctgtctctcacttttccactttcccgtgggtgctgctgggaattttacaaacagactcccgagtgattgctaacagttggtcagcatgacctctccagtccctcaggttctaccctgggtctggagccacttagacaaagcccataccacaatgggcagccgcattcccaaatcccggcctcactggcttgtagaattcccagcagctctaacccctgtagcttcaccagctcccgctgttgtctgctttacccagtgaccactgccttctgtttttaggtgaccgaagaggcctatgtcccagtgagtgacatgaacggcctgggatttaagccttttgacctggtcattccgtttgctgtcaggaaaggagaaatcactggtaagcacttgccataaaggccgtctcattctcacttgctctcacgagcttcccagaatggtgctggggaggtgtgtccactgtcccccagacccaggctccttaacccagggtcacgagttcttggtctccggtgttgggccgtgggctcctgaaactacagaatatgccacgtgtgtgtttctctgaagaagtggctcactgacaacttgcattactttcttgagcagtcccatgattctctctaggttaaaaactgctgtgtttagatacctcatgactgtcgggttcttgtttgcccctttttcctgccttctcttatttgacttttccagatgtgactttgacactgagtctgtcatacaggagttcctttctcccctcagcctcttttcaatggcccacttctctttggtttgatgctctat

SEQ ID NO: 106268 - DNA, 1020 bp, Homo sapiens
tgagtggctctttttgataaagctgtgtgcccattcccgtggtattcatggataatcccaaatctgtggttctaatgggatttccgtgatggcagccagtgcctgatgggcagggacaatccacctctgccctccaccacccaccgtctcctatgtgtaattgatgtacacggctccttccttttctcatcccatgcatcctgagagtagagagagctccagggttacttgcagtgaagaactcagatgtttggggtttcttctcagtgggtgtttttactgcgtggactgcttcattctgacagatgtccctttgcccacagctcacgtggagtgcgtcaatccattgtccccagcatcagggctgccctggatgagttgttaaaaggaaactcttaaaacaaggcaactctctccctaacacccctgcatccctgttcccacttgtaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacaggtagggttgtctggcttctggggtcttcctcgtgggaagtatggctgcctctgactgccaccctccttatcagacccctggcagcaggctagacgtctctttgagtttaggtttcacagagacttgttgaggaggagcaggggatggaatgcaattttggattagctaaatccttctcttgctgataatccaggaaaatgcgagagctagtatttggagcacacttttattgtgccagtgtgactctagggtgcaaagagaaagctctcagatggagtgttcgaatcatacttactgcaatagtgcatgaagtgcatgagcttagacatgcccttcagcgtcactactaggtaaattttctgctatcccttttacagatgggaaaactgaggcttg

SEQ ID NO: 106269 - DNA, 1334 bp, Homo sapiens
ggaagatgcacaaggcagatcctgtttccccaccgtatttagacctgtctgtgaagcagccagtagtactgtgtggaatgtggtcattgtttacctagaaatgcccacagccatgccaggcaggtatgaggtgccttcaactaacaaaaattcctatattttattttatttttgagacagagtctcactctatcacccaggctggagttttagtggcatgatctcggctcactgtgacctctacctcctgggttcaagcgattctcctgcctcagcctcctgaatagctgggattacagcacccaccaccacacccagcttatttttgtatttttaatagagatgaagtttcaccatgttggacaggctggtcttgaactcctgacctcaagtgattcgtctgcctcagcctctcaaagtgttgggattaggcacctggcccaaagattcctttaaaatgtggtccatgaggactcaagtctctaggtcctgccagcttcttgtctttgctgcaagcaggcatgaatcccatcattcttcattggttgggtctactcagtgttcaaggctcatttttttttcacttaactttgtgtaattagttcttgcgtgttcatccgtgaacagcatatggcatggcagctctgtgaagccagggtaaccacatgtaacgggagtcctttttgggggatgtttcccagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggtgagctaggctacccttcctggctggagccaggacatcttgggtgggagatggggactcttgcagtcctttcttgggaatgggtagcacaatggagtgtgatgtgataaacctgctgggtcacacgcacgataaatgcccaagcgtatttgtgcattgtgatatcgacactctggattgttgggtgtcaggaaagaggacatatttctatttctgagagtgtgtctctctcctgcttcctctccgccatccccttacaagccccaatctgtgttctggtccaggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtgga

SEQ ID NO: 106270 - DNA, 2001 bp, Homo sapiens
tcttatctgctctcccacccttgttctcagcttcccagcgtctctccaagcaaagaatgttgggttgattggccaagaccatggtcatctgagcagagcttttgtggaaatgaagcatctctttctgttttctctttgagatggtttgagttagattgtgtctcttccaagcttgccacaccccagtgcctccagtcatctgctttcttgaaggatggccacgctggtgaattctagacaaattctaacccggggagagggctggagaatttctggtcctggttgggagatactccctgttaaaccttcggatatgctgacctagctgaggtagccaggggctatttaaaaattcaaaatctcagatctggctgtggataaacccccaaggtggtacgtgcagtacttggaggcgtgagggcagaaggtcctccccagcagtttgtacgggacacatcatctatgggatattagtaaatatccttaaggaaaggcttctgtggtcaaaaccaggttcagcaggttatttcactatggggcttctcaggacgcttaacctactcatccccctctgggctttgcaaacgaggccgccattgctttctttctgctatgtagaaatagattgaggcgtaagggtcggatgtcctttctccattcatcaggctccctcttcctgaggagctgctgtcagaacagcctggggctgctgtgttgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctggtatgtgcattccattcccctccaggtgggatgcttgggttttctgtaaatgctgtgccttggcctctggcctgctcacaggagccttcttgggtcttgcagggagcccatttaccgtgaagatcagtggggagggaagagtcaaagagagcatcacccgcaccagtcgggccccgtccgtggccactgtcgggagcatttgtgacctgaacctgaaaatcccaggtgggcgtcggggactagtagggtggggaagccttggctccagccttcagggcagtgggtgcctttgggaaccaagtttaggcatggcccagaacacagtatccaagtcggctgtgctgaccttttcatttcacttcatttcattatgttcttctatgtttattttcacagagtctcatccaagaaaaacaaatgtttaccttgctacctttttcctcttccaaataaaaatagctttattgtgtcacatgggggaaacgtagatatgcttttagatttttagattaactatctgtcaaatagaatcatgtcagtgaaagaactggccctgccgatgccagggtctggaagtatttaagaggtggcagcccagcggcatccttctagtatttctctttcattcctgaaattagaacgagggctgtgctgcagaactcgctgggccacatctagccctttggtggtgaattgttcttcttgggccccgattagccagtcaacaggtcacacagtctgtctgaaatgtgttccaagttctttctataaagaatccttccagagggaagccactgtgagtgaaaattttgaggctcctctgcccagaagttggcatgtcctgtggaattgcacaaattctacagagaagggaaatctaaatcgtcttcagatggagcttgtgttgcgagctctggagagggggttgtctttctacactgcatctcccatccttcctaacgagtcacggagctgtcgactccgccttcttggctttagttaacaggttcttcttgtgtagtcacatcaacgtcgggtcacatgggaatgtggtaaagcctcattactgtagagttcagacatgatcacttaaaaagagctttattgggccgggcgcggtggcttact

SEQ ID NO: 106271 - DNA, 1964 bp, Homo sapiens
ggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccaggtgagcattgcgggcaggattttcacttgggaagaatagagttgagcccaggcagtgtgggcacccacatacttttttgccccatttgaaagagaagacttctgataggtggcattaagggcattatttaaaacaaggcatcatgactaagtctggcacagtttgtaactaagctttgctcacttacgtaaagccaaacaggtttcttactgggagcctccttggagcccgtatcttattagtgtgcacctgagtctctaattggggagcagagtaatacggtttccagagcatctttcagggctgatgttctgtggaacatactagaaagctacaaaactgactgtaagcatcctttcctgtggttgccgctggtgggaagatctgtagggaaaaaatggaacattctcatctttctctggcttggttaaggtgtattcattttttaaattttttatttaatatctttttctctcttgtttgttagagatggggtcccactatcttgctcagactggtcttgaactcctgggctcaagtgatcctcctgccttggcctcctaaagtgctgggattataggcatgagccactgtgcctggccggttaagatgtattcagggctgggcgtggtggctcacacctgtaactctagcactttgcaaggccgaggcaggcagactgcctgagctcaggagttcaagaccagcctgggcaacacggtgaaaccccatctttactaaaatataaaagaaattagctgggcatggcggcatgagcctgtagtctcagctactcgggaggctgagacaggagaattgcttgaacacaggagatggagcttgcagtgagctgagattgcaccactgcactccagcctgggcagcagagcaagactccgtctcaaaaaaaaaaaaaaaaagacatgtcttcagaggactccagatgtcctgtgaatttagttatcactagtgatgcttaggaaacttcagcaatggaccttggaccttgcttgggttctgcttggggttggagaaagaggaaagggctagcaacagacgaaacctagcactgcaggtttgaacaaggatggaagagggacaggggctctgtggggctcagtcactaaccaggtttctctttgctctcagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtatgtattcagggttcacaagaggacattttccttgtttgaacatgattaggttgcaaggaacagaaatccatcaagtttgctgaagtcaatgaggaatctatgtgtatgggcacatgggacagcctcctagaaatccagttgcaagatacatggccagacctcttaagggtgggaacgcttgttctggttgccttttgcctttctccattagcctctctgcttcttgctttcattcaattgctccattctttccaccaaccagcctctgtctgcccacccatggctaccctggctggctgccccagaagagtggccttggcatctgagctccctctagcaggagctcttaaccttttgtgtgccattgactcttgccatctggcgaagcctatggggactgttcttgggataatgttttaaagcacataaaatgaaatatgtcacattataaaagaaatcattgat

SEQ ID NO: 106272 - DNA, 1107 bp, Homo sapiens
aggctgtttcttaagcttttgtaaccagctgctgccgcaggagaagtgtgttcatcagcatcgccccctgttcttcccgggtcatttgatgccgagtgatatgtaaattattgatcagagattttgcggaggcccacgcaagcaacatctggtgctggttagcaaagagaggcatgtatcgttttgtcttgcttttgagactttttaggaaattggagtaggctggcacttggggtgggggtgggatgggagtgatctggtgatcaaagaccctctaattctgtgttctgtcctccctcctcagtctatatcccctagggcagcacagtccaatagtaggttctgcagtgatcaaaatgcttcaagtctatgctatgcagcatgatagccactaaccatatgtgactattgaacatctgaaatgtggccagaggaaccaaggagctggatgtttagttttatttaagtgcattaagttgaaatatatgtatatatggcctcgtggctggtgactaccaaattagccagtgcagctttaggaccttgccatgaagatgtggttcttgggccagttcttggacctcagcatcacctgagaacttcagtcccagacccactggaaaagaatctgtattttaataagatccccagatggtttgcttacacattaagtgtgagccatgctgcttcagagttattgcctgaggagtggctgtccgaccaagtctaaatcaaaattactgacttgtaaaatgctgctgttcaggattggctagtcttaaaatatctcaaatgttgttgctcagctttgttcttaaccatctgaacttctaatcccctcctcccagaagaggagatagtttccaagacaaagtatggggagtgaaactgatccagggaagagcaaaagctatgtctttctatggcttcttgtggggatacaacctctaaatgcatattaatatttaataataagctgacgttttcgagcctctctgtgtatgggctaggccctgtgataaatgttttgcatgcacagcttcatttgatctttatagtagccctcgagatagatcgttattatgcccattttacagatgaggaaac

SEQ ID NO: 106273 - DNA, 1662 bp, Homo sapiens
gctacatgctgtgacccaaacgcacagccacaaacctgccctgtgggggcagttcctagctttgagcttaattaaggagcattaatgccagttggaaccgttttttttccccttcaagtggccaaatagagaaacatagaagaagtgaggttttcttttttcccttcatatatattcctttttatttcttgttatgccttcccaaaacagagacattgaacagtagttagaatggccatctcccaatgtttaaaaacaaactgaactccccaatgggtgaacaaagtaaagagtagtaacctggagttcagctgagtaagccgctgcggagccttaagtggtgaggtcttccaatttcagagtgctgtgtcttcaacttgtatcatcattttagtggaaaaacataatttaattttggtgaaatgagattcatctcgtgacaggattagtaacagcattcacagaatttcacactgaagaagtgaggttttctaaagaaaggaagtgttcttctgaggcaggggtcagagtcttgtcctgtgtttataggatttgcaatgtggatgcgtttcccttggggctgatgagggatacccagggggtctgtctggttctgaaatccaggatgctgagtgccaggctccctgtagaactgttgattttaaatgggccatctcagcttggcctccatcctttatcctcactgaactcaggggtgtccatttgcttgatttcaccctgtgcctttgctcattctcctagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtaacccactcttctgcttcttgaagccttaactgaaccagctccagggaccaagccagatggaaatcctcaagccccatgaaagctttttacacgtactccccgtggaaactggggtcatgcacacttcggaggcgcttgctgtccaaagctgttttgggagttgcggtttgacccacgataaatccagagtgagagctcgatggccgtgttatcacacctcattactgttagttgtgattcagattccttcctctgccaagtttcttgactttcagaacaggatgctgatagtcagggaacacagcacagtgtcattaattttgagggtttctttgcctgcacagaattcatgatgcgtccaagtgggctcctacccgtctgttctttcatggtaccaggctcccagaaatgcactgaagcagcaataagacctgtcccagcctatctcctcctctttttactctcagatcttaatggaggaggagaaaagactgaaatgttcaaagaattctgaagctttttagacccgttacaatttacttttattctttgccacagatgggacatgtttgattatgaaagatacaggcagtgaagaagtaaataaagtgagactcactccatcttctctcctcctcccccacctgggtctggaagcaaacggctctgggaagggaggaccttcaccctgtctgtcatctcattgtctgtcttcattct

SEQ ID NO: 106274 - DNA, 1859 bp, Homo sapiens
ctttggaggctgaggcaggaggatggcttgagcctggaagattgacgctgtggtgagctgtgatcatgccaccgtactccagcctgggcaacagaggaagactttatctaaaaaaaaaaatattagtaataaggccgggtgcgttggctcatgcctgtaatcctagcactttgggagaccaaggtgggcagatcacttgaggtcaggagctcaagaccagcctggccaacatggtgagaccccatctctactaaagaaatacaaaaattagctgggcatggtggcgagtgcctgtaatcccagctaatcaggaagctgaagcaggagaatcgcttgaacctgggaggcggaggttgcaataagccaagatcatggtactgcactccagcctgggcaacagagcgagactctatctcaatcaatcaatcaataaaatatctttccttatcatcaccttacagctgcttcctggatggacacactgtctccttgttgctcacctcccgcttcttccctacgtagccccaggcctcagagctgctgcttgaggggcttcttggctgcacagattagataccatgatgaggttgagatagtgttgggggtggaccttggggcaggagcctcaagagcttccaggaacagctgggttgtgtttgagagttgcacgatagcagctcttttgtttttattgatatccagaacaataattctttctctggactaggagctataattaaaccaaaatatttcccagctggggcagtgtctagggctctggcagaagcatagccctgcatggggatgctatgccaggcatgccccatagagggcactgtagcaggcatgcgccagacctgatgactgaaggaggctctccctgggccagctaagttgtctcagggctgcagttaggggatctgaggcagctccactgcccatccaggggtcaagagatgagcctggcaccagagccatgcagacatggttcaaacccggctctaccactttctggttgtgtagcgtgactggccccctccctgagccgcagagtcatttgtgaagcaggaatcacggaaaggattccataccacatgcgtaaatggtgctgtgcacaggacctggagccggagtggggtacgcatgccccgtcagcgggagctgctgttctgttcctgtgcttgttgctggaattcacggcaaagtgggtgggctggcaggtcacagtggctgcacccggtctgcagcacagtgcctggggtgagggctgaggaggaagggaggagatgcttggcctccctggcttctccaagtctacccggagaagaaaggacagtcagaggggcccacgcctcccccacacccctggagggagagctggactctggtggctgaagcagcacttcaggctcacagtgtgactcaggcttcttgccctcagccacaatggctcatgcccagaggagagaacagggtgtccaggctgttggtgcttgtgggcgaaatgtcagccatgctcctcctgccttggcctagaaaagggagcccccaccccgcagggcctgaggttctctctgccagaagttcagagctagtgccagtgggttcccatgccaccagggtgagccctctgtaaggggatctatgtgtgtccctcaccacggcctcagtgctcccaggaaagccctccaagtcatcaacacagcattttctattcctttctcccaggtatccagtcggaattctttattaacaccacccgagcaggtccagggacattatccgtcaccatcgaaggcccatccaaggttaaaatggattgccaggaaacacctgaagggtacaaagtcatgtacacc

SEQ ID NO: 106275 - DNA, 2158 bp, Homo sapiens
ctgtgcctgtcctgatgcatccgggtggagtaaccaccttttgcctcctaggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatcttataacttattaaataaaacatttgctccgtaaagttgccttggtgttcttggatgatgtcgcttctgaataaattgtttaatcctaggagttcaacaccctcagcctgggtaacagcaagacccagcctctacaaaaaattaaaaaattagccagcatggtgatgcatgcctgcagtcccagctactcaggaggcggaggcaggaggattgcttgagcctgagaggccaaggttgcagtgagctgtgtttgcaaccctgcactctagcctgggcaacagagcaagacagtgtaacacacacacacacacacacacacacacacacacacacacaggcacatcgttggagccccagatcagctctcccaaccccttaagggacacaaaactagcaacttgttttgacaatgaacctgggctccttttgtgggggtggggtggggctggtaaacaagctgtcacc

SEQ ID NO: 106276 - DNA, 1044 bp, Homo sapiens
tctgacacctggctgtcaattgggatcaattgtttgcctctgagaggagggaggaagagagtggaggaaaggtcctctcctcccggagggagcagccttatctgtggcctgcaccaggaagcactgcttcctggactcctatctgagaaggtccgtgggcttcgggattctgcagtggcgggcagttcccccacttgccaaagagtccattcaggctctgcccggtggggtctggccgggccacagtatcatgctagtttgcccacagaggagcacagggcgcagccattggtctctccactgtgaagcctggcggctttctgttgggggaggcagcatttgtaaattaacagcatgggctttggtgtcaggcaccccagagcttcaacgctggctctgccgttcattagctgtgtggccctggggaagtcgccttgcctcacctctctgggtggtcgtgaggatcaaataagagcccacagggagctgtaaggaacaattccctgccagagtctcagccactgctgtctgtgaccaacacctgctggaagtgatgttcctggcagaaggccgccccctggctgcttgttggcatctggggctacacttggttgtcccctgcatgggagcgatggtgatgttaccctggggtaaatttccccactagaagccactgcctcctgttacatcaaagacatcccagggtgggatgcacctctttatcagtcaatggctaggaccacagggcaacccttacctgcacctgggcttggctgctatggaaaccagctgtttgtgcaaataccttgaaaactttgaaacttgaccccggacaggcctggtgccaggtcctttccgacttttgtgttttctttccacctttcactactgactttgcctctttcctaccaggaatggacagggccgatggaggtgaagcggacagcagctgcactgccctgtagagattcccaggccctgcccacttcaaagcacacaagcccacctcttcctcatcacatttccctttgcaacccagggagg

SEQ ID NO: 106277 - DNA, 1058 bp, Homo sapiens
gagacctactccacagccctcacaccctttttctctcttcctcaagagctctcaagagcaggcaggaaatggagaatctacgagcctgacttgtggcacggatccacatatccaagggtgttttgtattttggactcgcttatctccccgggacaaagtacaaagatgaaagaatctgcaagccttttgttgcccatgtttctccctctgccctgactgccttgccaagataccaaaacacctctccctgtcgggggctgccctccctttctaggaagtggacgtgcttagggcaaagctggtgctgaaccccggcagggtgtattcagaggaggagaaaacctcagcagaagcaccaagtcctggaaatgccagcttcaggcccagctacaagcagcctgctccatagcagcagaataacctcgtgtagcagcagcattcagagaacagcgggtcacatgctgcaggttcaaaccggattccaagcccagcgctgctgcttaccaaccgagatacctcaggcggtcaccttctctgtgcctcactgctctcatctgtaaaatacggaaataatgggaaacttccattctaaaatcagatgaactccagaaaggcatctccccctgcctccctcccgctcagcacatccaccccgcaactggcctgggcaaactttcctcaacccaaagctgttgagagagggactgcctgagtgttgcagagattcggctccccaaggcagactggaaggggcaccccagctagggaaagggaggcttatggagaagccattaagcgtggtggctctaaggttgggctggggattcaaatcctggccctgccatgacctctggcaggcaggtcactgatccttcacagaaaactgtgcctcagttttctttccaatgaaatggggtaacaggacccaccccatagagtgttctgagaactcactgacaaaatatacgtaaagagcatttcaggccaggcatggtggctcactcctgcaatcccagcactttgggaggccaagatgggtggatcacttgaggtcagga

SEQ ID NO: 106278 - DNA, 1048 bp, Homo sapiens
ccagccctcatcggctgcatgtatccttggagatgaggctctgggagcccaaacacaggccgcagagctgtgggaagagccattcttccctcctccacctctccctgcccctggggagctgtggacctcccagaaccaggcctgctggaaggaatgcatccaaaaggaggccaccacccaagttgcctggaagatcaacgatggccacaagtacctaagggaggggaccgtgcccaggaagcagctccagcaggccccatccaggtcagccttggtagcgggcccagtgcctgccaccagctcccgtgatagcaaggaggtacaggttggatggccagagaccaagggggcccagaaccagctgtccaagggagtgggtgtccaggactccccacccaagggagacagagtctggaaggccagaaaagcaactcaggggccagcaggtcagaccaggccggagagtttagaaatgaggcaggtctccccaagaatcctgcagctgctcttcccaggcatctcccacgatggccaaggccacgccctggacctccaggcacggcatcggctgaagcccgaggagaagttccagtacccagtcatgtcatcctaggagtacagctggcacgtgggtaagggccaccaccatcttgccattccaggcctctggcaggcaggcctggcctccctccccagcctcatccttcaccacccctcaccccggctcatggacctggatcaccttcctctgagcacatagaccttggggatgtgcttaggcaccttcacacttccaggccttttcatgctctggtctctccacttgggatgctcctcctgctgccccaccctgatgaaatttcacacatcacctcctctgggaagtcttctgagatgcctccaagcagattagttgagcccaccttcatgcttctgcaggtttttgagtccacagaagcactgggcacacggaatcaccattccttatatatccatctggcctggggagccctttgggttccaagacttcttagttaactttattcat

SEQ ID NO: 106279 - DNA, 1037 bp, Homo sapiens
ggtctctggtggtctgtctcttagcctgaactgtcagagaggagctagaccacttaaaactgcgaatgcaactatcttgtctggttttccctgggcagtcttgggaatgtgagtgagcatcaatgtgggaatggattcccttgagatgcacacagcagccttgcacaacagagctgctggaaaaacacctgccaggttgaatcaaacaccaaatgacccccgggttctctagagttacttgattgaatgcaacaaatattgatccagcagctcctgtgggccgggcctaggctgagctcccggggaatgaggggtcagatcttggagctcacaggacatagtgaaaagggctgtatgggggacagtggacacctttggtgcacagaggagccttcctgagggaggccattgtcatttctgtcattgaaacaatgctcagaaagaccttagcacagtgcctggctctatacatgtgatttatattaataataattatctccatcagcagcaagtcttcaagctccttagaaaaggaatggctgcagcatttctcaactgggattctgtgaataaatgaaaccctacagaaaatgacaccagtgacttttctcagtcctcccaggaatgacaccattctacaggcatgggaaagaagttgattcattacaaacaggggctgtccccgaatgttagggcttaattctttctggaagtcagttaagaaaggctggtggggagtttatttaggtatttaatgaatacctgtttgatatctgcgggcattgttctaagccctacactgtccagttcggtagtcatgatccaaccacatgtccattgagcatttgcaatgagtcttatccaaattgtgatgtactctaagtataaaacacacactgaatttcaaagatttagtataatgaaatgtaaaatttctcattaataatttttatattgaattttatgttgaaatgaccatacttggatagattgggctaaatcagaggttgacaaactttccctctgaaagactggat

SEQ ID NO: 106280 - DNA, 1039 bp, Homo sapiens
cttcttgttctttgccagtacaataaaggaagatcaccatcaccctgtagatttaatttgcatatctcttattataaatgagattgagcatctttttatatgtttaagagtcatttgtatttccctcctggtaaattatctgttcagatcatttgctcatttttctattaggttttgttgttattggtcttgatttgtaggaaccctttatacattaaggaaattactatgttgtctctattatgtatttacaaattttaatcttatttatggtatctctttccatgtggagatttaaaaacttttttatgcaactaatactctttgttatggcctctggatgttagacattacttagaaagccctttcctatggagatacttttaaaatagaattctcatgtttcctcctagaacttagatggttttattttttatatttaattctttgattcatctgaaacaattcaggggtttttctggtttcatttcctttgctcatctcattctcttgctgctgagcagtttgtagcgcctccctgcttctgcccaacccagttttggagcggtgcagcccccctgacagtaccagtgccatcactctggtaacaatattatcctcacttgcccattggttgctgccttgcttccattcctttctgaacacactgtttaggtaagccctaaccccgatggaggagagctttaactatcgttccatgcttgactacttaccagatttcttctttgacctctgtcaattcttcctagtcctggctcattatctgagacgccctgccctttgtgcacgtttgccttattgcctcactgggggaggtgacctgaacaagaggcatagtataaagccacaagctgtttgtactttgcctgtgctgaggaaaagagtgctccaccttcactgaagccagcaatttggccggctgttagcacttcattcatattccctagtatgagttaattctttgtcattttatttcttgtgattccagaatctcattttcagcttctgccagagccag

SEQ ID NO: 106281 - DNA, 1035 bp, Homo sapiens
ggcaggtcctcctaagacttgagggaatagatcccattcagaagttgtgaacatggctcagttaatagatacggcctgtccctcaggaaacacccagaatctgatgctgtggcatgttccacccctgaaatccctttttagccatgaagtagcattcctttctcccagcactgatctcttcccagaatagagtggccaaatgatgttttagaaaactccatgttttgggttgtcagggatatgaaaacaccaagagaaaaataaatggcagctccaaaagtctttccttcctaggagagaaggagcacctgcacactcagcccaccatgtcatattgtgttgtgattgcacgtctgtgtcttccactagggactttgtcttaattggctgttctatccccagactttagcacagtgcttgcatgaagtaggtcctaggtatagattggatggattgatggatgagaggatgcctggataatgcagggatggacaatggatgggtgggtagatgcaggatagatttttgcatgaattgattgatgtgccagtgcacagatgatttaggtctgcaggatggatagatggctgaatggttggatggatggatggatgggaggatatctggttaatgcagagatggaggttggatggattgatgaatacaggatagataggtagacaaatgcatatgtggttcaggatggatggctgcattgagcagaggtggaggatggatggacacaagatgaatagatatgtgggtacaggtggatagctgaacaaagaaaatctctgatgctgagcacaatgttgttattcaacaaattgtcattgtcctcatgtccaggctgaatgagttagagtctagtgatgctccagagggttggtttagtccatagcagccatggctggttcttccccactttcagtcagtgcacaggactcctgagagagtgtaattaaagggttcagacctgtttgcaggtagaggagaggagtagaggagtacagccactaatgtgaaccctgtact

SEQ ID NO: 106282 - DNA, 1049 bp, Homo sapiens
acagagtgcacacgtgggtgtctgaatctttgtgtatcatccagctccctttcttgcccagcaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgagaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctctagccctcagagcgtccggagcagcagggtacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctctt

SEQ ID NO: 106283 - DNA, 2023 bp, Homo sapiens
tctgtttatgtaaaatggtaattgtaaacattgaaaaaataacttagagatcagtgctttagctaggtggcgaaagatgtaataggattctgtttttattgtaagggtgtgtgtgtgtgtgtgtgtgtgtgtgtgtctgtgtgtgtgtgtgtgtgtgtgtgtgtagagacagcgtctcaccatgttgtccaggctggtgtgtgtgtgtgtgtgtgtgtgtgtgtgtgtgtgtgtgtggagacagcgtctcaccatgttgtccaggctggtctggaacgcctgggctcaggccgttctcctgcctcagccccacaaagtgctggtatacagatgtgagccaccacacctggccctgcagatcttttctttaaaaaataaaataatttagggtagaaaatggcagttcttgtagggatgactgaccacaaaagacagtgactcacaggagacccatagaggcagatgtggtagagtaaaaaactgtagcattgtcttgcgtaattttttgactgttctgtgttcttgtcattttagctgtaaagtttgactgagaaatgttgcatcagccctgaagtttattgagaaaatcttacgctgatgcaaactttttggactgttagtgtcttatgagtaagtcttttttaaaacaggaactgttggaaattattttggaaagaagtagttgttaagaggggtatgtagaagagaaaggcactgttttttcttggggagattgaagttggctttccagcttggtagctgaagggagatggtgttccagaagtcagagctctactctcgctttgaaatgctgaatctctaggaagttactccttggctgtagacagaaacatacggagttagagacagacttggggttggaagaggcaagaccttaatacaggtctgagctgatacttgctagtcatgtgatataggctgggcaagtcacttaaacctttttgaagtttagttttgtcatctgtaaatgggagtaataaatgcctgccctgcctgcctcccaaggttgttaggaagatcaaatgaaatcatcttgatgaagtatttgtaaaatgtattccttcctccctccatctcttcactccctgacaacatttgtgcaaagcgttaaacacattagagggcgttattgcaagcaagctcatttctgtccatagttcctttcatttatcaagtttgtttaaccttgggaaacatatatatatatatatatatatatatatatatattttttttttttttttttaataccaatggggttcttgctgtgttgcccaggctggtcttgaactcctgacctcaagtgatcctcccacctcagcctcccaaagtgctgggattataggtgtgaaccactgcacccagctgggaaaccacctataacagaaatgatttaggatttgtgaacttggtagggaaaaattctgtggtttggaaaactgagtcaccagaaggatgaagggaacacaaggtcaccaccagaaaggcatatttggatgagcaactggcagaaaggacatgtgttggtaggtgattctgtgctttgctgatgctgatgcatcatttttatggagcaaaatgaatttagcattaagagctagaccagccctctgctgcaaggaaatgaagcttctataaaatcagaaaggctagtatttagggggaggatgctttcaggttaggtttggaggaagaaggaagattttccagacaaaaggaattctggtgaaaagccacacaggtgagttgtgagaaaatttaggaggaccaagagaggacaagggaaaggtaagttcttggctatataaaagggaaaactttttaaagttagtagactaaaaaaatgcttacatagctgaaatagaaaccagaggaaacaaagttttggaaagcgctgttatcaaatgtgcacatccaatttttgctggtgggtaggctgtgtgtgatagcttttcatctcagttttctcctttttttggggggtgggggacagagtctcgct

SEQ ID NO: 106284 - DNA, 1048 bp, Homo sapiens
tgtgataaaccaactgagttatgagcatactcatgacttccacaactcatcccatgcttcctgtgtgcccatttggaagctcctactctattctaggttaaagggaaaaaatatttatgttattgttttatcgatatttaagttattatttttgaaaagtagaaacagaagccttatagcctttaacgtatatatcctgaaacaccttctggggcacctcgttgttcatcctcttccagactcttagtaacccaccataaggatctcagtttaaaaatctgaagaatgattcttctctgaggtcaaggttgcatttgtagacttcaggagttcattagttcattcagcagatactgctgtgagtatgccctgtgttcctggcatggcctaggcacttggggtacaggtctaagcaagacagacttggttcctgccttctttgttcattcattccaactgggtttattggtgaagattctggggtggggtaaaagatggaaaagaaaggttagagccaattgtggggcctcttggatgccaggctaaggaatctgaacaacagtgagggggggtttgggtggaggtgtggctcataaaagtggcattttaggaagcttaatttgctgtctgtgtgcaaggtgcagtggaaagggtgaaggaaggagagaagagagtcaaggatgctaatggaacagtgaagttagagaggccacagctcaggtctatggcagggagaggggaggaacacaatagaggaaaagtctgccaagtagaggccacaagggaaacagaggcatcaggaaattattagagaagtagtacaaggtagatgaagggtagctggttttcccaggaagatgatgagtctgtttggttttagacaccttgagtaatactgaaaagggagtgttacttgtcataatagatgacattgtttaagctttcactatgtgccaagccaagtgctttatagtaattctataattatttttcttttttcttttctttttttttttgaaacagagtctcactctgtcaccaagctgga

SEQ ID NO: 106285 - DNA, 1068 bp, Homo sapiens
tgtgtgtgtgtgtgtgtgtgtgtgtgtgtgtgtattttttgtagagacagggtttcaccatgttgcccaggctggtcttgaactcctgggctcatgcaatccacctgcctcatcctcccaaagtgctgagattacaggtgtgagccaccgtgcctggccaggatttcttattttaaagtatcatgttttaaattacatgtgtagcaaactgagaaacttttccaaaaattgtttttcctgattgtaaaaataatttatgctcattgaggataacctgaaaaacgtaggaaaaaaaaaatagccaaaagtgggcatagaatctaggacaacagaggctggagtcatggtactccttcttagaaatcagagactgatacaattgtttctcatatttaaagagaatggctgctttttgttttttctgggtgctcttcacagtgctgccaccgtcttctgtgcttgctgattagagtcgtgatatactcacctgcagacactttgtgtttgctattttcttagcagggaagaaaacagttacaaagctggccattgtgctggctgctctaaatatactgtcttctttcatattcaccatgactctgaaggtgtgatttagcaggtgaggaaactgaagcacagagaagttaggctgcaaagctaataagcagtcgttgggcttcgttccagatctctgtgactggaaaatgtgtgccctcccctgctggggacttgtggctgtgctatggaggagggatggcacattgtggctgatcatgacacagtgaccagctcctccttcaggttccagaagggctcccagggggcctgtctttgaggcagtggaaaagggggaaggtagaggagacatggcccaggagggagcgcttcagtctccagcaggtactcaggtcagtgccagtgaagggcgtgagggatgaggagctggccacctcagataccagagcccaaagaaaaagcatcatttccagcggatccgagtttctatgttgttgtctattctagcctactaaacatgtagtgggtagttctctgagatcatgttcactt

SEQ ID NO: 106286 - DNA, 1112 bp, Homo sapiens
gagagagaaagaactcagtctctgttccttagacttgagaaggaacccaggccctgccccttccagtgttgagaccttgagtccgtcatttctttttttttttttttgagacgtagtcgctctgtcgcccaggctggagtgcagtggtgcatctctgctcactgcaagctccacctcccaggttcacgccattctcctgcctcagcctcctgagtagctaagactacaaggcgcccgccaccatgcccggctaattttttgtattttaagtagagatgggatttcactgtgttagccaggatggtgatctcctgacctcgtgatccgcccaccttggcctcccaaagtgctgggattacaggcgtgagccacagcgcctggccgagtccatcatttcttctcttgggtttcactttcgccgctgaaataaaggggttgaactagatgacttctgaggtctcttatagcacaaatgttttgtaattagaattttactgcccattgttgaccttggagagacttactgtactccaggggacagcagggggttgagacaaattgagggtctgttgaaagcttagaactccctaggatactgactggaatatggttgaaggcaatttacagatcatgaagatctgatgttggaagtaaagagcaatgaacagattgaggttgaaagtttttcattcctgtcttagcccagggcctttgtatgttctgtttcctctgcctggaagttgctgtaagcttgtggccagtgccatctcatcccctgacgtggtggctcacgcctgtaatcccagcactttgggaggccgaggtgggtggatcacgaggtcaggagatcgagaccatcctggctaacatggtgaaaccccgtctctactaaaaatacaaaaaattagcagggcgtggtggccggcgcctgtagtcccagctactcgggaggctgaggcaggagaatggcgtgaacccaggaggtggagcttgcagtgagccgagatcgcacactgcactccagccatggcgacagagcgagactccgtctcaaaaaaaaaaaaaaaaagttttccctccagataaaagctagttttctgaaactgtaatat

SEQ ID NO: 106287 - DNA, 1242 bp, Homo sapiens
ccttctaccgatcttatttttcacaattcaggaaaatcaatgtaagttgctaaagtaatgaaatagcaggttcatttttaggtgtcagttatccccatgatctgcccatgtaggaaatatgcaccaagtagtgaaaggtatagttgggacaggccttgcccgtcagcccttgcagcgttgctgtatctctgggaggctgagttgaaatggcgggtggggtaaggagggaggtggactcactgattggaaaactgtggagggtcggaccaagacctttgggatacctcatgaggttttacagaaggctttggagttgcatttacgttaccaattaggaacggggctatccctgggctttgtttctcagagaagccttggggcaggagcgcgagggtccacaaagccaaagtgaagggtgaacacgctgctactctttcttccacagacattggaaagtgtggatgtccactgctttggccacttactgtatgaaatgacttatggacgaccgccagactcggtgcctgtggactccttccctcctgccccgtccatggctgtgggtcagtatggggttgggaagggtcttctgggccctagtagtgtgcagagccactcatcccctttccagagtccaggaaagacccagaggaagttgctgtcctccacagccagaaattcttacaaaatttaaaagtagaccaaatttgagtagtttacttaaatacacttctgtgaaaattcaggtggcttgtccatttgccaggctatctgaaatttctgggaactttttgcaaaatgctttagagctttggaagcaggaggatgtaaagagaagtatggcctgcatgagtgtgatgcagaagctagagccaggcaacttgaagccagtcttgaggacccaggcaggtgtcagacgtcagatcaagactgaagtgagacttgtaagaaacaagagaggccaggcatggtggctcacacctgtaatcccagcactttggaaggccgaggtgggtggatcacatgaggtcaggagtttgagaccagcctggccaacataatgaaaccccatctgtactaaaattacaaaaattagctgggcgtggaggtgcatgcctgtaatcccagctttttgggaggctgaggcacgagaattgcttgaacccgcctcttgggaggtggaggttgcagtgagccgagattgcgccactgcactccagcctgggcgacacagtaagactc

SEQ ID NO: 106288 - DNA, 1221 bp, Homo sapiens
ctcctcactcagcgttagcattgtgtgtacgtacattagcattgggtgtgcgtatgtgtcgcagcccccagcttaggaaatactgaaggagggccctctcaagtggctcctttctgaccctgcatcagcaaaccagttggcccccagctgtgcatagttcacaagtcacagggccttgaagggtctgccctccaggaagagggcaacgtgtttctgagcacccatgcttctgcttgtgaatttactcactgggtactatttattaaactctagcatgtaccaggcactgttctagggtcttggagctcagaagacattttctctgaaactggattatgagtagataaccagggcagctgaaatagtgctgtggggccttcccttcaggtgcattttctgttctttcatggaaaggcagcagagtggttaagaagggtgtgcctggggtgggacagacctggaggtggattccagcttcaccacttctacctgggtgaccttagacaaatttcctaacctctggaagtagagttttgtgaactgtgaaatgggaatgataataagttcccacctcagaaggtagttgggaggatttaatgaggtgattcctagtagggacccggcacttaatatgtgctcattaagtgttagttatgcttactactgaatcagctgatcttttttgaatatcacacaccatgcagtgtatctggtgctttgtctgcaccagcgtattatataacagatatactctgaaaacaataatatggggaaacgaggcaggggacagcttgaagggcatgtagccagagttcagagaaggtagagataacttccggttcctggttctttctttccacaagtgtttagagagggccttctggaggccagctgctgtcctaggcactgtaatgaaaagaggaaaccaagcccctgccccgtggatgtgacattctactgttccacagacactgaagcgtctgtcgccaaaccagcaaccattaataataatgtaataatgtgggccgggcagtggctcatgcctataatcccagcactttgggaggctgaggcgggtggatcacttgaggtcaggagttcaagaccatcctggccaacgtgtggtgaaaccctgtctctactaagaaaatataaaaaattagctgggcatggtggcacactcctgtaatcccagctactcaggaggctgaggcagaagaa

SEQ ID NO: 106289 - DNA, 1038 bp, Homo sapiens
ctccttgaaagctaagactatttccagatgactggggtgcagtttttttggggaaaaaaaaagagtcatatgataatcagccgagaaatagcccatgtagtttcctagcttgctgggcagattatggcgtaatgtaattggaggaaacgattggcctgagatagtaaagtcagcattttttgttttatttctgcctttagttttggctgtgacttcttcactgtgttaagttatggggctgaatattaccttgtctgcagctagtttaatggtatgcctggaaaatatttttattctaactcccagcttcactgtgtttattctttgctttcctctccctccctcccccttttcttttattcttaaagaagtcaaaacgatctgctcttgaaaatagtgaagagcattcagcgaagtacagcaactccaataattcaggtaactggttatagatggtagtggggcccaggacacagagatcaggatcaggagtctctagttggtcaagaggtcttgagttctgctggccagaaactgggcaatgtagtaatgactacagagaacaaaataactccgtctctaatgaaagattgcaacagtattcgtaggcttacagcactcaaatgctagaagggacttctgaggtaattgggtagctcaccttcttcactgatggcagcacttgatcatctaaagacacaggagcattagtcatggaaggaaaacagacctgacttaaaatgtaaggcctcctgttttttagtagagcctgcatgaacagaaatgaccttaaatcctgcccactgctctggaccccatgtgatgggaggatgtgctctcctgtgtgaattaaggaaaggactcgatggtgtgtggggatggcaagaaaccgagatggtacaaagagcactgtcctgagttggcagtccttgctgccactcccagctgcccttcacccagctctgctggctttgggccataatgtcccatctttggaaatcagagccagattgaatgatccctgggggccttccagtt

SEQ ID NO: 106290 - DNA, 1015 bp, Homo sapiens
taattctaatagcattctctttaaaattatggcaaagtttatatcagttgtttttcccatttccaaagatcagatattctgtcaaatactgccctccagaagctgagatggaaaagatgggtttaaattagttagagaagcatataggtggtacctaatttaagtagcaaggcaggatttttagttcttagaggaaaagtgagacacaaaagaataagagacaggataggtaggaaggaaaccttagactgtgtgaatctattctttgctaacaacagacgctacaaaaagttctcatttgaaatatcttgtcaagctacagacaacacgttttcttgacatgattttaataaaaaatacagctgacataacagattacatgaaactatacacaatgacattctctgcatagtaaccaacactgatgtgtgtacttgaatttttaaatggattatttataatcctttaaagtgcaatttattgaaaggtttaagcaaatcaggataaaggatctttctaataaatgactaacattaaagagatgctatattgatatatttagataaatctttcaaaaatcataattgatttctatagatgccaaatttacttctgttgtaacaatgacctgcccccctcaaaccccaaacttaattgctgaggattaagaagatcctctaattggcaagagctttttctgatgttaatatttttgtctgtttcaatacatctaactaaaaagaactatgggtctagagtagttgctttagcagccctgagttctataaccacaatggtattcctgttagaacttaagagaatgttgtgaacgttccccattctatttgaggagaaaacaaagaactcagttgctttctgatttagcaaagtaactatgctttgggctatagtgttaatgtctaagataaaggtagcaaaaattggagttatctaagaatcagaaaatgctttagagaaatgaactgtaagaggaatgtttctaggagctgtctga

SEQ ID NO: 106291 - DNA, 2437 bp, Homo sapiens
ctgtgggccactgcttagaagctgcagcagtgctatctaaagaaggagttgaatgtgaggtgagtggacatttacttgttcttaaagaattagaagggctccttttagatttaagacccagaagagttctgtaacaggttaattagatgtaaaaccttgctttgtcactcatttctgtctctgcttaaagctgggaacctgcctgcagttcacatacttagctttttaccactcaggtcacttaggttctggatctttttttttgagagacagtgggagctctctgaacctcttctggttctcagtgataccccccgagagagaaaaaaacaggcttttgttctgttgcccaggctgaagtgcagtggctggatcatggctcactgtaaccgtgaactcctgggcccaagtgatgctcccacctcacccttctgaggttctggatcttttagaaactcaccatgtgctagttatacttgggcaagttatatactctaaatctgtttcatcagctataaaacagggataatataaatactgtcccgtcatagggctgttgtgagaattacacttagtgtagtgcttggtacatgatgggcactcagctgttaactgttaactcattttgatgagggaatttaaagtgaaggaggattggctgggcgtggtggatcacctgaggtcaggagttcaagaccagtctggccaacatgttgaaaccccatctctactaaaaatacaaaaattagctaggcgtggtggtctatgcctgtaatcccagctactccagaggctgaggcaggaaaatggcttgaactgggaaggcgggggtggcagtgagccgagatcacgccactgcactccagcctggacaacaagagcaaaactccatcccaaaagaaataaaaaagtgaaggaagataaatgaatcctataactgcacagagctgcttgtggtagacatacagatctttgttttaattaaaatttttccttttacagtttgtacattcatgaataggtattcataggcagattagattttcctagatacaaagattaacaggaaacaaaaaaggaaatggtattatggggataaggctctatttgtgctgcaatagctctgtaaacttgattatattacctgtttaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtatttcaaagaaactggttctagaatacagtcaagctatagtaaacatcatgtacctgaatacgtacaggataaagagattgaaagctaggagtggccaaacgacttcaactttaaacttgtaagtttggcatttctcttcaggcagatatttttaaaagcaaatccagaaagcggttccccataattagcattccttacattttctcttcctggtcagccacacctctgtgccaaggtggtagtgcccagctggcatttgcactctctcagttgagccttccttctcctaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctcatgaaagatgtatccaaacaagataacttatatgtataaaattaaagcatataatatacatttactgttagtttgttttgataaggaataaaggaatttctaacatgactaatttttttttttttgagacaatgtttggctctgttccccaagctggagtgtgatggcacaatcttggctcactgcagcctccacctcccaggttcaagtgattctcctgcctcagcctcagtaggaaattagccaccacatccggctaattttggtgtttttagtagaggtggggtttcaccatgttggccaggctggtcttgaacacctgacctcaggtgatccacctgccttggccctcccaaactgctgggattacaggcatgagccaccacacctggccatgactattgtatt

SEQ ID NO: 106292 - DNA, 1207 bp, Homo sapiens
cagagtgctggaattacaggtgtgagccaccgtgcctggccttgttttgtctattgtgagtaatgctgctgtgaacattgatgtgcaagtatatgcttgaatccctgctttcaattatttggggcatatacatagaagtggaattgatggattgtatgttaattctcctctccttcctttttttaactagattttaccattcattatattaaaagagcaactcctacattctggatgcaaagtatttggcagtacttggcacctagtgagcactcagtacattaacacatgcaaagaccaactatgtgtaatagaaatgttacttttagaattctttgagtttttagagagaagcttgttctagtgtttttatattgtatgctgtgggcagcctaggtaaatataaaggaagaaaatcttagttgaatcccaaacaattctgtattgactgtttttgcatacctgtgacaggtgacagttcgtgatgctataaatcagggtatggatgaggagctggaaagagatgagaaggtatttctgcttggagaagaagttgcccagtatgatggggcatacaaggtaactaaaatatatgaaagttatacaaaattgaggtcactgttacccccagatacacttaagggatcaactcttaattgtaggttagtcgagggctgtggaagaaatatggagacaagaggattattgacactcccatatcagaggtaagccttccagtgggaagcagaccctggagggcatgtctgttagtgtccattatcctcatttttatggattttcacttatgtttatattttactttatagatgggctttgctggaattgctgtaggtgcagctatggtatgtaatactctttatgaaacttatccaaagacatttcttgttttctttttttttcttttgagacagagtctcactctgttgtccagcctggagtgcactggcaccatctcagcttccaggttcaagcaattctcctgcctcagcctccatagtggctggggttacaggtcgcgccactgtgcctagccaatttttgtgtttttagtagagatggggttttaccatgttggccaggctggtcttgaactcctggcctcaagtgatccgaccgccttggcctcccaaagtgctgggattacaggcgtgagccactgtgcccatccccaaagagatttaacatc

SEQ ID NO: 106293 - DNA, 1678 bp, Homo sapiens
ggctcacagtaggtgcttaatgcaatcaatgaaagctatgatgtgcattataaggaatcaacagacagcactgtccagggaagactagactcactcatgaagtgttaagttccccatcagtagagcgtgtgcaagcacttcttggtgcccaaaggattccagcacccacaacaggttggcctaactcttaaggtctctccagcttccagagatcatgctcctcagggtctgacttctagtccccacgcttcaagtaacaccgaccaggcacgtgtgcccagcgtgcaccccgcctgtcggtcaccgcctactgtcaataaagttgatttgaggcggctccaggcagaggggcacggccacccacacgccacctcagcccggccccgcggcccctcacccggtgggcgggtgggcgggtcacgcagccggcgcgccttgccattggcccgcgccggtggaggcggggcctgctcacgtctgccggcccctctgttgtcgtttggcagcggatagaggacacgaccaagatggcggcggtgtctggcttggtgcggagaccccttcgggaggtaggcagcagcgcgcggcctgtattcccacgcgacccctgcccaccctgcgtcccgccgtcatcttcctctctccctgccaggtctccgggctgctgaagaggcgctttcactggaccgcgccggctgcgctgcaggtaacaggcgcgggtgctcgtcggacgagggcggggagggtccccccttctctcgggaaggaggccggagtcgcgcctgcgctgtggccttccggcgccgtgggccttgggtttgcggagccagcatcctccgtggagctcctgctgcctctgtcgccgcctggcaattagcacaccggcgagtcaccacctcacagctggctgggcaatgggggaaaactaagactaggcgtttcctccctcactccatgtttttttctttaaattgcagcaaaatagacctaacttaaaatgtactttttagaagtgtataattcagtggcattaagtacattcaccatgttgtacaaccattaaccaccatccatttccagaactttttaatcatcccaagcagaaactgtccattactcggtaactcctcatttcccttccccaaacccctggtaacccctgttgtacttttctgtctttatgaggttgcctattctagaacttcttataagtggcatcatttgtccttttgtgtctggcttatctcagcgtaatgtcctcaaggttcatccatgttgtagcatgcgtcagagtttgattctttcctaaggctgaataatatatatatgtatatttttttgagatagtctccctctgtcacccaggttggagtgcagtggcgcgatctcagctcactgcaacctccacctcctgggctcaagggattctcgcgcctcacactcctgagtagctgtgattagatgccggtgccaccacaccgggctaatttttgtatttttagtacagacagggtctcaccatattgcccaggctggtcttgaactcctggcctcaagtgatctgcctgccttggcctcccaaagtgctaggattacaggcatgagccacctcgctcagcccgacattttcttttttttttttgagacggagttttgctcttgctgcccaggctagagt

SEQ ID NO: 106294 - DNA, 1021 bp, Homo sapiens
tagcatgtggaggcctgtctatatccaactgctgagtgtaaagaataaaaactgactgccccatagtctggtccacattttagttgtgtgctttgaaggatttgcaaggtagagaaatagatgcttcaggctctgatttcagcccatgctgtgctatgcaaatgttctctacatgcctgagtgaccttttgagaaagagcctttgtgatcttctgtagctagggcttgttctgggaattctgtgccagattcctctaaaagtgggaaaagtgaatctgttaaaggaccacgtaaaaaagccagtgcttttcctggatgaataccaataagtccatgtttcttaccatgtcttgccagagctttagaaatttgctctgcagtttgctttacaggttgatttgggattgaagtgtgtgagagggaactgactaaggcagttcagtagctgggaaactgtttgtttaaatgcttttgaattgtagataaaaataaattcacattggcatcattagtatctgagcatttctcagtgtcttaaggctggctctccatgagtgctggctgattgactctcatctatatcggtaaggttctttttgccccaaattgtgctctttaacacttcggcatttaaatcactttctatttgttttaattgtacaaagagaaatacatcattatttaaaagcatcatcttttttttttatattgtaagataaataccattctgatgtatttctcttggaaagggatgctggtatcctgggaggtttatgatttttgatgtttttactcaggtgattggcttgtatagctgaaatgctgatgaaaaggagttttcccttctccctttttcttttcttttctttttttttttttttttgagatggagtctcgcactgttgcaggggctggtgtgcagtggcacagtctcggctcactgcaacctccgcctctcgggttcaagtgatgctcctgcctcagcctcctgaatagctaggattacaggtgcccaccacca

SEQ ID NO: 106295 - DNA, 1327 bp, Homo sapiens
tgtcatcataacgcaactaaccatcaccactaaggtccattccttactagaaggcatctcaaattattttaccaagtggaataagcacatgatggacaccagagactgccaggtttcctttacttttggaccctgtgattatcaccaggaagtttctcttagggtccacctgatggaatacattacaaaacaaggtttcacgatccgcaacacccgggtgcatcacatgagtgagcgggccaatgaaaacacagtggagcacaactggactttctgtaggctagcccggaagacagacgactgatctccgaccctgccacaggttcctggaaagactctccaggaaatggaagatactgatttttttttttaaatcacagtgtgagatattttttttcttttaaatagttgtatttatttgaaggcagtgaggaccagaaggaagttttgtgctttggcagactcctccatgttttgttcccttccccctgagtatgcatgtgcctgttcagagtctccagataccttttttataaaaagaagtctgaaaatcattatggtatataatctacccttaacagagcttttcttattacagtgctaaaatgatttctgataaaatggtccctaactcaactagaaggctaaaaatacaagaatgaaagaataagcagagtactcatgatgcctttgagaaaaatcaaaacatcatgtagggtgacctagtttccaaaccaataaataagtagtattgtaatattaaaggaaaactgttccaatcatttaaaagtacttattaagtactgctttttacagttatgacaactgtttctttctatgcatataaatcaaggaaccaaatatctgtagccatggaaatgtctgactagaaatatttatattgaattctgaatacaaaatgtccctgtggtagaaaacttactctttatgcctggtgcagtataattcccaagtgtactgtctaccagaaaaaaaaaacaaaactaataaaaaatgaaatatgaaaattaagtttgtatttattgattattattacttaaggggagaaaatcatatttcttgtctaaaatatgcattgtttatgtcccagtgtttactgcccatagcacatttgtatttgatttgagaggacacagtgggatcttaggttgcagtttataagaactgttgcgtcactgaaacaaggatggatggaattattaattttgactaaaagggtgcatatttgaacagtgaacatacagtttttcatattttttcaaaagaatttatgttgaaggttacagattttactttaattgcccac

SEQ ID NO: 106296 - DNA, 1767 bp, Homo sapiens
ttctcagaagtttacaatctaggaattgaaatatatatggttcacttaatcatattcccttgcgtgtctagatttgcaacaaagccatttccccttacgctgttaggcatggggtggtattttccattattttttcctaacacactaactgatatttaaacagcatcacagatgctggggcccttgcctccagcgtccaccaaacattgcctcttagggcactgacagcctctatgacaaggtgcagaaatggctaacataatctcacataatgtagagaagtgtggggtaggaggaaacaatttcacagttcattcatgttgagaaacgtttcctaacatgtacacttgcatgctgccaagcagagcaaaatggatgccatttgcagcttcaagtcatttattttaaaatgccatctattggtttgtggggtttagagctgtcccttaggcacatttatttagatgcttgtgtagattcttcagaaaaacgtaagatattcctgctcaggaatgagttttatgaaataagctgtgattaccttctggttgtctgttcatagggatggagtcaataaccagtctttcgtttcaaatgatgattatacttgctatttttacaactcattggaaaattagggggagggaggaaggaatgtagtcaaaggctttgcaaggttctaaatgttcatggaaatatataatatacaaaataattcagaatacccaaacagcaagaatggcatgattttctaaagtgtttgctcaatgatttgtcacttatctgtagtttttaaaaatgtcattgcagattgtgttagggcctgaatcctttgcagccttgccacatgtttgtgtgataaacacacttataaccataattatctgataaagccctgcagtctttgacaaatgattaataaccactgacctcagttcccgctggctcagctggcctggcaaggcaatctggcctgtcgttgtaacccgtgtggctcctccagactgaccacggtggtatcgttttgtttttttttttcctctccagttgtcacgatgcaacctgatgggcatctcttctattgattaagctttttagtttcccatcacaaaagagagaaaatgtataaattaataaaattaagtacagaactttaatgttcctcttcaaatgattaagtttcgctcattttaaaacaagtaagttgaatttttaacaaatagtcctccttcaaaccaagacatgacagaggatttccttattaactaagcaaacattttgtttctcaaaacatagtgttattactgtttcctgttatccagatttttgcactaaatcgtaatgatttgattatgaaaccaaaggcatcagttgttgtttttatcatttctcttgttggcttcaactaggaaaagattcattacctcttctttcataatctcattcccacagatttcacacctgctcttttgagggccctgatgctccacatttagaacccacgggtctggctgaaagctcatttactgatgacctgtctggctgttcaccaagttcctctaaggcaggaacttactctctctcactttctctctctctctctctctctctcacttactccccacccccaccccaccccaccccagtgttattcaacacacgcctgtcaagggcaggagttttttcagtatttgagttgagggagggcatgagcaagtgagtaggtatacacctggacaccatggaaaatgaaaatcttcatcctaa

SEQ ID NO: 106297 - DNA, 1957 bp, Homo sapiens
tgcttcggctcgcacacggtgcgctgcacccactgtcctgcacccactatctggcactccctagtgagatgaacccggtacctcaggtggaaatgcagaaatcacccgtcttctgcatcgctcacgctgggagctgtacactggagctgttcctattcggccgtcttggctgccctcccacccatacccttcttgtgggttgtgtctgaggaaacagttacagtaatgagagtgcatgtgaatgtctatgtaaacagctttgtgctgattaaacattcacaaatgttttgtcttttccagcctgtcaaccagggtcgccactatcagaaagaaatgaacccaccttctccttctaatccccggtaagaatcattaataatctacatttaagaaaaaaaaaaacttagttggaagattgtacatttttcttggttttctgaaattgttttccaaaacttctagcttccaaacttatgttctttcaaagtcctagttcatctacttgtcttctttggactttagaatagtggtaacagtctacctaggtttaaatatctaccttttactagctgtggaattttgggtaagtcatttgactccatgtaattcaggcataagaattacttcatagtattttggaaagattcaaatgaaaaattcttagaacagttcttggcacatggcaagttctcactaagtgttaatttattcattactttatttgcataactattttattttaataggtgtctgatgtttggtaaattttaggcataaatcttttttatatcatctggtgcccttaaatttatcaagatagcttataaaagttcaaatgaccagtctcttttttcataactttaaaagtttataatctcaaaattattttatttcaaaaatgtcattggtgtatgagtcatttgtcactaaggaaaaacctcattatttttggttcattaggaacaagtggatctgaatttgagttttgaaatacatgctgtattattctacaactttctgataaataagtatataagctagtttatccatataaattagtattaccttatcagtatttatcatatattaggaaattattgaaaagtccatatatcgtgagcctacctacaaagtcttagttactgtgatgcacctcattatccaaacgcatctgacctgtactgtgggctgtcctatggagggtgtgttaactattgcatggtgtctgaattaagactctttggttacacactacaaaacagcttagctagtattaaaagacagaaagagatagggagaaagagtaagaaaggcggtttggcaggtggttgttaagtaagatacggggctgtattctagaacccaaaggccgccaggcctcaggaggggcctgaaactaggaactagaaaggcaagaggcagccaggcagtctcttcactccatctctgcttgcttcctcccatctgctccattcttctctctaaggaccagctttctctgctccatagtccacatatggccatttgacagctcttgagtttacatatcacagttcaatatacatgtagaggctaacagactacgtctgaacttcctttttcaagaaagagaatgtgattagtgtagcttgagccaagtgcccattctggtccagtcagcaataaacaatgaaccaagccatgaaaaatgaacatggcttccaggaaaccacgtaagtggtttacaggacttttattgggacccagaatattcatgacacagatgagtaaatgttctttactagtaatctcttctaaatgtttctattctgtacacctgctctggttatttgttcatgttacctagtagggtgaattgtcactatcacaaatagatacactaaagagtttaaaactgaggttagaatttcaatatatataagaaggtattttaacattcttagaattagctatctct

SEQ ID NO: 106298 - DNA, 1043 bp, Homo sapiens
ctcaaatgtgccatttgcagctgtttttccaacaataccccattgtttgaagaatccataaatgtctttctgacccttctctcccttcagctacaacaacattgcattatttcaaaacacctgtttgagagtcaggtcaccctgtgtgttagacatatgttcattgccctggctaactgtgcaggttcacttaggggtggttctccctcctttggcagtttctaccacatgtgcccactggcctcatgctgctctaggtcatttgataaatagccttccccaaacagaaccctctgtcaaagctatctgcattttcattctccatgactgaaaagtcaaaagcagtggaaaccatggctcagagcaccagctggaatcagacaggcctggtgttgagtcctggctttgttctttcttatctatgcaaccttggacacatttcttaatgtcttggagcctcagttacctcatctataaaatggagaaaataatacctatcccacaaggttgttttgagtgtaaaattagatagcgcatgtagaacacctagcccctaatctgaagtatactttcttctaccttttgctgagtggttaggcagaaatataaaccagtatggctggcattctaaagcaaatgaaaccttctcaaattcataaagttccataaattaattacaggtactgttctacaggggtggtggctctgtggttgtgtgcttcctgctctttatttatagttgaatcaagtgctaacacagtgaatttctgtgtgctttctgccaggtaacatattggcatgttctcagggataacctaaagagagaaaaatatttatttataagcaggaagcagtgtctatctgataatttcccggagaccaccctctgtgtgtctaccttgttcacacagctaaattgcagatgtgtagcttcctgcttgaggtcttgaattgaatttgggcataactagtagcagttcataaaccataatgctaaccatagtgagaatgtttcctttactaagtgggacactcctaccaat

SEQ ID NO: 106299 - DNA, 1062 bp, Homo sapiens
cagggttctcgaggcccaacaactggtccttcagagttaactcagttaacattagagagcctgctggggaaggctgcaaagcggacaagtaaggaatatctaaggagcgcctacacagaagcaggagcaacagaaagccaggattcctcgatggagcaaatagatagaaataactttgaaatgagtttgttgcctacaacatgcctttctccaactggaagaaggtgtgggtcctgtcagaaaactccagagcccgtaatcaaagcgaaggatctatcagcccagcaagtgccagcttcactaaacaaaacctccctgaaagaaatctcaggggaaaggctgagctcgatccccgaagcatctgtaagtggttcccgtgtggtttacagatgccggcaatacatcctgctgtgttccgttctgttccacccatgtttttagcagtatctctttttcatcatttgggtgatgagtgttgtattttctttcctgttctgatgtgttttagtttggtaatagcagctgttaaagagtctactgcacatcccaaggataatagaatacctcatgtttttaatgagaaagataattatgtaattttcatcataacagttattttattttctagttacttcccataatttgtagttatcactgcctgcaaattataaatgatgatcttatttttgagccaaaagcttgccagtaaaattgacagattttcaataacaatctacattaggagccataaaaacaccattattctattcactttctacagcagttccccaaataataaatgatatgagtgaaggttaacattaaaacagtgtcatcgaataaatccctcggctagtttggtggctgtattcgtgtccatcagattgattttttccttcctgtattagtacttttcttccttcaattcccctataagctgcacttagaaactagagaacaaatgaggctatgcataacaaatgacatgtacattccattttttaaaacatttaagattttctctatgtttcatgtcctaaatattctgtgggtgttgcattg

SEQ ID NO: 106300 - DNA, 1105 bp, Homo sapiens
tttttgggaggccgaggcgggcagatcatgaagtcaggagttcaagaccagcctgaccaacatggtgaaaccccatctctactaaaaatacaaaaattagccgggcatgatggcgtgcacctgtaatcccacctactcaggaggctcaggcaggagaatcacttgaaggttgggaggcggaggttgcagtgagccgagatcgcgtgactgcactgcagcctaggcggcagagtgagactgtctcaaaaactaaaactaaaaataaataaataaaaataacacttttatggattactgctctaatttttgtcatcttttccaactgtcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagaggtacactgcttgataagtgaagtagtcttgaagcacagttgtttccttagctccaataagcactaaaacaagttgaaatgaaagagggaaaatcaactgctatttataaaaatgcaacagattgccatgtcagtccacagttgcatcaggttgttatggtaactttaaactgtctttttttttttttaattaacagtcagccaatttcacttttacttatagaaaccagttttgggtttctttctgttttttcattttaatctttgaatcacaggatgagaaacgatatgcagtttagtgctatgatagcaagaccagtaaaacactgagaatatactgttctagatctctggagaaattgtgttgcagttgctaagcattctaaattgatggttttctggcttccttactcccctgccatcttttcaccttagacctatt

SEQ ID NO: 106301 - DNA, 2019 bp, Homo sapiens
atggtctcgatctcctgacctcatgatccacccgcctcggcctcccaaagtgctgggattacaggcgtgagccaccgcgcccggccctttctttttttttttaaagaaaaactttgtggtggtggttctcaaatgatggtgagtataaaaattacttggggggacttattaaaagtactgtgatactgccgagatcctaattctatacgtcttgtatgtatctctgatgttgggccctagtatctgtgtttttaatacatgctgaggggggaggggggatttggatcctatggcacctggactggatttttagaaagattgcagtgtgatgtttgtcattacacccattaatggactattattaccttcctttaacaaaacagatcagttcattaacagaggaacaagtattacacggaacagtaaaaatcaagatgtttgtcatatcgcatttggatccaaagttcttgggccacctccactctctggcagaaggaataacatgaagatatccagcgaggtaggagcaaggtttggagagcttatctaagcacaagtgacctggtaagggaagagtgtcttccccttgtagagggagggagggagggaaagacagacagacagacagacagacagacactacatgccaaaagcagaaggcttgaataaatttggaacagaaattctggattttaaaagacttcaaaagtgtttcctttttgtcatatcaacataattaacattttcgagtattcttttcattaaatatgttcacaaaatttaaaggcaaatataagtgagcacattttgctgtctctttcagaggagttggatcataaccagacaccttaggatgaacagattctcaaatgttaggttttttatttttaatttcctccgaatttctgacatacgcgtgatttttaattcggcttctacctactgaagatggagtgtagcaaataagcacattttaatttatgtgtctaggagacttgcatgtcttctattttatctcgttatttttctccttccatttctaatttcctataataatttcctttttcttcacatcttaacctcatttcctctagtttttttctcactcttcattggtccaaatattatgttttctatatagcttctacagaaaacaaatgtagttgctatattttaaaatgtacagattaattcctttacagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatggtaagaaataatcatgcataaagattgatagctagtgaaaatagtgagaaatgttcttgttaagataaatcagcagttatattcaagtctagatcttaagtctagagaattgtcatttaataatgaaaagggtggttgattttgaaatatatttgaaattcttatattagcttctgaaatctatcattctgttttctccattatttcaaattgctataataccctgtgttttattttatggcaactgatgtagaaataaaatagcattccattatcactgtattttggaaatgccatgtgcattttaagtgttcttagcttaatattatcttttaattaatctcttccatttgtaaggtactctttcttttctctcactgatccaacaacaaaaataaaataaaccctgtaagtgaaaaaggatttttgttccattttacagatagagatttaaagtcaagcaaagaggtaaagtgatttgcagtttgtaacctttagaaataatttagaccagaacccaagacttagaattccctgtcactttttctacccttactgatctgactttactgagagttgaaaagggaggacatttaagttcattttatattatttacaaattaatgatcactgtcacagaaaatttccctcgtg

SEQ ID NO: 106302 - DNA, 1034 bp, Homo sapiens
cagtagtaactgtattgggtagataccacatgtctgccttccttcccagactgaaaggactctcttatttatgtctgtacccctggagccaagcccagagtctaacacatgataggtacttagtatgtgtggggaagaatgggtcactggaattgctgactgatgaaccagctgaatggttgagattggggcatgataagaagtcttttaggactaggaaccacgtttatacaacaataataatgctaatattataataaggttaataattatgattggatatctagaaaccccaacacttccatcccctataacctgcatttcaccaagccacagtgttccactctgtggcgtatctactggatttgtcccttacactctacttcctacataagcttcctagccagccctcctcacttcgtgtttagatgactgacagggaccaaactagtctttctgtgccttggtgctctccattctgcctcattcccccgcccaaccccatctcccacctcaaaatattcctgcatcatggttagtccgaacttctcaacactctgcttttgcacattcttttgtaaagaaccgcagtgatgctttaccctctccagatgctctgaaacctggcctcactgggccatcttacattacttcattccgctccagtgttcaccattctgccagtcaagccaatcacactattacttgactctcagtttacctgctgcctttgctgacaccaggctcctctctccacaaagaccagagcgttgccacagcctgcaaatgtaattttactgttgagacatctacatagaaaatactcttcatgtatttaataaataatgtatttcggtctcttttactttttctactgtggaagcaacctaaggttcacctccatattaaaatcagcattcctagatatataagatttgtctttaaaaaaaagaaaaaaaatatatatatatatatttatatatacaggaccttatgtaaaccttgcttctaaacaaataatggaagagcccaat

SEQ ID NO: 106303 - DNA, 1067 bp, Homo sapiens
tggtccattctgtaggctgttctgtacatgtcttcagaagtcccagtggaatggagcccctgtgacttgtagtgctgtcactgatagtacattcttatattgccttttcctcctttgttgtcctattctccctgctccctcactcctgcttcatgagattacctctgaaatagactacttgcaccgtattttaaattctacttttggagatgtgcttcctaaagacgctgcacaacacagccaagtatatgagatatctctaaggattgcattggccaaaaaactcacaagaattggagaccttactcagtattgaattttataaatattctcaaggatataagtcatgaagtacacatgaagcagaaggagatccagtcctttctaaatgcacatggcccagatttaatgggtaagttctccgagcaatacctgagggagagctaccagcccaaagagagcttattttggctacttcatatatttgtagcttatgtggcatttttcggggagcgatgcccccataagcccatggattccaggtttgttgactacaagcagtcctagacgtatcaggtatatcctgcaaaaggctttccattaataacttttcccctaataccactggtgcatttgccagggaagttcgctcatgtttacagggagttttggctggtcttatatcttttttttctggaatgccctttagtaaagtaaagtaaatggttgcaggcctgctgctctctttccttcccagaggaagcatgcaaccttttaaaaacactgagccaggtaactactaaccttggagttgtcagatagacttgtaaataatttaccattattgctcttgcctcatcattttaggctttagtaggtctcctggctctgctacgtactatctatgagaccttgaacaagttgcttaatgtctctgagcctctcactacattggtaaaatgtaaatattcattcctatttcaaagagttgttgggaggaataaatgagataacacaggtaaaatggtatgcaggttctggcacatggtagggatttagatgttgct

SEQ ID NO: 106304 - DNA, 1053 bp, Homo sapiens
atccataataaccaaaaccatcattaagccctgcaagaagacatttcttggtgtttttcttcaggtcctctacaaatgatcatcctctgactccagggacctatagattttattatatggccttccagcttttatattatagcattgagctgtcatctgtagcatctattagaatgctattgacaaaatgtccactcatattgaactaagtactcaataaaccactataagtaaattgttgtgttctaaccttgaaggatagtctattgattcccctcatgggtatgagcctagcagaacgcccctatctgcagttcctttgtgctacctataatatgttgtgtaatgtcttttttgagatcccagattataaaggaactttttttatattctttattaaaaccaaatattgttttcgcatatttattttatttcaaataaatagttaaccactaatcattgcttttttcttatgctctaaaactctgccattttaaaattgcatacagaattaaagtaatccacacctataataagaaagtttggagtcattttccaaaggtaattgtttttagcaggattttttgggagtacctctagagcttaattgtgtgtgtgtgtgtgtgtgtgtgtgtgtatgtgtgcgtgtgtatgatattacagtcctttttcccacaagtggaatcataccattcacactttttggcatttggtttggtagtgacagtggggctttctctgttacctgccttgagacgatttccatactactaaatctgtctcactctttttaatagcgctatatataccattgcatggctagaacataacctatttatctagatccttatggtggacctccaagttttccctctgttttgctattagtgttaccatgaatatccatgtgtgtatctttgtgtacctgtgaaatgtcctctatttaaatatgtgtgagattttcgtgtaaaaatgaaaaagagaatgtatatattgcctaaggaataaaaatcttctgcaattatagtgatacattctggagagcataggtga

SEQ ID NO: 106305 - DNA, 1023 bp, Homo sapiens
caaacttcagtgacacgcaactcacccatgtaacaaactttcacatgtacccccaaaacaaaaagaaaaatcctcccttccacccctctagatctgttccctgccattctctcacttgctctgtgtcctgggaggtagcccgctcctgtcctcctacgtcataccatatgaatcacccagactcccttgacctcaggcttttgatttcctcaagcctcccagccagtgagaagtaccagcaagagatcagaagacaggatgagagagaagccagggtattccttccctctttttttgctttggacttcctactgatgaccctttctataaggatccaattgctctgactctagttccttcccttgcccctttatacctaggaatggtaaaggctgcccattgtttctattttgggggtgcctaaccatccctttgtttcctcaaccttgcccacacctgtgtaaggaattgtttcatgatagtctcttcattttaactatgtgggatgaattctgtttcctttgagtctctgactatagagaatgacacctggtgagtgaggcaggataatttctagtcctttttagctaggaatttagattccattctcagagcagtgtgaggccaatgaaatacggtgagataatctgatccccatgtaagatggtcatcctggatgctcttgagggtattgactagaggagtaagaatggaagcagggagaccagctagaaggctgtgaagccaggaactgtgtggtgcctgggcaagagtgatagtataggagaaagagaaatgagtggattcaacatgtaactgataaacttttagcacagaaatgtgagtcaagcatgacttaagttaatgatttgagccattgggaggtggtgttggtaaggaattaaggattctttgtctttggtgggtttcatttgaaatatctgtgaaatatccaggaagagattcaattaaacagtttggagttcaaggaatgagttagggctgaatatctagattgagtta

SEQ ID NO: 106306 - DNA, 1005 bp, Homo sapiens
tgagatacatcccatcaatacctaatttattgagagtttttagcatgaagcattgttgaattttgtcaaaggccttttctgcatctattgagataatcatgtggtttttgtctttggttctgtttatatgctcaattacatttattgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctgccgtcctttggtatcaggatgatgctggcctcataaaatgagttagggaggattccctctttttctgttgattggaatagtttcagaaggaatggtaccagctcctccttgtacctctggtagtctagaaacttttaaggtaactttatcttcaagtttggagggctacttgatgatgggaggcagacaactcagacagaggcattaagagctatcaagctcggtagtgggaagccaatggcattgaatttaagaagggatatatacatttagcaggtccttacattacagataatgcatcaggctttcaactatggcagtggtagggtggataactttatcactaaggcaacatacttcctcagtgatgtccgaggcaaacagtgctaatcgatcatttcaaccttgctgtccttcttaacagagcactccagacagtcactaccaatcatttgacactggaacttaagacgaaacctatttgctgtccaggatatgatttttacaaaagacataaagtttccttcaaatggatttttgttatattgattctccataaaaaaaaaaaaagaaaaagaaacaaggacaaaacattaaatctcaactttgtgaaggcacttctttagggagaaaatataatatggttcagaaaatgaggcatttcaagcaatcctttggcaagtgc

SEQ ID NO: 106307 - DNA, 1266 bp, Homo sapiens
tgaaatcatgccttacacatatgcattagaatttctgggtcaagggtgaagacagtatatatcaaagtggtttaaatgacagatgctagggccagactgcctgggttggaattctggttctgatactcactagccatgtgatcctaggtaggttacttagtgtccttgtgcctcagtttcctcatccataaaatgggaataataaaaggacatatcccatggggttgcttgaagattaaacaacatccataaagcattttgaatagcacttggcacagattaagccatatataggtatttattattataattattactgttgatatttataacaatttctattttggtgtgttatggtgattattattaaatttggatgataaaatatttaccctatttccaataagcaaatctttgagtagaataagaataggcagtctcttttatgctttcccattagagtgttttgctctgattttgttgtgtaaatctttcaaatagaaaatatataaaactgaaccataagttctaaaactgccatctaaattgagtatggttttcgtgctttaaaaaaacatgttttgtttgttaaattggaaacaatttagtgcacccacattccttctggtttaagtaatctatagaattaaaatgacaaaaaagtaggattagccagatttatatttggcaaaggagcgttgcaaacagcttccataaaacaggtgtagctgttttaatagatgtaccagactggcccataaaacccacccagttgccatagcactccacagatgtccacttaaacaatttaatatcactgaaatgattctggcaaagaatttcttaaaacaaactgtaatgatttatcattttgagctgtctcaagtaccatcattatcctaatggcccatgatcagaatatttttcttcaaattctttccccccactttggctctcctttttctgttcagaccctcttcatctgcatatgcttaataccactaatcaggctctttcattcatattatccaacccacactaaatttccttaccttactcttttcgctttcatttgagaaaaatcctgtcttccaatctcctcctgtgtgaattgattctagaaactttttttgtttttattattatactttaatttttagggtacatgtgcacaatgtgcaggtttattacatatgtatacatgtgccatgttggtgtgctgcacccattaactcgtcatttagcattaggtatgtctcctaatgc

SEQ ID NO: 106308 - DNA, 1187 bp, Homo sapiens
gagaaatgtaattatagcttacaggctgaactgggaatgagagtgaactattagagaaaactgtctggacattctctcatccagtgtctgttcaatgtgtactgtataagattccagagactgttccagaccctggcgatacaaagatgaataagaaataattcccttccttagtgagttcatagactatcaaatagaataatatagaacaaatagaatgcagtgagagaaatgctaacagaagtatatataattgctatgaagactttaaataaaatagagtttttatttttgccttttagttagaggtatgttgatggaataggggatgttgctaacgggtttcatagaacaagtaaaaaatcacaaatggtaagcacggcatttttggatgagagataaacatgtataaaagccacactactagtgtagtatattggtttggctggagaataaggagtgagtggagaagtgatgatagatggatctgaagaaataggcaccgattttttaattttattctgtaggcaagggattgatagtttttatgaattaggaagataacattgctggttatttttctaaagatgtgttaagttgctgagaaaaaaaaactagatatggtgagtgtaattaggaggttgttgcagtcaatcaggccagggatgatggatattgaaaagcaagagtagagttgaagaggaaggaatatacttcagaaatggggactctcagagaaatttttcagtgttagtataaaaagagaataggaagaatattaataaatgaaccacaattggcccagcacagtggctcacacctgtaatcccaacactttgggaggccaaggcaggaggatggcttgagcacaagagttcaagactagtctgggcaacatagcaaaaccctgtctacaaaaataaagttaagaaaaatcagctggccattgtgggcgctcctgtagtcccagtcctccagtcctagtgcctcagtcctactcaggaggctgaggcaggaggatcacttgagcccaggacgtcaaggctgcagtgggctgtgatcatgccactctagcctgggtgatggagagagatcctgtcccctcagccccccaaaaaaagtaaccaaaatttattgagcaatcacaccatgccagcaactttaccaagttcctttaactctcacaa

SEQ ID NO: 106309 - DNA, 1050 bp, Homo sapiens
tcataacatttggaaccatgggtattgatggtctcttggcaaattatcattttttcttcaggcttccatttgcaaagtaataatcagaaatcagactaaaatgggaaatatttttaaatgacagtgatttagaaaaaagactagaggttgaagaaaatttagaagtaataatggctacatattttatatttacatttctctttaggagaaactgaagattcagaaatattgtcttaatccatttgggctgctttaacgaagtatcataaactgagtagcttacaaactacagaaatctttgtcacagttgacaaggaaatatggtgaagtagttgctttagccagtgaagatgagtatgagctgacatatgtcactttaggaagatgctttagaaatgtccctgttcccatctcaatgctctgctgattatggaagaatgtaccagcctaagtccctgagttaccagaataagcagaacctcctgctgccccatggaacatgtagtgcgaagaagacataatcttttacatgttaagtttccgaaatttgggagttatttattactttggtataacccgtcttgactgatacaggatctaaaaatataacttagtcatagattaaagtgcttacttttctagtttgctaaagcttgttattattcatgggtgttgaatttcattgaatgctttttttctgcacctgtccagttgatcatatgtttttgattttagtctgttaatgtcatggatgacattacagatattctcatatttaaacttccttccattcttgaccataacctctgttggtcatcaaatatggtatttttatacattgttagactgagttttctttcctttatttaagacttgtagacacatacattcattattagattattttataatttttctagtcatcctcacatagttttatgataaaattatatttgataaattaagttggggtgttttaatcctttttatatctcaaacaatctgtattgggttccttaaaggtttggtagaacttgtctttaaaacctc

SEQ ID NO: 106310 - DNA, 1075 bp, Homo sapiens
aactcctcagcagcagtagatgcagtgtcttttctctagcaacaagacaaaaaccgggcatttttaatacacgtatacaaaaccaactacaactcattagttattcttgggaagaagaataaataaacaaagaattccagctctattttacatcttcatagcagaagctagtagccttagtagcagaggctagacattgtttgaaggcatttctactttaatttactatgccagtatttctgtctctttggagttgttaatttcttcatctcaggacctctctgagggctgatcaggactgcagttcagagtgtttccagggcattgtgagaacacaaaatgcattccttgtgctcctgtctttattacatgctgttcatcagtacattgcaggcacctcttaggcatttaattccattgggagtttctcttgatacaaattactttcatttactataatttttatactttatccacaggattaactcttgactcttttgaaactcttgaccaccacctttctcagaggtcatgattttttctgtttctgctatagctcatgccttgtcttgtgctttgctaataataaatcaataaatggctcatttcttgctctcatccaaatgaagccatatatggtaagcattaattttgtaataaattttcttcgtcagaatatcttactgccatttaaattttttacatagactatggaaataatttacttccaatattgaaaaataatcatctgcttgtgaagtataaactgagcctctgtttattttatctaaagcagtatacaagtcaaactttacttttttattcataagttcacttttatagatttgtttggaatgtacttatattacaaaattttatcttccttaggtagagtggaatatctaaaaaagtttattaatgaatcttgaaatctttggtcatgaactacttatagtgtcatctttgcatacttcagtgatattgaatacttcttaaaaacaggaaatgagtaatgctgtatccagtgaaactctaggaagaatttaaaatgtaatcatcattagcaaaaattcta

SEQ ID NO: 106311 - DNA, 1003 bp, Homo sapiens
ttgtttactggaaaacccaattatggtgttgttacctagaagggaatattgtaagtaaacacttttttttttctgcttcatttataccaaagcaatttaacatgaaattagtaattatattaatctgggctctccagagcaacagaaacaatagatagatagatagatagatagatagatagatagatagatagatagatttattatacagaattggctcatgtggtcatggaggctgagaagtcccatgacctacagtctggcaagctgaaaagtcagaagaaccaatagatagttccaggttgagtctgaaggcctgacaactggaagagccaatggtataagctccagtccaagttggaagggtcccaaggcaaaagacctatgttccaactaaaaagacagagagagcaaattctcccttactccaccattttattctgttcagggctccaattgattggatgagacctaaccacatttgagaggcaatttacttcactcagtctactgatttgtgtgttaatctcggccaaaaacaccttcacagatacacccaaaataatgtttaaccaaatctctggggacccaagagcccattcagttgaaaaaaaattgatcttcacagtaatgttagatgcagccttatataaggatgaaattctttgattcctataaactcttaaaaaagatttttttctactcaaaattaattacttagactacttttggaaacattttaatttattatttgaataaattttttaaaatttctacaaatagtgttttttttttttttagtgagatatttttgacaatcatttctgatggattgcaactgaaaatgtaaagacatgtgccagtggttgttctgggaatttttcagttgcaggagagtcctctttttgggctaaaaaatagatttgataaattatggaggaaacctatagagtgatggggcagaggaaggcaggctgctttgtgcaactgtatctcctaatat

SEQ ID NO: 106312 - DNA, 1032 bp, Homo sapiens
gaatttccagtcagtgaccttaatttgagttccaaactgtgatatttttcatatattattcacctaaatatcaactcagttggtatctcttgaggtttctgttccagaaactctccaaatgggccttcctgtttgtggaggggaacacactctactctcatccctggaacaaaaccttctgtgttgttcttcacatcctgtatgccctccaattgccacccactctctgcctccatttctgttcatctgaattttcaacctctcaaatcttcccgattctccttgagtgcccactgtctcatgacttgacaggccctgaaatatttccagtttcccctgacttcaagttggagggcctccatcagcatttccaaatctcttcatagtcccctgtctaccttggtaaagattttatttccagatcttactatcaggttattgtttcctttatttaaaaaattaacacaagcattactgtctttaccatgatcatgctcagattccctgactccagctagattcgactgctaaagattttgactggaatttgaagctgaaacatctcttcttcaccaccacacctctgccttaagctttatccatacccactcctggccatctcagtaatctcatgcagatggagggtattgtagtatcaacctaaataacagagagagcctcgctaaaagaaaagatgtttatttgggaatgaagcattgcaatgagaatatacatatgccatggtaaagtatgtgtgttttcagagagataaaggaagacaaaagtttttaaaggaagaaatgaaggagattacataattgttttgaaataattatctctggctgcaagatcaagggtgacaccagttcaaggttggacaggcagtttctgggcagatgttcttgcagagtttttttattccatatggttgtgatggccttcatgcaaggttgtggtttctgtagagcctgtttaattatgaggcatacaagcataagcaagcataagaaccctctctctttgtggccttcc

SEQ ID NO: 106313 - DNA, 1025 bp, Homo sapiens
tccttctgatggctttttaacgtcatgattttatagttttcttggcttattctggttgctgggatgacagtagcagccttttgccactgtctacattctaacctattcgcccctcctccccgtccatccatccatccatccatccatccttccatgtatagatgtgtgtatatatacatatacacagtatattacatatttataaaaacacatataaatgtagggatatttaaaagtacttttcattgaggagtaattccatcttgtgaattatttcccttcctctatatgcccaaattactataaggtgttagttttagctttcctaaataaatgagagatttgagtcactgaaaaccacatttgttttcatctaattctatgtatctaggatattttgtaaatgaggatttactacttcatatcttttcagcctcatcaaatctagaaatgaaagtaatcaatacttaaatttgattagttcgcaaataatgtagtctctatcgaccaccaaagaagactaagaaacagatgatgaagacatttaattacattaatatattgaaatttttatgacaataagagctaatgatagttatgtaacagttattgtctgtctagaaatatagtggtgggatattaagcaagatgttatcagtattcacatcattttagtttatctaaagtgatataaaatgaatataagcggaaagcttaattcatataaaaattatatgacagaaaaatttacacatggtacactttaagtatattatagtctctcagagtagtttttaccacagaacatagtgttatgtaaggtgactttgtctgaaacttgtctgtatcagctagcttcttctgcataacaaactactccaagagtcagtagcttaaaagtattatgtattgtttctcatttatctgtgggcaggttggagttactaggcctggctaggcaaataggcttgaactgtgcatgtggctggacttgcttcctcaatgaggtttggagtaaggtctgc

SEQ ID NO: 106314 - DNA, 1459 bp, Homo sapiens
atgtagtactactgacttccacaattaatgcagataattgagggttagccgttagtaaataaattactctcacttcaaacatcagatgtctgttaactccttaacagactcattttttgacagccattgagataattaaaggcagcagcatattataattaccacaacactaccttttagtttgcttaaataaaatttaactgcaagtactgtcagaaaaattcaggcttttcaactgttaccctctttttacttgtgagtctgagcttgatatccctatgaattgacaacactatttggattatagatatcataaagtttcagttaatatttagttaaaaagtagaacattatccagtcaccttatcttttttatttgcattctacatcatctctggtggatttttattatttttaagtagcttcacattatgttttatgatacatttcttcctgcaacagttttgcatacagatggaaatgttggaaatctagtttaaggtcgatctttttttcccattttgttatgtgattgatctggtcagtgaacaagaaattcttcaaggccatccatcactctaggcagcagctgagctaaaccttctaactcactgcttgcagtcagtcatgcaagatttgggttataaatattgaatgtgcaaacaactgtttaaattagctgtcctatctgttttatgcaatttcagtagaaaagcaagctgatatgttgtttagtggcaagaagtagaagacagtgaattcagtattatccttccatacgtcattgaattcatcctgttggcaaatatttaaaatagatcaaattaattcttgttccctgaagttaaatgagaactaaggcaactgagcatgtaatttatgtagtttttttgttttttatattcaaacagtaggaagactgttagtaattgtgcatgtagccatctgtcataaatatggtagccaattgttaaatgcttagttctgtgaattttgttacctctttgcaataacaaaaatagcttaatatttggaaaatatttggtcaggaaagaaaatagcaactggcttatcctactattcctggtaagcatctagaatattgaatatgtgcaggtgttagtacttctgctagttggagttgtaacaagtctgcatacattcactggtattgatatatgtaataggtaaaatgcaaacaatttgtagtgactcccaaaagcctttctgtgtgtaatgaatttaggtaaacttccataattgctatctgtgtttaaaatttatttttcaattatatgatgctgggaacatcctttcaagtagcagacatgtatctaagcctacattaataacataagtgaactgcttaccagagagaagagtgttcagtagcatgtgtctcttagtagttggatcacaatctaacataaaagttggacaagattataagttacttcct

SEQ ID NO: 106315 - DNA, 1512 bp, Homo sapiens
ataagttgggtagttgtaaatacaagaagaatccccctttgggaagggctggtgtctctagggttcctcatttctgtatttttttttctcataaattgtgaagtttctgatttggatgtaaaaatatctcagactctttggattcatagaaatgactgatagaatggcatacatgtagtaaattacaaacatatcttacaatagcacttacacatgtctgttaatggcatttattacataatggtcttattatttagacatctcaacaaccaactctccacctccaaatagaccatgagatcttgaggggccagagcaattagatcccaatgaggctactgttgaactttccatttctaagccccatttgtaaaagacattgcccagatattacaatagacatcagtagatttcattggactttagattggttacagtatagtacctgccatggtagtacatgatcagtaaatgttaatttccttctttcagtagttttctaattctttgcattattagactccctttaatttggcttcagtttgttctgtggtatacttcttttgggagacagaatgaagatatgggtggcctaaaattggcaaggtagtaatacatttagaatttccattcatagaaaaggagttttggagctagctggagttagataattaaaaatcatccaatccattgctttttagacacttctgaatcccctctgttacttcaaacaaaagaattcatcctcccttttttcaatcttatgtacattttgggatgaaaatgtttatatgttttacgtaaatagaggatgccattgctccctcataaggttgaaatccactgatatggttcaaccttctttttaaaattgggtaataatacaaagtcaaataaagctgatgttgcagttttcaaccacatttaaattctgtgtttcgaggtactctaacatttgtttttactttttaaatgatcagtatttgaattttaagttttagatattggtcttagcccaagtccgtaggaaaaaaattaggatttcctgcagcccaagctgctttatccagttgccccacaaagttggtggtcactggcaccctaggcttctggttctgatctcaggcacctctctctccataattcattccactcctcctccttgccatagccaccttggttgctgagcaccttacaagctctcagcttttggctcaagtttttcatccaacctaatcccatctctccactttttgaaccctaatcgttctttaaggtcaaactcaaatgcattatctttcataaatacttcccatatcctccagttgtagtaacatctctgtttcctcggtgttctcacaattgtgtacatgattactttgagggcagggactacatcttgtcatcagtataatccgtacagcacctagaagaattctctgtgcatggttggtcttcagtagtgcttgttattttgtattgtactgaaatgtgttgatatactgttggtgt

SEQ ID NO: 106316 - DNA, 1036 bp, Homo sapiens
ttggctgccaacctgcttctttgcttcctcacgcaccaggtgaagtctcttcttagggtcctgtgcacagtggtttctgtccccatctctttgcctggctaactcctcctcttcagcctcctcatctcagcttaagtgtcccttcttcagaaagcccttttatgattttccgccaactgaatgaagttcatctcttatgccttttctagtacccttttcttttccttcattacaactgtaacagtttataattattatatgtttatttaattatgtgtctttttgggtggacttcaagtttcatgaagacatggagcctgttctattcagcttgatatcccagcgcccagcacaaggcatgacacgtaataggctctgaaatacggacatacgggcggaaggatgggtggactaatgaatgaagggagaagcagcacccagtctctgttctcagaggttactctgtgagtgaaagatccatttaaaaggaaatctaaatatatcttgatgaatgttatgataacataagagcaagatcagtggggaacatatgaagtattagggggaactaagattataggctgggaactggacagatctgtaggcaaattctgctttacctctgtgggactttggtcaaattacttaacctgcctcaccttatggggtgagagtaataatacttacctcacaggtctgtcataagcattaaatgagaaagctaatgtaaagtaataataatggctaacattaagcacttatgacatcagcattgttctaagcactttgttatagctcaattaatcctcagaattagcctggatagtaggcataattattacctctgttttattatttgagggaactgaaacctagaaaggataaggaacttgccagctactaactcttagagctaagattcaaacatgtagcctgaatctagaacctgtgctctctactcccttgccacgctgccttacttgtaaatattgttatttttctatttgactatacatatatgcataagtagtagata

SEQ ID NO: 106317 - DNA, 1009 bp, Homo sapiens
tgtattagacatttgatcaattgaagcagtaccaacaatcattaattgcaagtgacagtttttgcattaaagagcagtgacttacatcaagtcaacatcaagtaattaaactaatttaatcatatttcttggatatcactatagtctggcatttccctaggaaaagaaagcaaatttcatctgtttaagaaaatatcaaaggattattattttgacaataaatgacctataacttgaagaaatatataatccaaaagtttgagattttggtttgaatgaagggcgatgttatgttttgtacggtctgctattcaaaactatggttggtcaaaaattgattgaaatatcttattttaataatatttactttgtctagaagtattactccttcctatttacatatagcagctagcaatatatttgttttaaatggagattgtttagcaaaaatgaaaatatacaacctttactcagttgagctatctattatgtgagatgttattgagaatgaaaataacatttgattggtacgcttgcatagaattgagtattgttgaagattttattaataaatttatatactttaaattaaccattacatttaaggtatgctattttcttattcttctttgtaattaatagctgtccaaggtctgagcttaggtttttattttccatgccagaataaatgatttttcttattaaggaagatgattctatactgcttttactaagtaaaagatgattttttttcagtgaagccatcaaacacacaatatttattaatcaagttcaccatcttatatggggtttgttcatggcaccccaaaacaattacaacatgaaagatcactatcataggtcaccctaacagataaataatactgaaaaagtttgaaatattgcaggaattacaaaaatgtgacctacagacacaaagtgagcacatgctgttataaaaatggcactgatagatttcttgacacagggttgctacaaaccttcaatt

SEQ ID NO: 106318 - DNA, 1048 bp, Homo sapiens
atgtagacatgaatagtcagtttaaatatactaagccactggaaaaaaatgttactatagaatttatttagcatctgacacacaggatcagtctgtgtcaaatgttattaaagtactttttttttgtcagatcatcaccatatggtatcataatatttcttttaatcttagaagtgaaacgttttggaaactggggcttctatatgtgagaaagttgaattacaaaactttctttttttgagggtaagaactcttttatatctaaaaatgctcatataaaaatgccctatgtgtgtaactctttgtgtttgaagagaacagtgctgattcagtgagatttgtgacataaattagggaccttttttaaagactgatttcacttatcctgctgttctctcagctctatttacagaggccattgtgcaatggaaaaatactgtggggccaatcaatgcaagatgcaagagagattcattgaggatggtttatttaagttggcctcattttggtatctcactttgcttttgtagaccagagctctgcttgcctcactggcttttcccataaatatggtaaagtcagatttctagagaattttctaggatcaaggcctgtgatctcttatttctgttacattgcttacactactgatggccctctggagagtactaagcagaagcttagtacttttaagtaaaggttatccctgtatgtttgataaaaatgttatgcatatttgatcaaatatgtttattgtttagaatgtaaatctgggataaaacataggaactgttataagttgttcaggaatgttgcaaaatgggaatcatataccagaagttctttatatagactatccaaaaacgtgttgttactttaaaatcccttaatttgttaagcgtactaagttggaataatataaaatagcatgagttttagactagttgccttttttttgtctttaatccacgtgttggtctgtactattggctttgtaggagaggttcacagataaatcaagacatctccattttctacccaaaaagtc

SEQ ID NO: 106319 - DNA, 1048 bp, Homo sapiens
attttttaaaaactatgaagatagaaaaaaggatcacagtctgacagagttcaaaatgaaaaatcaaataaaaccactatttctttgccttaaatatcaaatgatcagtcatgtctctacctttttccacagaattgaacatttgtattattccataatgttgccaaaatgtggcttttcattttaattttaggaaagatcaaaaagggttcttatataagtctcttgaaatggaatagaaatgtctccctaagtgcctctttaatgtgaggtgttgtaattcatctcgagatgagcaatttatgatcaaatgtcaaatttgcagagaacgatggattccaactacaaagacttagatggggcaaatggtagagagcaatccaacatgcattaatttaaaggaagttaaaaaatatacattatctgtagatcttcttgtgtttgtgcctacacaaccaaagtaaatgaaaactgaaaatttcagacaactgaaaactatttgatttatcacacagtggttaagaccctttggcatgagagaaacctgaatttaaactgttgccccactaattcccgactgagtgaccttgtccctttactgccctgtgcttcagcttcctcttctataaaatagggatacctatggtattcatgttaatgattaagtgatatgtgcctgtaaagcacttagcatagctgctcgcagtatctgcatttatctgaatattagtatacattcctatacatatttcattgtcacccagcagaatgacaattgatgtcatgttaaccacaccttctggtgccctataccacagtactttgtatccagtagacaatcagtaattatttgttgatgttctgtcatagaaatgtctgttatttttgccatctctgactttaaatgtgattctcttggcctgtgttattccaatttaactcagcagtttgtccatcatggttgaataactgaccagtccagtgaaaagaaatcagtcaaacttgttctttgactgcagggcctggtttttgctaaaatgtgaggaag

SEQ ID NO: 106320 - DNA, 1021 bp, Homo sapiens
atactggggaattaatggtagctgtttcctttcatgtagcatgcagaacgaagagaacccgtttagagagaccaagatgtcaggaagaaatgaaagatggcctagcttttccttagtgttctagaccagggttctagctggggccagatgcctgttttcatgaccttggatttcttaaacctgaaggaacctatttttttttttacacacttacaacctacagaaacatgtattataacctaatatttgaggtcctgtagctaggtagttgaatttcttataagttttcctgtcttggcagaaagaccctgttcttaaaaaaaaatggcacatcctccaaaaatcccatgttgatttaatttggcatattctcacaaagggaaggtcacggaacaagttccatttccattttaatggtttaatttcattatactaagcagacaactggaaacagaaggaaaccattaacaatattgtgatgtcacacaggacagatatttcaaaatggttttgctttatagaagtatgcatagtgtgaaaagattacaccactgtgatataggggaaagggcacaggcctttcaaatccctgccctgccgtctcttaactctgggaccgtgagtgggctgtgtggcatctatgaactttggttttctcttctgcataaaagagaataatgatacctactagagaattgttgcggtgatttactgagactgaaatgcgcctaatggaatgcggccacgtggtaggtagcaataaataccattcttttctcacttcttttgctgcccatgaaaagctaattctgaggaatctttaatcctttttactatctttttacaaacctactgtatgttaagagtcttatagtgtaattaaggggcccctcagtatttcttgaagtatattttatagggctctgaatatgagatggtaatacgtattttatataaagaacaaagggaaaatcgtccccaagctaaaacgctttaggagaatacagagggcaatatcaga

SEQ ID NO: 106321 - DNA, 1122 bp, Homo sapiens
cgaatgtgatactaaaccatcattattaaacaacatctcaaagaaggattaaagtctaccagtcagtgtcctatcactaatacttctgtgtttctcctgagacacataatgaagcaagctctgaaggtgacatccaaacaaaggctggggaatgtaaactcagtttggatctttgagattaagaagagctatctcttcttcacagccctataggtcaatgggaaaatcttcaaaatcaattctttcagcagccaggaacatctgaaaggaaatcaaaacttgcttattatgctgacatggtttaacaccagctaagacttagaaatgaattttaaaatctaagctctggcaacaatacatttagcaaaatctcctgctcgagatatagcaatcataaactgtcatattccttacatataagccaacaatggtgttatatattcggtatcagaataatgaaataaagactatatgtgtatgtgcatgtattgtgtatggatatattgaatgcaattcagagaaaactcacaggtattaattattcattaattgtgttaatatgtgtaagtagttattcattatgttgacatatgtttaattcaaatgaaatccgttagtgttaactattcattaatactacagatatatacatgtaaggataatttcactttccaaggcattaattattattattttttgttgtccctgtgctatgtacacagctttaattgtctggtctgatttaaaggatttgtgtaatgtgtcatcattggaatcctacttttatgctaggcactatcataggcactggaagcatgcaagtgaactggacagacaaggtcccaatgatctcagagcatgtattctagtatggggagtatattgataataagtgacttgtctgttaatctgttctcatgctgctaataaagatgtacctgagacgtaatttgtaaaggaaggaggtttaatggattcacagttccacgtggttggggaggcctcacactcatggcagaagataaaggagcaaaggcacatcttacatggcggcaggcaagatgtaagtacagggggcatgtacagggggactccccttcataaaaccatcagatcctgtgg

SEQ ID NO: 106322 - DNA, 1040 bp, Homo sapiens
ctttttgctttgttgtatgataagggagaaaaacagggttggcatgaaggggaagtgaatcaggtgccaactttttttgttgttcctcagctctgatctttgctttccctgagccttgtcatctgtcagggaaaggaagagtgcaactacactaagggtttgaaaaatgaatcgatcattctatactttcagaaaacatattcagtaatctttaaagtaccattctcatgtaggcgatagcttcaaggttccagcataacatatgcatagtgaaatgttttaatcttttattttatgcttttcagcattttagaaagcatcttttgtgttcattttccatggtgctgtgactttttttttttttttttgcttagtacagctagttgagtggtataaatttcttaagataataaaaccatggctttcttttatttcattcttagataggatagttttaaaacatttaatattattaaatatcgctaagatagagtaagtacagtagccattcacctatactgtacattaatacttaagggctttattatctgacatttcatgacttggtttagttctggaaaaaacctgaggaactcattaagaaagggagggagtgtccaataaagtttgtatttgttgctgatacacaaattcttttttttttttttttttgagacggagtctcgcttggtgccaggctggagtgcagtggtacaatctcggctcactgccacctccgcctccaaggctcaagcgattttcctgcctcagcctcccaagtatctgaggttacaggcatgtaccaccattcctggctgattttttttattattattatttttagtagagatggagtttcaccatgttggccaggctactctcatactcctgacctcaggtgatccacccgcctcggcctcccaaagtactgggattataggcataagccaccatgcccggcccacaaattcttaatttctacctgcctctaaccagctgcttctcccagaaaaattcagtattttcaaagccagagcttt

SEQ ID NO: 106323 - DNA, 1019 bp, Homo sapiens
cacccgcctcggcctcccaaagtgctgggattacaggtgtgagccaccatgcctggctgaggctttcttttaaacagaagaattacacttccaattcaataaaatttcctctagaagagaattggatattaattcaaagaaatacgaagtttttattttaccctatgcttatgtagaacattagagaattccccaaatctctaaatcttcattttccaactaactgaatggcagtgataaaatttcctgtctaagcaaattatttctcaccatagatgttctctttatgtaaatcttgcattttgagcctaatgttgtaagaaaccaggtctgatatgtgtagtttttactaatccattgtttaccttgttagagaaacagtgagcaggttagctacctaggcgaattgatttgaatggagacagaattgttagacatacgttaatttgatagcaccttcaaggaccaactcaagggaggcctgatttaccctcattgccagtcacttgcttttgttagtagtggatgcaggagctatcatgtttcattctcaaaatcacagtatccgtttgcacacggaaaggtggaaggaaggcctatgcaagtgtctgttgaggcattttcagctggaggtctgtcttgatttgtagatgcacttccctcttaactgagttttaggattacagttctaacatttctgtgacttcaaactcagtttgtacagaagtggccattcagtgaggtcctcatcctcattaatgttcagaacttcaaggagtattctttgattagttttgggagtcctcggtttgtccccctttctgtacctcaagatttgatatgttttcacaccgggggaattggtagagtatcattaaaggattcatcattactgcttcctgaagataccctgtgccccagatagccccagacacacactgacttttctgacatgtgatgattttgctgactataatctggtctctatctctgcctttgcagatcttctatataattta

SEQ ID NO: 106324 - DNA, 1043 bp, Homo sapiens
ttagatgatttacaggaatagagtttttgtggtatagatgattgtgaaaaatcaggtatatatgctttatcatacactgttatagcattggacaggtcttcgggctagtagcgattaatgggaaagctatagtcttaaagtggaatgtggtggaatttgagcaatttcttctgattaatcttagtgatgcagaatatatgtatgcttccctttatggaagattctctagaaaacgcattccatcctgtcccctgctgcatctcaggtatgacacttctctcaaggtctctacataaatgggaaaaaaaattcgaaaagaaacattatttgaaaaattaccttacaaatggaaacttgggtgttcgatttttcgaactggtaaaaatgcccaggcttgatagtaatgtgtgactgtgtattccaggatacacttcggtgcccatacaaagtacttcctgagtttgattgtacccagtgaccaggaatgcaaactgttttctttatgggattttcagacattccagtcccccaagagtctttctctgccatctctgggctttatggaaaccccaggtacacctgtatgtcatgtggtttcccagaagcctttagtgtgtctgtcttatttcagtactctctcccaggatcataactcagtttatcaaagcaactcagtgcagtggggtgtacgagacagcacggctaacttgtccaccatgaaagcctctgagggatatgagtggtctgtggtatttttgccataggtttatggttttgtcacttaagttatgcttatttgtatgtgtcatgacaaaacataacatgtatttcaaaattagtaattagcagcaaaggaagaatgattgcatcattaagcatccctttaattagaaatggtgtgtaccaagaattattcaggcattacttcatttaaattttagagatgaggagacagtcagaacacatgcttacatagctagaaagtagtaaagccacgaaaccgagtttttcagattccagaagcaggcttttaaccattattt

SEQ ID NO: 106325 - DNA, 1107 bp, Homo sapiens
ctgataaccatttgataaaatggttaaaaaaaataaagtaaaaatattttttcaagtagtaagaaaaacatattgggcttttcattagttgttgttttaccgatgtttaattcaaactatgttaatgttgcgattgccttcttcgttggcccaagaactcctaaaaacaagttttcattatacaaattgaaaatacctattctaactctaaactattgaaagcaattaattaagaagttttatctgcttatatctctcacttaaatagcccatatgagaaaaatagtctactatttattctctatatggacctggctgttaaataattcgaagtcactagtacctaattcttaaattggtatataccttcactggctcgttacaagcaggttccttcttgaaaacatggtttttgttggtgtttttggtttatggctccttgcacacaacttttctatatcaaatgattttccattaataagtgaggcattgtctgctgttatttcatccccaaattccccacttaacccagtgctggcattactggaactctctggaacccacttctgtagctgacctgcagctcctcattttttaaaatctctcttcctgctctgcattatctttctctcattatgaaaatccagcatcccctctcaaactcacttcctctggagtggcttaatggactttttctgtttattcttttctgctttgtcacttgcatagttctatacagttctatacaggacctggataatatgcacagctcagctcttagagatatatatacatatttatatcttggggatatatacacatatatatatatttatgtaccataaaacatttcagtcaacagtgaaccacatatatgacagtggccccataagattataatggagttgaaaaattcctattgcccagtgttgacgtagacattgtaatgtcatagtgcaattattaatactttattttttaataaatttagtgtaaccttaagggtacagtgcttattaaagtctacagtagtttacaataatatcctagatcttcacattcactcaccactccctcactggctcacccagaacaatttctagtccc

SEQ ID NO: 106326 - DNA, 1103 bp, Homo sapiens
gtcatggttaacaatcactgaactctgttcgttatattctgggcatatttttgacctgctttccatgcaagtcatcagattttaaggaacaggaaaagactggtcatggtgttgcaggcatcgcacttgctaaggaatataattagaagtaatgaatggaataataatacatcattatttataagaagtgtcatgtaattaactcaaataatgcagaatatattctaatttccatttggaatgaaaataggtttgtttgaacatcagtaggtagttacttattcttttatatttcatgcacatatcaaaactgttaaaatctactgagtacatatacgtggatttttttacaacagtcaaggtagctttcctctcctaatagtcttatgtatgttccttatttttattatatatacaaaatacgtatatgtgttcaactcttagaattagcataattaatttatatttattgcaaattaatgatctaatttatttacttagctgccatttcctttctcaaactaattaactgaaaaaataaccataaatttgcaaatagcttctgggcacaaatcctacattggacttatccttaaaaacctctacaataccagatatctgaagtagtttgcaatctaaactatctttgtgagatttctactacaggctttaaatatatttcaggagccttggtttagcttgtatctgcctgcatttgggggtcaggatatgggtggatatgtcttaggcagtggagttatgtttatgtgtaacaattagtatgacaggtggtactgaccaatgtcaaaggtggttcctgaaagctctctactgtgccagacatcagcctattaatttgtgcattgtggggaggtctggagagtcccaggggaggaagaaaagaggtggtgagcagcacgcaagggtaataagtaatacttgtgtatttcaatattgtaataacaggaatagacatgccaatgcacatggtctcagtagattttagagggagattttagagggagaaaaacagatggaagaagctcctttatattcctaagaccaagcatgttctttgttcttcaagaccaattaagtcaagc

SEQ ID NO: 106327 - DNA, 1040 bp, Homo sapiens
cttcagcagagagtgtattgatctctgcattgctattctgaatggcataaggagctgcaacatgagggagacacagcaacatttgtggatgaattgaatagggtgtgtaatgacagaaaccttgctcactgatcatactgtattctacaaatcatacgtcaacagtttattgaatcagttattaaaaagagcagatttttccaatcaagaccatctcacgcagaatgttaccagggccatacaacattaggatgatgcatgtagggacagccttacaaagtatatttgtgagagaattagactaggtaactttaagaacatttctgctgacacattagaaataaaaagttggctaccatgcaaacagtgctccaagatccaaattcaaaaggtaaaaaagaaaactctgacaaatatcttttaatacggaatattaactttccaaagagcaatgttaagtttcccccgttttcagaccgttaccatgttgagtgttcctgaaataagtggaaaaataataaaaatagcttcattacttaacagtgattcttacagaatagatgctatacataaaagcgcccttttagtccttccataaaaatcagaaatatttgtcatttcctcagtaggttgtaatcttgtgaattcctttaattgttcaggaaactgcagttattagtgatctttcatttctctaaagagtttcttttcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagcctagatcgcaccactgcactccagcctgggcgacagagcgagactccgtctcaaaaaaaaaaaaaaaaaaaaaagagttcttttcaaaccttcctgtaca

SEQ ID NO: 106328 - DNA, 1020 bp, Homo sapiens
tggctgtacgttagaatctcctgtagagttttaaaatcctcaggtgcatgggtcccaccacctagagattctgacttaattggtctgcagcagagcctggacattgagaagtgtaacatttcccaggtgattctaattgttagcccctgttaagtactgcttggggtctagtttttagcaagactaatattcaaaatatattaccattggtactgcattaagtaagctcttgctctctaccaggcactgtgctaaatgatttacaggtttcaatccatttgattgtcacaataaccatatgaatgaacattcattaattccttcatttattcaacaaatatttatggggcacaggcaacaggtcaggcagtgtgtttggctgctgggtaggaggttcagggaaagctttcaggggagatgacatttgagctgacatctaaagattgagaaggagttaaccaggtaaagagttgaggggaaggcactgatgaccaggaggatggttttgcaaatattctgtatcgggaaggaggatggctagttcaaggagtggaaaaaagaatttaccagtgcttctggagcagaggaaaccaggtggagcatcatgcaagataagatatagaggtgggaagcgaccccctcaacagaggttgtagttctgtgaaaggcttttggcctttattttgagagctcatggaagctctgatcacatttgcttttcctgggagatctctctggttgcagtaagtgaaacagaatagaaggaagcaagaggagatgcattgtaatgagttgagtggccattgcaggagatctggagagaaatgagaacagcttggactaaggtaatgaagggaaagagacaggtaaggatatttgcgtggaccttaggacttgaggatggattcaaaggagtagacgatgaatgccatctccaagtttactattattacctccaatttgcagaggagctggtcaaagcgtatgagaatttgtgtagttcttctcaaactacagtgt

SEQ ID NO: 106329 - DNA, 1585 bp, Homo sapiens
ctgggctaatttttttttttttttttttttgtatttttattagagactgggtttcactgtgttagcctggatggtctctatctcctgacctcgtgatccacctgcctcagcctcccaaagtgctaggattacaggcgtgagccactgcacttggcctgtcttatttttcttaacactagacttctctgttcatttatttacagtacctcccagcacaaaaggcatttgagtttgcgtttttcctaggattagcaaaaagtgccaggtaggcgaaggcagtagggtggtgatggcggcagtggctctggaggccgcagtgcgagtcctggcctctgctccagccccactgtggtgacgctcgctgagctgctgttgctccagaacactctcctgaccatggtcttgggctatttcatcagcatccacgcacatgctgaagaatgcttaagtgagtcacctcaggcaccaagatgggcctcatcttcgaaggtggcttcctgggcatcaacatggagattacaggacctaagaataaaaggatttataaaggagacaaagaatccagtgggaaatacacattttctgctcacatggatggaacaaatacattttgttttagtgaccgagtgtccaccatgactccaaagatagtgatattcaccattgatattggggaggctacaaaaagagaagacatggaaacagaagctcaccagaacaaactagaagaaatgatcagtgagctggctgtggccatgacagctgtacagcacaaagaggaatacacgaaaatctgggagaggatacacagagccattagtgacaacacaaacagcccagtggtccttcggtgcttctttgaagctcttgttctaattgccatgacattgggacacatctactacctgaagagattttttgaagtccagagggttgtttcaaaagcctcttcctgatgattccaaactcatagtttactgtttaccaaacaccttggtgataacgtcataggccattaatttctatgttttaattttctgaactatacagtcacagcttatgtttctttgtgattaatagaaattggaagaaaacacctttttaggaaagtcatagtgaaaatttgacaattgattggcataatttcctaattaaatgctgcctccattatataggtccttccagaaattaaacactggaattgaaatataggaatatatatatatatatatttttaaaatcttcttttccttttgttttgataataaaatgcagttagttcaggaaatcagcacaaagcctgatagtactttactgaaatgactgcattctgtgtattccctcattctgtggtttaagctattaaggattcattttgttgagtccttatgagaaacaatagtatgaatcctgacattttctatgcatgctcatggcagagctctctggcttgggtgtatgctgccaggctgggcacttttatactttgttttcaagttttgcttttaaaggtaagacttgccccagcacctattttcccccatacattttacattgtaccttaggactcagtcacctccactta

SEQ ID NO: 106330 - DNA, 1047 bp, Homo sapiens
tgtaaccctgctcccaccccacaatacctcgtacttatcctttttgtttttttgccagctcacttttctcccccacatttaaggtttcacagagatatgaaaagccaccctggttcctccatctattaaatgggaaatgcatatgaacaaatagaagaattgcaccatacgatgcagctgaaatacaatgttatcatccttccactctgaacatttctcaggatggtttatgtcccagcagttaatggcttgctattgttggtgtaccaacacaatgctattagcaacacagaattctcaggctttctgtttagactatcttcatgtaggctagccagaatttagatatttgtaaacggaatttgaacagtggcctttcttcacaatataaaattcagataagtgtaactggtcatggcccaactcttgtttattaattaaggctttataatatggcaccatttttggaagctgcagtttatgcaaagaagaatactaattacattctgcattttctgtaataatggggcagtgttttggacaatgcagtttatccagacaatgcatccggctcataatgtagtttattaacaaggaggctctgaatgtttcatgggagattgatacagctgtgaaagggtggcataaataatattcctggccaggctgggggcagtggcaatatgttgcatgctgttaacctcaagagatctccgaatagcttttatgtatgcctgctatatatttgttgaccattgctggatacaaaggaagctaagtgatctgggaaaatctatttggtaattttcttttcccattctcttagcacttgctgaggccttaaaaacaataggcctttgcatttgtatggattgtttttccttaggctccaacaagaacgtcactttaatattgttatcatcatggatttcttataatggtcatttgtgagaatcagaataggctaccattttttttctataagatatttttcttattgaaataattcacatagcacaatgtttatccgtttataatgtgaaactt

SEQ ID NO: 106331 - DNA, 1081 bp, Homo sapiens
aatcaagaagatgattaaaggcaaaatgatggtccagctttatgaaagaaggtggtattaagccagaaatcagactggtattgtttggcatgaattaaacttataataagtcacaataatttctctgtagctatatagtctgggaaactgtaatctagttcccaagtgaataaactataaggccaaagggcaaatagtttaacaaaagggaatcagatgattatcttgtaagctagaagagcaaagatactgtggcttaattacatagcttggtaggaagctctagttacaaccaaagtcttaaagtagttgtctggtcatttgcaagatactggaatggtttaacttatgagaagagagaagacatagaaaaaaaacagaaattctgtaatggctcataaattgttgctaggggaaaacaccagggaaaatgatttaatattgtgattataaagactaatgcaatgaacaaggaatgtttcattagtgatcaagaaaattgcattgacgggtatcagatacccatatgattatggagatgaagtctagggagatgtttgggcttaattgggtacagagctacagggtacactaataaataaatattcttggttttgaccttgggataactgttgcgttttaactgtttcgatgtgtctttgattttgaccatgattgtgcagatcgtaacccttaaattctattttttttgcctagaatatttgagtaaagtctgactctttgcagccttgaaattctgtgaccacccagtgggttcttcctgcctgctacacaaacagagaccatggaattgcagtaaagaaagagtttagttgacagaaggctagccacaccatgccggagatggagttattattcaaatcaatctcatagaaggcttgtaggttaggggcttttcaaaggtagtttgggcgaaggcgtagggatggctatgcaatgggtgtttgctgccgattggctgggttggagatttaatcatagggagttgaagctgtcctcttacactgagttgcttctggccagaggaaccatcagttggtgggtccaagtagagccatgg

SEQ ID NO: 106332 - DNA, 1083 bp, Homo sapiens
tttatctcataccaacgtatctatgccatagattgctgggaaacaagagttgtcctggttactaacgtagtgtacattaagtttcctggaatttttttttttaagcctgtttatttgatgctggcacctctgttcttctgaaggcagcatattaggtttactaataaatgacacccagttcctaagagactcggcctaaaagctttcctgacagggcaggaatttgtttcttttttctttgcttttattaaaaaacaaaaaacaaaaaaacaaatattgaggcaaaatcgaggatgaaggacattttgaaaacttgagtactgtaaatagttttaaggaagatttcatttttccaaaactacacattttgcagtttctttaaatgcccatttaatattttgggtcttgccagggcaacgtgttgcttttacgaataagagccaataatgagcccatggagcctttaatttatgatgtatctgacagtatagtggtggatctgataggggatgcatgtgattatgtctgcaagctgaaaataaagtagctggtatttgttctgaaaacgttctgagaacaccctcctgttaatggcccatggcttgatccagcatctggtaaactaatagattgtcatttttaccatgaaagcataaatcattaatgattccacaaccatttgagttcttctctggtctagaatatgccaattaccatgaaattagtcctattagcaacatgattgaatgatagtaacctgactgtaacttgttggcagaaattctctcataatgacagtaatgaactgtgcatttgagtccttgctgggctctgttaaacaggaaggttggatattatatgtttctaaccccttatgaatgatacttcttaatgattatgtgaattgaaggaaatgttctgttttgccgatttctttcaatgtaggaatttatcatttttacttaatttgttgggggaaggaatcactgtttgccattaaaaatgttgttcagggactactttgtgctacacacatattacgatcatcaccagtatgtatatagagcctaccgtatcaggctt

SEQ ID NO: 106333 - DNA, 1018 bp, Homo sapiens
gagttcatacggggaccaaaaaaaatgagtgtatcacagaaatgtcgactaataggaaaattcatttgactttccttcttcctgtggttttaccacaggcagaaatttcaaggtaaggaagaagaaaagaagaaagggaggaaggaaaggagaagggacggaaaaggattccagtttctgaatttttgtggcatcctactgtaagtggcagtaaaaggggcttgtgggtgtattttccaagataagaatgaatggataacatgagttcatgtgctttcctgggagagttgatagggatgctttttttggaaaaggggatctcctcatttgatagccctgtgatttgagcctgatgtgctgttaaggcttgggaaaggtagccccagtcaggggtccaatcttctgcaatgtgatccaagcataaagaagtgcttctgtgtgcagtggattcaccatatgcccacttaggaacccagcatcaggtgtagatcttcaccatgcctaaaatgtgcaagcaacagctgttcagaggtaccctaactggaaatgccatcttggaaagaaaaggtgcaggttgtcatattcttctctacaggattttaaagagcaatgtgtttgtgggtctgatgaaacaagagttagattaaaatgtagcaccctattgagtatctgctctggaccagaccctgtggatgatgcttttgcttatgaaataaggttatcagccaggctcattggctcatgcctttaatcctggcactttgggaggccaaggtgggtggatcacctgaggtcaggagttcaagaccagcctggccaatatggtgaaaccttgtttctactaaaaatacaaaaattagctgggctttgtggtgcatacctgtaatcccagctactcgggagcctgaggcaggagaattgcttgaacctgggaggcggaggttgcagtgagctgagatcatgccactgcactccaggctgggcgacagagcaagactccatctcaaagaaaaaaaaa

SEQ ID NO: 106334 - DNA, 1048 bp, Homo sapiens
gcatctactaagagctcaaaaattatcattttaccattattatccattatgctgccttcaagttttcactcgaataactatggatgtcttaaacttaattaacctaaatttgataactttcatgatatgtgaaaaatgggagaggcccattaaattaaaggtccctgcatgctgaacaagcacaatgaaccagttagcactgtggcagagggcagaaaaggtttgaggataaggcttgtctgtggattgggtttgacagaactaacttggcatttaaggagtatgttgatgggcagccattcaattaagtggttaacttggaaagtgggagtaggatagtcagtcacacattgtaacagggtagcccaagaggtgggtagaattctaggatggggaatccagtatctacacacatggtacagaaaaatgaatgttggacaagtagtaagcatcagaaaaggtttccaaggtagtcagacctatttctttggatgggttcaagtatgtaggtgggaggaagaataaagaagccagcaagggccagagtttattcctagagggatttgggtcctgggaaggtgaccaagggtgccaggttgaagcccaggtaagaaaagaacattgctgagcatctactgttgcctgacatatgctcccattttaaaaatattctctatattatctcatttctctctcatagactcacaatgtaaatcttattgtatttattttataggtgacaaaagacatgattaagtaaacgtttccaaggtcacacgtccagtaagtggtcaagccaaatcaaacacagaccttcctatttcagaggtcatgatcattccatgacaacaccctgcctcagaggtgacttgatgttgagcttagagcattgacctagctagtcttaaatctctcctgccatatgccatgattagtccttagaagaggataggttgagactgcagatgggaggtgggtctaggatcgcaactcttgggagaggaggcccgcagaagctgggagagggtggagactaatcagcaagagt

SEQ ID NO: 106335 - DNA, 1038 bp, Homo sapiens
agagattgaaccacattccttcatgttcttcaccttatttcttattctaataaccaggagttgcattgtatccagctgaatgcataaaattgctaatctgaaccaagttccagagtgctgatttgctttaaaacaaacaaacagaaagccatagtgacattcctgaaggcatgcctccaagttcttaatgtaattacttcttggttcctgagatgtaattaattagataaaaagagatcaagcgtaatccaaaaggatatagaatattttctaaatgggagtgactgtgggcttcagagccatgaaaacaagtcactagatccagggacacaaacatctccctcagcccctcactgtggtgggaaaacctcttgaaggcaagaaccactgaaagttacatacagagaggctggtcagagggataaaaaaaaatcccccttcgaatctgcagaaggttttcttaattttttttcccgagtagtctttctctacctggggttgtctgccctaactgacatcaaggccattttattgaaaattgttcagattgtcgatgaagcacttagtctgacatactttgtctattgttactgttaaattaagtttcactctgacagctgaccaccaagtcaggccccattttgtctaggagcttctttgattcaggaaaagtaccttatctagtaacctcattgttttgtagctcctttttacgcataccttttaacacacttcaagatgagagaaaagaggatcttttaaaatgtcatatatatggatgtgtgtgtacacatatatatatgtatatggatgtatgtatagatatacacatatatacatgcatatatatacatatatatacatatataaggatgtgtatacatatatatatatatatatttttttttttttttttttttttttttttgaggcagagtctcgctctgtcacccaggctggagtgcagtggtgcgatcttggctcactgcaagctccgcctcctgggttcacgccattctcatgcctcagcctcccaag

SEQ ID NO: 106336 - DNA, 1030 bp, Homo sapiens
catggactttgaagtcagacagtgaaattttggccccgccacctcctagctgttaacttgaagcaagttacttaactgctctgagtctgtgtttcctgatctataaaaaggggtatctgtggttacctcaaaggctgttgaaaaactgaatgtgcccatgcctgcaaagcaccacgcatagaggctggcaagtactgagtgctaagtaactgttgactgatttgtgagttcagttttgactcagtttctgacttctgctggctagaacttataactacattaagacacccacctggttaaaaaggtagaagactcaaattatatacgtgcacatacgtacatatgtatctgcttaggatatagtaagacctcaatcaatattagtttctttccagttccagtcatgttggtattaaattagtatgacaaccaaggctgaactgggcaaatgtgaaatagatctatcacagtaattattatcatttgtattactttagaatttaaaaagctctttcaacatgcattgctttagtaagtccttacaacagctggggaggtgtggaagtgtttttttatttgtccatatattctttcctccacgcagcaaatgcacgtgagtgcctgtgatgtgtcaggtactctgctcatcctgggaaaccaaatagatgtcctcacagccctgtcttggtgatcctccaaatgtatgtcctaagataccaaaaggtggtatagacaaggtagttatttccagtgattaatgttttatagatgaaaaaaaatgagattcagtgtggcttgtaagtgacagagccagatctcaagctccaaatcccaagtcttttccactggatcccatgcctgcctgcctgaatgtatcatttggaataaatgctagagagagcctggtgtagccattcattttacagattaaaggcaccgaggcttaaagtgggtaaatgatatgctcaagaccatctctgctttaggggtagctatcagttccaatgaggaaaccttttgacagcatgct

SEQ ID NO: 106337 - DNA, 1074 bp, Homo sapiens
aattatgttaataaaggtaagcaaactagttgacatcaacacatgcattctgtttcttctttgtacatccgtgtacctcccagcgaggactgtgaaccagattccgtatgtattcaagactttcattagataagaatggcatatacttatcattagagcatactaattaaagcagaaagtgacatttcaaagtaatgatgctccctagtgtctcaatgtaaaatactccctagtctatttttaatgaactggtatgctatgtatgtttaaaatattattttgttattttgttttcattatttcagtggtggctatgaccaggaaggtaggacgttcttctagatataaggaaagaggccagtgaaacctaccaagagcttcgggctttgattgtagtcatattcagggtgtatccaggcattcttgcattcatttggtgctttgactgtatgcttgctacttgatactgtctgtgctaggttaataggacccagatagttcctgccctcaaggagattacccacgccctttgattatgatcaaagcaaagccgttctttatatttcctcttttgcatactctctaatagcaaaaaggatgatatgttcagtgctggttatatatacacccttgccagttactacaaactcttaggtattcttagtggataaggatagctaaagagtctccttacttattctatatttttttccttatatttgttactgaatgcattttcctcatagtaaaagcagacatcatcgtcatcatcatattcattgtttattaagtatagaaatccaataagataggtatcactattatttaaatgttttatggaagactgaataagttcagagtgtttaggcaacttgcccaaagctacagagctggtaaatgacacagtcaggacttcttgacctagggctggctgcccccaaagtgctcttgacctttatgctttaatgcctctcattgtttcttattttttttttttttttgctttctcttgcatggacagctgttaaaagtcgttatcctcatagatgatgatgagttaaatacttaggttgt

SEQ ID NO: 106338 - DNA, 1053 bp, Homo sapiens
ggcctcccagagcgttgggattacaggcgtgagccactgtgcccagccagaaaattttttttaggtattaattttcttgacacatctgaatgctaaataacgacaagaccaaggctagtcaaaggctggtcaaaagctttcctctgcagcaccataactgtttagaaatgccaaatgaccagtggttttccaatagtgtaagcaactatctctcaaaaacaatcacgtaacacaaaacacataatatgcatgcactctaaatattatatgctatgtatattataatgtattatacatacatataaacatacactatacataaacattagaaacttataccaagttgtactcatgactgtttttttctttcccagtaatccttcctaaggattatgtcaccatcttatttttccctgttaattggttggatgatttctgttgtaaaacatttcttttaaataaaatgaaatggtgatatcatgtattattgtaatttaaaaagcagttggtatcttttccctcaaacttgtatcttcacaatttgtaaggctattattaattttgtcatattgtggtaagggaagggtaacattccatgcaggtaagaaacaaatctgaaatttactaaagataaaaaaaaattccctggtaaagaaacacaattttaaaatacactgtaaggtacatattaacgatcttcactaagatagtgaaaaaaagctttaagtctacctttttaaaggattttgtaggttaatattttccctttctttctttctatgtgtcagacttctagcttttcccctaaaatatgttcattacaggctaacagcctaattttaaatattaacagatactcttgatatgtttgaattgccccttttgataatggcatggcttaagaggtcctaatgaaaaatgttaatgtacagataatttgtggaataattttttattaaatattataacaattattttttctttttctatgtcatttttgtaatgatcacttttaatggttgcatggttttccatcctattgttatgccatga

SEQ ID NO: 106339 - DNA, 1023 bp, Homo sapiens
tattttgtatttttagtagagacggggtttcaccgtgttagccaggatggtctcgatctccttacctcgtgatctgcccgcctcggcctcccaaagttctggggttacaggcgtgagccaccacgcccggccggttccctttctttcaagatctctttgccacaaatgcttacagagaaatgcctcttcatgtttcctctcagctagaacacggactcccaaggactcttggcactctgagggcccatgcaacagggaccctgaagtttaagcttcatcagcatcatgtcagttcttctctgtctctttgaatatgctgctgaatcagtgagaatataactggttagatggcatctggaaagctggagaagacgtttagttggaattagctgtgaaattgagtttcaggttaacctcgaggtggatattgcaaattcttaagtgaattgggagaataaaaaaagctttataaagtataaagctttaaaaatggttatcaaaaagtagaataattccaggatacataacttctctgcataagttgttgcagtgaaagattcattagaaaaatgtaacaataaaaagaagaggtattgatgttttccagaaagctgtatttcttgaggtgtttaattttttgtgtgtctcacacagcaagtttcctggtggcagaacaacatctagccttgacatgtggtgtaaatctttatgctctcttcagaataaaatgattgcagcacttttctactatcagtggggcatgaattgctgatatgttatttgatggatccaagcatatcagttgtctttgtcaccaagagcctcaatggctcaaactctggagatagttattcaaggaagagtttcagtacttggccatgggatgccccacaacccagagaaacctgaaacccacgtcagcctttcgattctgtatgttcatcagttatctatttacttattgccactttgttgaatgctctgagatactgatgtttgtcaattacgatttgcttatgcaaa

SEQ ID NO: 106340 - DNA, 1049 bp, Homo sapiens
tcttgtctagctttaaataaaagcagggcaattaaatcaattaatactttgcttggtacttttttgtgactgaatcaacttattttttgaggtagcatcagttttattcagacagctgcacaaacataacctcggtatttagtcttggaagacatgcaaaatacatttcaagtctgtgcttcctaaacacaaaactggagaagagagactgagttggaacccccatggtcttcacatttctcattcatggaaactgaaaacaaaactaggtctaacctaactattattgaatttatcgttgagagggaagaaaggaaaatctgcttagcatattatcttctgacttcctgtaaagtgaaataaacctaatcagtactggtgtttctaaaaacatatcaattgtttacattttaaacgcaattgttaatgagctgttattatgaaagttcaccacattgctctaaatcacttgctgagccagccatcagaggcttacatcccagcaaacattttctggaatttgcagggcacaattatgattgactacagatctcctcacactttcattacaagaattaatgtagtgaattgctatataaattgatgccgtgagggaaaggcacgctaagaggttttaacaagactgtcagtagctcaatagtttgtaaagtcaaacttctcagtgttttcagagtgcccaccctctttctcagtgtatcttttcttcttggtctagttagcaaactgaaagggagagaatggttgttttatgtcaattttctgtagaagcataacatgctataggatttgtatacttgtaaatccaagttgtacatcttgatgaattttcccaaagtcatcatgcctaaggaaccagcatctagaataagaggtagaacatgacactctgatgccatcttccactcactaccatgcttgcttccactgaggctgtcactatcttgactcatctgcgattggttttaccatgtttttgaatttgtgtgtgtttttgggtggttttttttttttttttttttttttttgag

SEQ ID NO: 106341 - DNA, 1208 bp, Homo sapiens
tgttttctatcctaataagagaatttaattgatcaaggtggggagagcatttctgaaatcctcttcagagatggccacctgcccatcaggactgtgattcacccatgttacccatgactcataccacaccaagctttctctttcagttaatggttacacttcagagaaagttatttccccttcagagtatccgatttcacatgactatggagcatgtagccccaggatcctttctcattaaatgcttatgttggcatggactaattctggttagagtatttaaaccagacttggtatgtccagtagccagaaagaatagtaacagtcatctaaccatacacttatagaacagaaatgtaatagaataaatagaatatttatttcatgtatgaaaaataatactagaatctattcctgaaccattttttctaagggataggaaaaattgtcaaaacaaagagagatttttctccaagaatagtaattaggctaggaaagagacatgttactgcaattataagtgggccctatgtggcaagattcaggggcttgctagcattagacgacttggactacatggtagatttttttggtctttgggtctgtctttaggcagagccaggagagggaacccagggaatatcagagcagcctgtgatgctggaattaaatgaaacttgttagtattctggacatgacaggccaggtgacatcctgggctctcttcagccctgtgattctggatgactgtttttttccccaccagttccataatatatttgtttgtgtgcttccttcaagtaccagaaggaacacccattcttagaggtctgttgtattgtcttttcctaaatacagtggagggatattactacacaaagttaatttttcatccttcttgtagatacaaatattgatgttttcacagtatatatttgtatatttatttgctatagcctcttgattgttgataatcaagagacaggaaaaatataatgttactattattgccattattggtcattacttggctgggattttatccagtttgggagctaaattcttctttccgttgacaaagaacaattaattgacttcagataatttaggcttctcatgtccccaatatgtgatttgtcaagctaagaatattactttaacttcattatgtttactttccttgtatttggtatgagtgagggaaaata

SEQ ID NO: 106342 - DNA, 1723 bp, Homo sapiens
tttaaagtctctgccaggatccatgctcacatgttacttcctgtatggaggcatggccagtttccagccccgcgctcttcgttccttcccagcctgcgccggagccacaactttcaggagcatggactgaaggcgccctcgccccagcgcccctctgagatcctttgtgttttcctccgtttcctccggccgtttctattttggggggctctccgctccccctgcctctcccctccccttcccctctcgcaaacatgcctccttccttcccggggccctggaaggagctgcctgcctgaagcccggagacgccgcgccgcgctcagccccgccgccgcccgccggctctcgggctgtgctgcgctgccgactcaagttggggatcctcggctgctcgccgccgccgcccgcggtccctgcctgccccaggcccggggcatcgccgccggccgccgactccgcgccctgcccgatcggctctctcctttttaaacggaaagcagcctttctccgccgagaggatcgtccccagcgtggctctgcgttcccggtcactttttgagattttccggggggcgctcggcggcttcccggattccaaggggactcgggccgccgagcgcggggggcccgtggagcgggcgagccggggaagcgccccggcttagcggaggctcgcacggaggcaagaacttattcaacaagtttacctccctgctttcctcttttcgatgtgcgttttcggacatgcggaggttactggaaccgtgttggtggattttgttcctgaaaatcaccagttccgtgctccattatgtcgtgtgcttccccggtgagtgccggccgccgaggggatgcggccccggccggcgcgcgttggggatgcggagttgtcgcctgggcgcggagctccggcgcccgtccgggagaccctggagagggtggagggtggcccggcgcccggataggagaaaaggattgctccgctggcttggatgatgtttagggaggcaggctagtggtcgaggaaggtggaggcaggggctggccggggagggggctgggggacgcgggggtctgctcccgctcccttttgggggtcctggggagctggaatcgggagaaagggggacttgctttgctgactcgtcgccgatcgggagaactcgagttgtggggcggttggggagactgaggccatggaaaggatgcttctgtgggtttggggggcccgggatgagccccctcgctctggcgggtattgaaggaactcagaaggtgggggtttgctttgctgttctccatccctttgggagggctaggtttcggggaatggaagtcggaggctggctgcggaggactgaggatgtgtggggagcagcctgcgttctgggtcgggggcgtcctccctctctctgggggctggggcgcgggcagcacttcggtgccggcgtgaggcagcctccttgggcgcagtgagacggcagggcgcaggcggtttcggagagatccgtgtctcccctagccccggcccgtggccctttccctccgctgctctgctcgattggattgcctgggtctggacgcggggagggggcgggggcggtttcggcggccggggcggtttcggcggccgggttgctgttcgcgccggggctgatttttttcctgtctcgcgcgccctgcctaccttcatctttgcccttttgcaggctgttcgcgg

SEQ ID NO: 106343 - DNA, 1057 bp, Homo sapiens
cccctcctctctcccctggggagggcagaggccagctgcctccctctcctctcttgcaggtcccccgggcagcagccccgagctccctcgtagctgtcccttggggtggaggccaagtcctgccctagcccggggaagggctggaagaaggggtgatttgcttttcatccctcgctcccctaaggacagagaattccccgtttttctgccctctcatccatcaactcctgcatacccggaggtggaggttatctgaatcaagaaaaagaggaatgtgccccgaggtctccgctctgcctggttacagacgcctgtcctcgggcggctggagcgcccgtttttggtgcagcgggtcccttagtcccgtcgtgcgacccggagcagggcgcgcgggagccctcgtcgcccttggggatcccctcgggggactggcagcgaatgccccctttgcagaatcggggatggcctcgaggggcagaaagggaaaacaccgtctggtattctgcacccccttttctctctgcgcatcctcctgcccgcggagcggcacggagctccagcccagaaacgcagctcggaggccgagctaggacgtgcgtccacactcaccctggggtttgcccactggagtcctgcctctacggtaggacactggggcctggggtttgcccactggagtcctgcctctacggcctctacggtagtgtaggccatggggacatctccccttagaaacagctgccttcattcactaaaagatcactgctcagtatttgggttaatcatctctcctttctagtctcccctgctttaccacggacttgacgactgagcgggctcaggtgcacacaggggttgagctttgtgagggccactctttaatgggtgcagtgggaggtcgtggagggctgccttgcaaattagaggaatttccaattccacttctgtccttcttgcgctcggggatgcagtcagtgggctgaccgtggttttcttttccctggtgtgtgaggaagcttgagatccaaaatgggactgccagggaaccagccttcgt

SEQ ID NO: 106344 - DNA, 3050 bp, Homo sapiens
ttgccgcgacgccgctggacctcagggggcgcccccgagccactggtggggctcctgccacctccacactggtcggcctcggccacctccacgcctcagggatggggcgcgcgtgcccgggttcccaggctctggggctgcagacgcgccttggcgcgaggcggcggcctcggcctggcgatgctgctcctggctttctcgaaacccgctgggggctggagttagccttgggacccctacttcttgcctgctatgacctcgaaagcgcttatctgtttgacatgagggataaaaatgcttctgttttggagtagggtcgtccttgtgaggtcttagccaaaatccctttttatttagtatttttgtgtttcctctcagaatcataactcagcataactcttcagttgcatttgagttctcagctcctgttcaggatatgggttagctgtagtttgggcagggttttggaaacacagccctggcatgagctttttcccagtggattggaaacagtggattttagtctttgaacagcagtgtggcaggtttgggatccattcagggttaataatgcttcaagtgatgctttccaagtgcaaagctaagagtgttaccaaacatgatattaggcatattacattgctatatacatctttataaagcactgtagaaacgtttacaaaaatagcaaaatataatggatcccccacccaacttcaacactcacaactcaatcttctctcatctcttcctccccaacaccttattattttaaagcaaatcctacacatagttcattcaaactctgatacatatctccaatcactgggaatttaattgcctctgacacagtataaaatatgttacttcagagtgttaaccttttatctagtttacattctcaagctcagcagattttttttttaattgatttttgtctttcggccctcagagtgaaactctggttttgatatgttttgtattgtaattacattatatctaggatgctgccattggaaacagttcagatggataagctcagctgtgtaccttggatgtgtcagaattggaggctccatgattaatgtcgggtgaatcatgaatctccctctaagctgtctcttattttatttgcatgtgcgggctttagttctgatgggcatccgttatggccttaggaaaaggcaaaagtaatatttggaaatcagcaatctttctctttacagggtgtgagattgtacaggttttttttccctctccctcatgtatcatgtttgaaaatgaagaatctttacccagtctctaaactgggttcctttgacacagttatggaataaaatctttgatgtttccttctaaacagtgttcacatttgagggttgatggacttaaaacactaataaagataggcataaacagggccttttggaaataggggaagttgctgttgttgctgaaagaagaaaggtcataggaagggttggctgatgtgggaaaagtgactattccatagtgaagctttgagtatctcccattaattatggacctgttttcactgaataaaagattatgttgttgtttacatgaagcgatccagcgaatgctgatgatttaatgcagcaaaacaaacagccctttcagatttgcctttctattctaaacagctcccaagttaacagagtagaatcagttatacacctgtgtgctgattgaaagtaacttccttggcattcacgtgagatcacttaaaatgccctagagtagttactcaggagcctctcctactcccttgtctccctgccttttcctggagacttcttttctttttttgagatggagtctcactctgtcacccaggctggagtgcagtagtgagatcctagctcattgcaacctctacttcccaggttcaagcgattctcctgcctcagcctcctgagtagctgagtctacaggcacgtgccactatgcctagctaatttttgtaattttgtggagacggagtgccgccatgttggccagggtggtcttgaactcctgacctcaggtgctctgcccacctcggcctcccagagtgctgggattacattgctactgggctgttgctttaacactttgcttttacagtgacacgttgtttgttctttttaaatcttgatttccattcagcatgtgggacaatgaaatgccatttctaggcaggttgaagattgcaatatgcgtacattctgaattaagagatttaaacaattgtagttaatactgtcatcctgggttacatttcatgtggtcacattccataacccggagcttatgggaaaaatttagggcatctgaagttccctctaaagcacttggtgcccagaaattagcccttggtttgctttggttcagagttgacctctgttagatgttgggtggtggtcactgaaactgttttcggctgtatcctgtttagagaataaaagggctgttttattaatattatagaagccaaggagtacactgctccccacctttaattttccacctgagcttgatctaggttaagcagccactgacgaggtagagggagtggctcaggagggactcaggaggggctgagaagagcctgctctgtgagggcttcttgtgggatttggcaatagtcactgaatttgtcccagaatgaggttgcctgtgcaaatgattaaaagataaaactgggcactgtggctcactcctataatcacagtgctttgggaggcgggagggtcacttgagcccagaagttcgagaccagccagggcaacatagggagaccctgcctctacagataataaaagaaaaattagctgggtgcactcttttgtccccactacttgggaggccaagatgggaggattgcttgagcccacgaggttgaggccgcagtgtactgtgatcatgccactgcactccagcttgagtgacacagtgagaccctgtctcaaaaaaaaaaaaaaaaaattaaaagatcaaatgtaggctgggcatggtggctcatgcctgtcatctcagcactttgggag

SEQ ID NO: 106345 - DNA, 2815 bp, Homo sapiens
aaaaagagttatcggacttggctttgacttatttttggtattgtgtttatgtggagttgtaaccaacaaaatcaataaaaaggataagtatattccagaaacctgtatttacgtctccttgcttttccctacaatttgcctgttgcaaatttctaagaacatgggattgttaatgtctctttaaaagatgtcttaaagtaatacaggtaaatttcactgtcaggaaagtctgtgatgattgagatgtagaacagataaatttgtggttaactcagtatgaaaaggattgttaggtataagtgatggctgtgcaagattgctttaagtagctagagggcttcttgagtgattgtccccttctattgggacaactataattggagggaccatttcacctggtatcatttgtggcaagatatttggtgttttgacagaaaaatatattctgtgtgagatagcttgctggatctatgcaggcctaaggtttttatgattgcagcccttaatacaactgtaaaaaaaattttttttttggcctggcatggtggctcatgcctgtaattccagcattttgggaggcccaggcggacggaacatgaggtcaagagattgagaccatcctggccaatatagtgaaaccctgtctcttctaaaaatacaaaaattagctgggcatggtggtgcacacctgtagtcccagctactcgggaggctgaggcgggagaattgcttgaacccaggaggcagaggttgcagtgagttgagattgcaccactgcactgcagcctgtgcgacagagcaagactccgtctcaaaaaaaaaaaaaaagattcgttttaagtgcttccagggataggaagaggaatgacagctgatgaggtttctatatgtgcctggtttctgttttggaagcctcccaaacggaattgggtagtgtttcacttgtacttgtggtgggtgtggggatggaggtaacttacacattgaatgaaaacttcatgtgtcagccagttgatgagagttgccatactattttgtcagcatgtagcaggaagaaaaatcttttaggagcctggaacttgttaatgcttttctatttgttttctaaactaggtggctattgagagttatacagaacatagcaaaataggtaagaatatggcctctggagccagcctacctgtgccattgctagccgtgctaccttagaaaagttacataccctctctgtgcctcattatttttttcttcctctgtgaaatggggtggtgatagaagcctaactcctaaagtctttgtgaggcttgaatgagaatgtatataaggacttagtgctgtgcatggtaaacagtaagtgctcaataaccatttttttaaatcaaaagttttatatgtttatttttatagagaccgggtctctccctgtgttgcccaggctggtcttaaactcctgacctcaagtgatcctcctacctcaacttcccaaagtgctaggattacaggcctgagccattgctcctggccaccgtttttaagtgttcttaagagatttggataggagtgtatggaaagcggacggtggaactgaaaaggacaactgtatgtatagacaactttttgaaaaattgtataaacatacgtgatgggtttttgtatctgtctttgctgttgagggtgaggaggagtagggatcagcatggggacattctatgtaagattactaacaggttacattttgaggtttaaataaatgagaaagtcctcatgaagtctgagatatcaccttgcccacattgcaaaggaggtctctgctttctcagcttaaagtgggaaaaatgctttctgtgggcttaaaatgtgtctcataagtcttccaaatccctgtgtagaaagagtcgcctagtcctgcaccctcagatgttaattcctcttctcaggctttatggacagtgtggtaatggagggaaataggttactcattactgggattcaatttggctccactgatgggaagcaaacagtagttgggtgtttgcttttattttacacttgtgtgacacttgaacacattgatgtcctgtctctatatgttcatggattcagagctacagagcatatgagagagaaccaaacactgatgcacacctcgtaccctctaatcttttcttttttttttttgcagactgaaatcagcatgatatttttctggccaaacaacaaaatgtgattttaaactactcagtttagctatttttggggagtagcaaagtgacacagttggctgctgaattctagcaactaaaaaagaaaaaaatgaaagcatagttcatggaatatgtaacacttccatgtaagaaaataggacaactggtcttatttttgggtctgtgatactgtctttctaagtgagtgaagcagggtgttgtataatgcagtggatatacttttgaggaattcatactagttacaatatacatctaagaggtatttgagttttcatagcattgctgcctcatgaatcctgcagtgcacttaaatcagatctgttcattaattgggaatgatttggataaggggacacagccataagcaattgaccaagcataaaagcatagtccagattagtgaggaaatattactgactttttaaggttgtctcgagaactttttaagaattgtcaaaaggatttatttacaaagcggtggttatttataaatgagttctacctgtttttaaaatgacacttttccagaagcgtttctcttcagtaagtgtggaggcttagctctgtctgtgggtagctaagggtggtta

SEQ ID NO: 106346 - DNA, 1031 bp, Homo sapiens
atttgctttttgaagagagtatggaaactatttttcctaattgcacaggagggccaattgaaagatctagctttttatgtatttcaccctgttacttttcccatataagcaagtgccatgaacactgggtggaataaaggtgtcttcctgtacttgctacaattaaataagtaagtaatgcaattagtataggattttatttggttacgttgaagagatgacctttcagcaaattactttagcttctgaataagctgataataactgtggatagagtctgaatttgttggtggtgagtttttttttgacactactcctcttccaaattacctaaattgatttgctttgtaatttgagaacttttgtttggggctttgaatatggttactttgtagtaatgcggtatttttactgtcccatgtatatcatctaagtgtgggcagcaggctctgaatcataacttcaggaaaggtctgagggtgttgtgtttggcaagaaatggcttggattctgcatttttcctctggagtttggaactagccatgggagccagccaaaccagctgtgggatcttgggcaagaccctcaatttctttcgggttgtttgcctcacccttcactaaatggcttctaaaatttttttctggaattttagagattgttgattccaggctaggcagtttggaagggttatggtctttttgcagtatgcaagtcagatgcccaggacacactgtgatttgtgaggtgcacttgttgactttttcctgtgagggtttgcttcctaaggcgttgagaacccttccattatcttgctaaccttgctacggattatcctgagggagtagcagacaaggtggtgagtggaacttggttaatggaatgcctataagctatgtttttgtttgtttgtttgttttttaaacatgaaaccttatttcttctggagaccaagttaaaaaaaatatggagatttgctcatgtcaacaaagttatgtgtatagcgtttaaaactatctaatgtgatttat

SEQ ID NO: 106347 - DNA, 4285 bp, Homo sapiens
tgagggctgacagaatgagtagataatgctcttcaaatgattataggatgttttagaagacattgatgtcactgtatgtagtttcaagatatctcatgtttgtatattgtgtcttaagagatacactatccaaggttaatatcttccttaagagaattctgagtatatatattgtcatggtggttgaagtttatctttaaaaagagaagctaaattcgtaccttctgttggctgctaaggtatctgttgctgagaacgggattccattctaattagaggacaaatgtctataggacagcagggttatgttttgatggttgcaatggtagtaaaccttttttttttttcctctcttgtggaataatttaagctaaattctgtgaatctggtggtcattgtatcaaaagtggccttggctcttaggtgattcaggagaaggtagccctcttattagtgctttgttccagaaacagtgaatgaggtatgcagagagcagcagagcttgcctcagctgacagtagagcgcaaaaatgaatgccattgcccagtaatggctttgtgcaggttggactaggagaagggcttgcctgagctgatcatttttgcttggttgacaagtactagttggtcaccagatctactgcccttgatgagacagatgttggctggtgcatcatggtgattctaatgtgcacaggcagaagctaagttttctagaacacattgctagtcaatgcctgccctgttttatccctcttcccaccagttgttttctcttctaaaactagtcattttctcttatttacatgtgtgtaaaggttacgagtggagggtgcagaaaatctcttgacagttttaggcactagcttctcattttcccagtcagtcaatttgggcagaagctgctgaaattatttcatgtgatagaggtttgcatgctagaggtcttagtccattttatgttgctgtaacattatctgagactgggtagtttataaagaaaagaggtttatttagcttacagttttacaggctgggaagttcgagggcacggccctggtgtctggtgagggcttttgtgctgcatcataacatggtggagaaggtggaaggggaagtggacatgtgcaaagagaggcaaaacccaagtgatgccctggcttcgtaacaaccccgctcaagggaactaatccattcccacgagaagtgactcgggcttgccagaatgagaactcagtcactgcctcgagaatggcaccaagccattcgtgagggacccaccctcatgactcagacaacttccactaggctccacttcccagcaccaccatgttgaggatcaaatttcaacaagatttggtgaggacagaccgaaaccatagcagcgcataactttagcgttagagttctttctgaacatattttaggatgtggtttttagaagaacacgtcagttgctagtgaagtttcttaactgaaatgagggagttgctggttcttgaaatttctgctgctccttatgatgcgaagtggaggtaaaattgatttctggggagtctaggggaaatgtaagcactctgaccacataaacaaaggattttgtgaaaataaatcttatatgccttggaacctttaaatggggttgagggaatgagacttgaagacaagtggattctgatgaaagaggccagtggcaaatgtgtatttaaaaaaaaatgcatttttttgcaggtaccagagtgaatcctagctttgtcctttgctaactttggccagttacttaactttattggttttcttacctttaaaatggggataatgagaatttcaaccttcttgagtccttgtgaatattaaatgagatgtgtgtgcaaagcaccagaaaagcattaggcacacagaactttttttttttttttttttttgagatggagtctcgctttgtcacccagactgttcagtggcgcactttcggctcgctgaaacctctgcctcccgggttcaagcagttctccctgcctcagcctcctgagtagctggaattacaggcgcatgccaccacgcccggctaatttttatattttacatagagatgaggtttcaccatgttggcaccatgttggccaggctggtctcgaactcctgaactcaggtgatgtgccttcatcggccttccaaagtgctggagctgatattatagacatgagccactgtgcccggctggcacacaaaattttataaatggtacctgtttttaatagccagtgtttaagattcatgaaacaaaagtgtgcctaaacacgctctcaacgaatgctatgccactgttgtgaagacatgggagagagctggagctgtgacagcagagatcccacagcgaataaagtggcagaaccagaatctgaactggcttttggctgttgtcatgctttcttctgtgcagagcaggagtgtgatgaattaaggctcacagggctaccaggaagaggttttttgtttgtttgtttgtttttttgacagaggtttagcaaagatggcttttaggatttaatttgtcctatatctcccaccttgaagaaaaaggttcatagctactcttcatattctcattgctgaaattatcagcacgagtagggtacacatgccttgctgtatatctttgtgttaatatggggccagtcacaccccctaggtgcatataaacagggacattcagtgaaagtgaacagcatatgtcttcttcctgtccctgtgtgttattttgcagtttttctacagaggaattggaggttggcatttgagccaatggtccccattcccatagctgtggtagatgttgctaattgatcacagagctttttgctactgaagcctgaacgaggtcttagaatcattttcaatagttggtctgggagaggacttttgtgccatctctgtgcctataataaggcagattaaccaaccttcgaaaatagcatgagaaagagaggtgtatccaagtggctactgtattcttggaaataggtgtgctgctacatgggcaatttttaaggtttgcttgtccataaaattgatttgaacttatatttgactcacatttgtttattcagaaaaaaaaatccagtctcttgatggtggttacatcatattttaattggtaagatccactaatggaggtatagggatctaaattcacttgcttatttttccttcaaagcccaggggttttgcatcagattatggcgcttgtaggagtgtttatattccgaagtgacacctttctgaattcttagctatttaagtaagtgttaagaatgggcttggtgacagcagtttttaaaactgtgattgacttattggatcttttccctctgttgtttatacctgacagagtatcttatgtttgttctgaataagttgattgttacctttagggtagcttgtttctcaaaatttgagtggtcctctgatcagtgttatttttgataaggaaattgaagagtaggcatgaaaggtgaaaggaattcatttgcaaagctgacatcagataaattttaggtgcttggtaacataccaagtactcggatgacatcaggtaatcccgtatttgtttcctgtatatgagtttttccacctcaagattccttttgatgttgagcctttgcttaatgaatgtgaaatgtctatagagctctctgttcaatatggtagccaccagccacctgtggctagtaaacacttcaagtatggcatgtctaaattgagatgtgcttcaagtgtaaaatatacaccagatttcaaagacaaatgaaaaaagaatgtgaaatatctcattaaaacttttcattgactgcctattaaaatgatattttagatatattaagtagaaaatgccattgaaattactgtcacttgtttccttttactgtttcatgtgactaccataaaattttaaattacacatgtggctcgcatttgtagctcgcattgtatttttatcggacggcactggtctagagagctctttccaaccttttctcaccttccagaagagcatttcacagctgtaatcccctgtgtgacattgattacctgttttctcttccctaccccttcaaaatgtagggctaagagaaactcttgtaattgatggagaaggttgtctcctagaagatactgcctctgggatattccgggtatgttaggatagcaggttagggtcatttagctttgtgtgcctgtttacccatctgtgaaatgggtttaacagtccctgctctgtgag

SEQ ID NO: 106348 - DNA, 1067 bp, Homo sapiens
ttctccctagaattggcatcttgagccacgtgacatgaagacatcctcatctttctcaattcctgctccctgaagctcagagccactctgatccttgccctttcaaagctggattgtttggttcttggttggtgtctctgagatgtccaaggttctctcaatacattcttttaatgcctacgttaaccaagggttgatttgggtcattttcaatcaaagggcaccaatatcagctggaagtacacagaaggatagataactagatgtgttgagaaggacaggaaccttctcccctgcctgccaaaaataatcctttaatagtggtttcatttctttgtttggtttttcgagttcattcattttgagctttttatcttcgggaatctgaggacttttattttggtgctagggacagcctctctggaggagacatgctgataacacttagccttaactgcttctcttgattttatttgtaaattagaatcctaaggatctgtaaggaaatgagtaaaacttaattgtacaacatttagagcctgaattaaaaataataataaaaagagtctataatggtaagaggccctggaggatgagatgaatgctgagctgtgtgtctgggcatgtattttgtccacacctaatcctttctgtcatgttttaactactccttagagtggaggtcagcagtgtctgattacctccagagttcctctctcttatcgtatcttgtccctcgctccatttccttttctggcattattggacagcaagtgttacaacttaaaatcaatacgaagcaatttcatttgtttataactatgaagatgagcgcttccagcagagcactgtactttcaagtaaagtttaggtttttttttttttttctactttttctgtctggtgcccaaaatgcattaatttttcattgtacgagtttgcttatgttatcccgctttgatctaaggccttgttaccatcatcatctctttaaaactgggattgttggcatctgaatcatttttgtgttttgtaggtccttagtaatcacagctccattgagtttg

SEQ ID NO: 106349 - DNA, 1341 bp, Homo sapiens
atagccattgggtgggttgttgattcattctaaaaaacaatattagaggctggtgtggtggctcccacctaaatcccagcactttgggaggctgaggagggcggattgcttgagctcaggtgttggacaccagcctgggcaacatggcaaaaccctgtctctacaaaaaaagtacaaaaattagccaggtgtggttccgtgtgcctatagtcccagctacttgggaggctgaggtgggaggatggcttcagcccaggaggcaaaggttgcagggagctgagatggtgccaccacactccagcctgggcaacagagccagaccgtgtctcaaaagaaaacaatattaggacaatattgcaaatattaaaacatcttttattcagcatgcagtttgattcttaggagatgaatgatgaagatccaagttctgttttggtcagtggcacaaaattcttgaagaaaccttcttttctctcaaacctgtttcatttgttggggacctactgtgtgccaggtgctgctgcctaccttggggaaccgtctagttggtaatcacagtggaatatgaaaagacactgattgggctattggattataacatgaatttttagtgaagcctctggacggttgagacaaaggaaattattaatgcattttgttttctgctttttcttttttattttttgccttgttttgctagtatggattttgatttaattgctactttaattgctttcattgggtgatagattcctctgattgagtagaccttttccatccccaaatatctaggagttgaaacttaaggtcaggaaggacaagttcttcagtgggaaataaaaaaaaaaaaggtggttgtcttggcagcggaagcttgctaattacactgccagttgtagtatctatttatgatggaggcactggggacccaattagcaggtcattttcatgtaaaagtttgggattggactctcgtgtatgaagatgatatggcaaccagtgagcaccttcccagtgcaggggaattgaaggtggttttagatctcattgccttggatctccacaggtcactgataggaaactaaagcttgactgttccttctgttcgtttgcaccaccagtttctaaagttatcttgtctgcagggccaacattactgaaaagttgctacttttgagagcctgacttcctgggaaggaactggtcatagtgatgagaccaatagggttgtgagaatttgcaaactggaaacatagggatgggaaaggcagtgggaccaggagggcattgacacatcccttcggtctggatgtcccatttgtttcggggctgcctcccaga

SEQ ID NO: 106350 - DNA, 1244 bp, Homo sapiens
attccttaaaaacaagctgtgtatacagttctccttttcttagctaaacaaaatgaactgggtttcaaaaattggagatgaatgaggttcttataataatcagttgcatttacttatcagctcttgttcctgttctcttcatttcctttcagattgaggcatttttaatgaggagagaagttagaaaagggggtcaggaaaactggaaaaaaaaaaaaaaagaagaaaaagccagaaaaactcttctgctgagctctgtagctgttctcagttctttaaagtgcttgaaaagtaatattttgttgctactaaatctaattaatagctagctggtactcatcaagacctcatttctttcaaccttgaaggcaattggaaagatacacagatctgtgtattatcacagcaaacgaattctcttttttccttaatcacttagagcttggtaaagcaatgtaggcagcagacggacagctgtgttttaaaaaataaaacgcatctcaggatgttcactgtggctcgtaatgaatgtgtattgatttttagaattactttttgaaaaaaatagaattttgaaagcagaatctaaactgtatactaggcatggttcttaacagaatagcctacctgttcctgaatgtttggattgagtgaataagtatttggaagcctgtcctctgcccagcacggactaatcagaatgctgtgggccaaaatgggtttaaacacaaagagaggatgaaaatactcctccgggaggagggcgccgggtggattacaatgcagagccctgcatctctgcctgtgtagggtgcagctgtgggctgttagttacatgggcatttcttccattctgagtggaccaagtgtgaattgacttggtgcctgaggtgcagataggctcaaggaaagtaggtcaggcctgaattgtggctgttagacgttgggagtgcaagcagaagagaagacagtgattacaaatactgcctatttagaggacaagagcaacttcggagagttggaggagcaccccccatctgcataccacctcctccatccaatcagttatttctgcggaagcacacccaggactgatgatgttttgtgtgttgttaggtagactgttactcatttggcagatatttattaggtgtgtactttgtgccaggtcctttgtttgaacctcaaacctgccttgggttggttgtgccagtggcgccgacatccatcactactttgcatgt

SEQ ID NO: 106351 - DNA, 1057 bp, Homo sapiens
tcagcatcctcacggtgggaccagtcaagtgtccagctacctcacacacgtgggcttctaattttctctgtgggtcacactaaatagtccattgttcatcaaggagagaggaaattgatttcaaattacgcctgtattggttaaaaactgaactgccatgaatgctttatgggatcagggagaagataggcccagggttttagctgcagtaaaacctgcttaattaaccagacactgtctattactatcttgacagtcagcaggaccccctcttcggcacaggggcttagttttgcagcccatgcttgcagggccaggcttggtttagacctataagggtggagggtttgggcttctcatctgttgtctacttccttccctgggtcactgcttgtgccggctggtgagaactgattgttacattttcaggaattttgagagccaattattaaacacagtcttttaaaacatagacttatgtaaacttacaattaaattacatttaagaagtgacaaatatctcaagctcaacacttcctaatgattttcctgcattttactctgatctgtgctccggaggttgtatctgtggtgtgtgtggtagtattactgtataatggtttgctactgcacatctttcctccttcacatttagtgatgttacttcattttggtgctttgaaatgggtcatcatgggaatatttataccatggaaatcagcaaacactataaatcagccaccctgctggaactggatggtaagtgtttaccaaaccaccactgacttggggcatcctctgagttccttagggctactgataaagtttggatgtttgtccctacccaacactcatgttgaattgtaattcagcatgctggaggtggggcctggtgggaggagtttggataataggggcggagcctttgtggtttggtgctgtctatgccatagtgagttcctatgagatctggtcatttaaaattgtgtggcatccctcacctacccccacttgcttctgctttgccttctgccatgattgaaagctccttgaggct

SEQ ID NO: 106352 - DNA, 1060 bp, Homo sapiens
agccaatttttttatttttttgttttttttatttttagaaagagtcttgctccgtcacctagactgaagtgcagtgctgtgatcatagcttactgctgccttgaactcctggcctcaagtgattctttcacctctgcctcccaagtagctgggactacgggcacacaccaccatgcttggctaagttttctagttttatgtttgtagagatggtgtcttgctacgttgcccaggctggtcttgaactcctggccttaagcaatcctcctgcctcacttctcaaagcagtgggactacagatgtgagtcaccacacccagcctgacttgtgaataaatatgaacagcttggctgccagaactagaaggctttggcatctcccactgccatgctgccttaaaagggcatgaggtcccacctctgtcttttccattttcctggttggtggcacccctcaccccatgtggtgtatccattttctattgctgtataacaaattaccataaactcagcaatctaaaacaacacacatttattatcttgcggtttccatgggtcatgagtctgggcattagctgggtcctctgctcaggctgaaattagggtgccagccagggctgtgatctcatcggaggctcattctctcccaggcttgctggttgttagcagaacgtagcgcttcatgtttgtaggactgaggcctcagctcctgaaggatgcctgcctttgcctgcgacgtggctgtctccacaatgtggatgtttgcttctccaaggccaacaaggtggtgggggtgcggggtgtcagggtgtctctgctatttgtagtctcttttaaaagactcacctgattaggtcaggcccacttagaataaattctcttcattaaattaaagtcagctgatcagggccattgatatacatctgcaatatccctaactcctgcggagctatatacagagcttatttctaaggagagaagttcttctggtgtcccaatgtcagtccatgtatgttgttataacaaaatatctgcaaccaggtaacttataaagaagagaa

SEQ ID NO: 106353 - DNA, 2643 bp, Homo sapiens
aacactgccctcaacatggtggaaggaagaaaggcagctttcctggaggcgctgtgggtcctcttttataagggccttaattttattcaccagggaggagccctcagggcctcatcacctcttaagggccctaactattattactatcacattggcaacacctggattttggagggcaggcactctaaccatagcaccagatatcatgccttactcttaatgatcaagatttgggtcacgttcagctggaccaataactgaacaggctcagatgacgtccccacctacgtgatagaagtgaggatgaaagcccccacttcagcctcagggaatagcattgtcttaggaaagaggactctctgccaagaggtgagagaaggagctttgggcaggtaaggataacacatgcccactttggaacttagagtgaccagcacatcctacacggatcaacttggttatcattctaggggtctagaattggtattctgtgtacctccttccttgacactgtagtggtatggacagccacctgtgaaataaagctgtgggtacagagcagtccctgttaggttttcattttggtgtgaatcctctgtctccttgacatgagtatcctttaaatacttagaatattgtcccgagaaaatgccatatgaattcagaaatcggatcaaactgtgttctttgggatccattaaaactgaaatgcctggggccaaaacacttaccagatgcatcaaacactactgtcagtctgagactgctcagccacatcgctaccgctctcatttcataggagttttctttcccacagaaaggcagctcgacaaactcttttaaaccttacttttttttggttttggtagtggtagagggaaggtctgagcaaagataacagagtggctacaaacttaattattaatctgactcttctctcctgcttctctttagaagtgacattctctgtggagaggccaggagggggaagttgtagcattcaggttttatcagtttgagggcccactttcttcagtgggtctctgtgatggctgaaacgggttgcaaataaataaatgccatgtgggctcaggaagctaaagtgaaagagtgaggtgcagagccacagcgaggggctggactgtggagaactggacgcgacttgcctcttctccaggcctggcggggttgggcttggggtgaggattaccctgttggaatttgagccagcattgttagatcattctaatatttccagagaaactagacatcttaaactttacctaattacttccaatttttatttttttttaatgaattcagcttttattactgcatgagggctgaaataattgtcttttggctagacttgtcctgtgggtggccagttttgatctctggtccgcaacttgccagggcagaaggcttatcggggatgctgtttgatgccttgtcagcatccatttctatcttccttcttcgtacagagcctcggttttgtacagatatctgtcctcctccataaagctgagcagctagggagaagctgagcagcaagggagaagctgagccactagggagaagcccagcagttgggtagaagccagaccctagctccaggttggctatatttggttcacagccatcattaaggattggttcaggagcaactatgtgatctcaccacgtgtgtaatggaattgggaggatgtgtgtgctgggcccttccgtggagagctgcatctttccttgaagcctgggaatctgtattctgtttgctgtgggtgctgccaggatgtgccacccacaactgcatgtggcagccatcctgctgccagcctgagggtacaaggttgaggagagctgacctggaagggaagggaagcacctggattcttgttcgacttctttgagctgctcaatcagctggctctggaagcctgcctttcctttggactcccatttgtgtgaaacaataaatgttttattgtttaaggcagcatgagtcggcctgggaagcagactaggagagggacctcagtccatttctagacttcatgaactattggtgataaaggatgctttccctgatgccaggctaagctgccactaattcagggctagatgatggaaggatttcatcgtctttacgctgagcccttgctattgtccctttaggggattatccaagataatactccatctgaggtctgggctcagtggggaagagcataatcacttacatctgccatgggggctcagcatgaggagtggcaggagtaccagtgtttgccctcgatgtgtgaggttgggtcagcctgaacatgatacggaagcctttggtctctagagagggttagatatagattgatactaaactatgaccttttccatttatgaaaattactcttcaggacgatataccttcatcaaggtataggaagttattggacttcccttaggccgtgtccccttatctgtaaaattgggctaaccatccctctataccttgctgtgtgggtcgaatgaagttatgtatgtaaagtgatgagcacagtgcctttctcattttaattttcatgttttcctgttccatttctacgtatcatcttggctaccaagtcagaaacctagaaagccttt

SEQ ID NO: 106354 - DNA, 1032 bp, Homo sapiens
tttcttatttctatcaatttacacagattattctttccaacttttttccaacaagttaacaattaaagacagcccttctattaataatgcagataacttttgattatatacaaattattttcacactttaaaatgtttttatttgtatctagtatggagaggcagtgaggcatgtgatgtaaggagtatgaactccgataccacactgcctgggtttgaatcccagcatggctacctagtggtaaatcacttaatcttgttgtgcctcagtttcctaatctgtaaaatgagagcaattatagtacaactttgtagggatgtgaggattaacagtttaatgcatttaatacatttaatgtgcttggaatagtgcctggcgcagtctaagtgctgtgtgttcacttctatgcatagtcaaaaataacagtaataaaatctgcagtactactactggctctatcatcagtctttgctaagagattttgcaagacccaaatcatttggtagatgtattgtcattgtctcttagattacaagtgatttactgctgaatataaaaaaattgcccaggcaggtaagcttaggaaaaggagcctccatggggcaaagatgctgggctatagccagcagtcttcgtagcagatggataaagagattatatcgtatgtttgcctacatagatttggctgtacttagggtgatagtaagaacaggaactgaatgttacttaagagctcaacactaatgcatatgcagcatttaataagacaaatattcctctgttaagtgaccattcctttcacaggtaggtagttattttcgtttcactcacttgagtattacttattctctcattgccttcctgcctccctgcctccctccctccctccctccctacctccctccctctctctctccatctctctttctctatctctctctttgtttttctttctttcttctcctgttgcccaggctggagtgcaattgcactatcttggctcactgcactgtctaccttctgggttcaag

SEQ ID NO: 106355 - DNA, 2591 bp, Homo sapiens
ctgttgcaatctgtgcagttgagaaggctctcatttaaagaggttctctggtgagcttcttggaatgcgaagcatctttctgtaacctttgtcgtgactctacaattccatccagttgagcaactgttctcttggatgacctttgcctaaagtgagatgcacatgtgcctccagttcagttgtaggtagttctcggcagtactgcatgtggcctgtttccagttagaaatgtcaacactgtgagcccaggtaggtgctgggcacgaattgcctgatggactctctgagaagctgttaacttctccactgcttttgaaaggatcttcacctttatgcattctctagcctattttgttcctctgtttttttcccccgtcttctctacattaaaggtgcattagtgtattctcagtgcaacactttagagttcttggaatgggcagagagcagttatgtcccataatggcaggataatcaatggaaagagatagattgccaggttgtaaatcatgtgagagaatttgatgatatcagcttcgggggaatgggatcctattactcgttctgaattctctggttcctggaattaatttgtgtgtgtgtgtgtgtgtgtgtgtgtgtgcgcacttgtaatcttttggtagaacagcctttgttgtgaaccagaggatgacaaaggacaggtcagcttgtctcaatctctccctccattccttgctgtctgtgctcaccttcgacgagaaatgctttccataaagccaccaatagcgcagcagagtggcttacgcttagactgtcagagtcaaaagaacatttatttctccatattcaagggaaatcacaccctttagactaggacactcaaaagcctagtagaatcctagcaaatgcatttgctggcaatagaaagcaaagggctttttctatttttaagaggaataaactgtgccttttactttctgacttaatgcagagagatgaaaatatgctaaaatcatgttttttttaaaggcatagaccagagacattttggaagcttttcatctagcaaagccagcgttcctttaagcaaagcatcaggattgcttcaatatttaggtattaatattcccttgtggctcaatcagctctttgaagatgaatttctcagcactgctgtcacaattaaagaaagacatgcaggggtgaaagggaatttgtgtgtttcttagattggaaggatgtgttgagtcaaatgaacattctctcaaggttaaattatctatttaaaacccacccaattacagtgccaggtacaatctttgatgagattcagggaaaacaaattaatctgtgtgggagagattctctttgtatgaaggcaagctatgaaatcagaatgaactgggcattgtttgttaagggggaaatggttatataaattgaagatggtgtagtctcaaaaaccatgatccattattaggttactgaagacctcctaatagaagagggtagaggtggtttattacagttgtgcttttgtattttgttgaaagaattgtgaggtgaccacaacacaaaaccatgagcaatatactgtgacctctgtgtgcggagactaatccaaggaatttagagtaatctcagggcatggctttctagaatgatcctcacatcctgttggtttcacctcccaaataaatcttgaatctccctgagcagtgctctctaaatttactgctattgacttggtgagctaccatcctccctgggttaaaatatggtggtagccctctaagtgatcttcctccttttagaaacatcttcctagtacagatgaaaaaatccaaactctcacccatgggcctgcctccgcctctcacctcttcgcctgttgttcctcactcactcactcactagctccagccttcatggctgggatggttcagcaggcctggctccattgtgcctccccatccttctgttagttgcttggggttgccacaatggcagagtaattaagtatagtctctggagtcaaactggtagattccaatcctggctgtgctactaaccaaccctatgaccttgagtgagttactaaaacctttctgtgtcccagtttcctcatctttaagttgggtataataataatttgactttaataatacctttttttttttttttttgagacaggatctttcccaggctggagtgcagtggcgtgatctcggctcactgcaacctctgcttctggggctcaagtgatcctgccacctcagcttcccaagtagttgggaccacaggtgtgcaccaccacgcccagctaatttttttggtgtattttatgagatggggttttagcatgctgctcaggctggtcttgaactcctggattcaagcaatccacccgctttggcctcccaaagtgctgggattacaggcgtgagccactgtgcccagcctactttaataatacttaataattctaattaggtttttgttgaggaatgaatgaattaaaatatagaaggaattttagaccactgctttgagctcagtagcactgtatagattgtggcacagttttgttataaaattagcatcctcat

SEQ ID NO: 106356 - DNA, 3108 bp, Homo sapiens
aggagactagtatttatttacttatttgtttgtttgtttgtttgagatggagtctcgctctgttcccaggctggagtgcagtggcacaatctcggctcactgcaacctccgccttctgggttcaagcaattctcccgcctcagcctcccaagtagctggaattatagtcatgtgccaccatgccaggctaatttttgtatctttagtagagatgggggtttcaccatgttggctaccttggtcttgaactcctgccctcaggtcatctgcccaccttggcctcccaaagtgctgggattacaggcgcgagccaccatgcccggctgagaatggtatttagaaaccaacatctgagcatatcttgggatattgcagcccccaggcccttttagtggacaaatctatgggttaagtatgtatgtccatgtccatatacacacattaacatctgtatgtctgttaacattcacaagttcaacaacacatgctttattttagttttctctttcatggatttgtgggactccttctgtgacaaggtgaaactgggctccgactgttttgaatatgtttatttactcagtccatcccactgtgtgttggaatactcttccgtgtagacacttctcaactccctcaaacaccaacctccacgccaagcccttctccctgccatatagacaccctcctcgtctcacttggttaccccttctggacagacggtactcttctgcagaataaggcatgtcttcctcctggtggagggcagccccatggcaaagtacttggcttggcaagcagggtgtgttggctagatttcattctctcaattgaccggacacctttgtgttaatacgcaactttatgtggcaaccctgaggactctgccccaccccagctctgcacccatcttgggactgaggcactgctgctgcaggggtgctgctctgttaaacctaggaacagaaagggtgttgttggtagttgactttccaccatcgatgccggaagataacagaaaactcagtaagaggggcataaagtaggtagacagagaagatagcaaaagaggactgctggagttttggtaaaaggattgtgtgcctgatcctggtttgtgtccgaggctagctgcatccctgcccttggtatttgagggacaatgttataaaagatttcactcttgaagttaagctaccaactgaaacaagtcacatggtcaagctccaagtcaagggacaggaattacactgtgtgggaggaactgcaaagttgcctgtagaaggacccggatacagacagggccaattacccagtctactatagagaggtcaacttgtttgccaagggctaacttgttaataagtggtagaatctaaatgaggtctgtccagccagggtgtgtcggtatttaatggctcttctactgcttctggataaaatagtcagggacttgttcggcatgtgggttgctcagggtgtacaggccatttataagggtgttcctttccttttgctttctcttgcctccttgtatgtaggaagtatactttcaagaagatagtgttaatcagatacagaacttccaagaaccagatggccttcatttctttcttcctgattagctatataaaaccaattgtccaactgagaaaggcttaattttacaggcttaccggggaggcaagcttattgtttacagctttcaacctccctcttgccttccttgccagaggctcggctccagcaagggaacctgaatctaacactgaagaattttggaagaagttggatttttacaaggagtcctcacacagtggatagatacgaaaacggtctctttacttctgtgagttaaaggtgtgcctgtgttgttcttagggcctgccttctatatcttctttgttgtgtcatattttaaatggcaaatgacattgactgacagtaagagcttgtatcgtatttttcagatagtatctgcattaatgtcctgtaggaaaacgtctgatagtgctgcagaccattttaaggaattgaaatctaaaaatttcactgaattataaatgtgcaggtacactatataactaattattaagcttacaaagcggccaggtggtacttggagaatcttagtatttagtgtggtggaagaactattcttgcatcagtggaaatattacactgaagccgtgtgcttttttatgcagagtaaagataatagtggctggaatacaggatcagccatgtgctatgtgaaagatggcaggcttaaaaaaatccatttgtatttctggcaaattgtcttaacataatccacatgcctttctaatttaaaatataaaaaattaaataaagtttatactgaagttatatccattaagaaactggtaaattagttaagtctcacaagcttagactccagcatgagaggggggtgtgtgtgcctgtgtgtgtgtcctgctcacatttgaattgtgaattcacattgcattcccttgcaaggatgtgccatttttaattaagactaaagcatggtggggtattctaaattgggcctgattataattgcagatggcaattgagcttttggaagctggtttctttaactgttaaataaaaattgtcttttttagtattggtttgcagaagtttagcagtggatgtcgaggggaaaaaaacggtaacctctttctttccttgaaactaaatgtcacagcatatccatcttctgttaaaggggtttagctctgaagaaatttttcttaaggcctttttaaacaattgatcagataaaaaattttggctcataaagctgaactttccagagactttctgttgatgagagtcaatacagtaaaaaatgacagtattcattgttattataaagagtacttttgaccatcacacttttagtgatcataattagtaccttaggctgggcttggtggctcgcgcctgtaatcccagcactttgggagcccaaggcaggaggaccatttaagcccaggagttcgagaccagcctgggcagcatagtgagatcctgtctcaaaaaaaaaaaaaaaaaaaaaaaagttaaaaactaccctggtgtgttggtgcgcatctg

SEQ ID NO: 106357 - DNA, 3783 bp, Homo sapiens
taaacaggtgctgatgaaagcatcttaataaaacacatcacacagttgtgttactccttcacgctgagctctgcctaatgaagattggctgtgtagagccactactgcttcattttgttgcattttgtatacacagttcagaaaattaagagacaagggaactagtattgagtagaataataaaaggactttcttgaatgatggcacttctgattttttttttccctgccctacgtgactggacgaataagggaggaagatgtcatggggcctctaaacagctgataacaacagggttcatttacattttgtagcttgtgtgtcccccctacttcaagcacatgcgtagggaattgaaattgcagtttgcctattacgtgttggcagtaatctttcaaaaaaaattttatgtttcaaaatcaggcagccaacagcagtagccagtgatatatggggctattgatgcggattgaatttgcagagggaaaatgggatttggttgccatatgaactcataatgaggtggcctcacagatttgtaatggtcaaccattatttgcacctggaatccgccaggaatcaaatacctttcaaggagagactgaaatgaaacttgagggttttttttgttcctcgtccggtgaatggagcagttccaaagtaatgtcatttggtttgtcagttgaagatgcttaaagttaacagttacttttttttttcttttttgaaatggagttaacgctcttgtcacccaggctggagtgcaatagtgcgattttggctcactgcaacctccgcctcccaggttcaagcagttctcctgcctcagcctcccgagtagctaggattacaagtgtgtgccaccatgcccagctagtttttgtgtttttactagagacagggtttcactatgttggccaggcaggtctggaactcctgacctctggtgatcctcccacctcagcctcccaacatgctgggattacaggcgtgagccaccgcgcccggccttacagttactcttttaataagcgtagtgtggatcagtggtcttcactgatcccattgccttatcagcaaaaaaaaatttggacccatgccccagtgtgtgtgtgtatatatatatatatatatgtgtgtgtgtgtgtgtgtgtgtgtgtatatttatttatctgttatgttcttatactaaaatcctatgaaaattataaaaccttaaaaatgtaaagcatgaggtcaaaactattctggatatagaaggctaaatattgtttcccacatcccctttgaattgtcttatgcacccctggatactcagtgctggaaatgaccagcaggaatcctgccttaggtgacgaggctggcactggagaatgttgggccgtccttccttccatcctgcagggatcttgctaaaataaatgacttaaccttgaaactttactgattacgtggtatgtgctatagatgggattggattaatactaaacatttcagcagcagttcttctccccaggtgtggggtgtaggcatgaaatagcttaagtcaactaaagctcacctcttatgttttacctggatactgtgctttagaagtttactttctgattcatctcagcaattttgtttttttcgcttcctccctctttctctctctgtcttccttaactccttcactctttctgttcttcctttattcgtgccaggggagattgggacacagtattttccaaatatatttatcctctcaggtcagttggagtttgtgggctaagagtatgagatttgaagttaggataattatagtatttggatgagtgaatgaatgaatcaatagatatgtcccttcatccaaactatgctggttaggtgattggtgggcaagctggtaagttcctctgattctctgttttcttatttgtgaagtggagatcgttgctaatgtatgtggttctctgtagaattaagtagagaacacgggaaatagccagcacatggtctggcattgtgtacatgcccatttaattttggggtaattattatctccacagtccctgtccttcttggaagtcctgaaagtatttcttgaaagtcatcactcaacttcagagcatcttagataccaaaataacagatggtacagtatttgcggggcatacatctttcacttaggtgttcttttactttccttttcccgcctaagttaactttctagagggaggaaaccaagtcttcactttattttgtggttgacttttcttgcctccctctccaacacctcgctcaacaggtaatcaaataactaatttttagttgtcaggtaaaaagacatttttgtgtttaagttcttcaaaccttagcttttggttgcatcagaagacttgctttgaaattgcacaaggtaaagaagggggagctggaaggatttcaggaaggagagtttgctatttgtaattagtgcctaacagaagttggtacatttctgtagttttccgttgtcagtcactttggatgataatttttttttttgctattatttttaagtgacagattgcagtacgtattttaggacctgccacccattttgatttgaaagattatgttgtcggaatttcagacactgcaggtaaagatctaattttactaattaacaaggatttacaaatcttgtaaattactttcctcttgcaatggaaagtgcttttctctgatttattatacaaataattgcaaatccttataactgaacaaggtaaaacttttcgtgtcttttggaatctgttttctggttttgtgccttcagtaatagtcttaccttagtagacaagatgtataaattgtgtaaattactaagcaaaggtgaagggaaatatattttggttatttccagttagtaactgcctcttaatgaatcacattaagtgccatagtcacttctttttttcccaaattgtctttaagaaggtacatttgcaccctaagtacaaaaaagggacagtattatttttctgcttttaataaaagtaataatgtcatatttttcctgttctagaatttcaggcatcaccccctggagctgatggagagactggtattccactgtgtatcttaatatcagggaaatatctcacaggcacatcaagctgatatcacagggtttccttgattgtaaacaatagaatggattatgactgacatgagccaacacttggatttggaagggtatgatagatttttttgctcagggtctaagaatcgtaagataccaaaccttggaaggggcaggaatcaggacagtgggagctaatggcaagttggtggtggaatacattggccctaccatgttttgtttttagacatggcattcccaagactcagatccctccttgggcgaggttctgatctgcatgactagggaggacagaacaactgcatggttaaggcagaggaaagttgggggactagaacacagagaaatcggggggaaggaccttgaggttaattacaactaggccttgctttctttaaggttatccagtgcagggctttgatcatagagtggattttcaaacattggagcaggaagaggctcccgactctcaccaaagccctggggaatgaatgacttgttcaggaggtaggtatagcttggggttacacctggttttctttagctttgcaacagactagagaatttggttcttaagtgatattatctaaaattgggaaagaaaatctctttcagttagcagagataaaatattgacaatgctgtggagggga

SEQ ID NO: 106358 - DNA, 1775 bp, Homo sapiens
gttgaagattttactgttgcagaacttactccatttaaacttgaaacccagtgttcctacagctgctttccttttctatgcaaatatttcaagcattgagaccattacctcctgagcaaagcagagtcatttatgcattaaataaataactttcctgtcccaacagggtttgtttgttttttttttttgggggggcgggagagatcacttttaggcgacattatgtgtttgtaggggcttgtcttcaaataaaaggcataattgaaatacagctgaataggaatcaagagtgtgattcaagtgtaaggtaaaattgatggcatctcttattgcttcgtagatgaattactttatggcagctttttcctgataaagcttttttaaaaactaaaaatgcattattctagtctctaattgtccatcctgacagcagcaaaaaagaaaggctgtgttttgctttttgtttcttttccctcccttagcagtgatagtagaaattgcttattgctggaaaatctgtatttgcctgctggtatgccattaaaaaagggatttggtagcctgaattccattttttctttaacgcaaaacataaggggttgcattttccatactggcagaatgtggaatgggtaggtgacttgaatgttgtcttttccacttagtattaccgttcaaaacccacgtacaccaaggaattggaatattcgaatgtgagacagaaagatgacattgcggttagcactgtctgtatccaccaaatcgtgaaccttctcagagtcatagtcccagccagggaagtaagagtgtcgctcttcactattgctgcacacatcctgctgctgggtgccaaagtggggcaggtgctcaacttcccagcagtgttaggagtaaaggctggtgggggagaaggctggttggcagattattaaatgtattttacatttgccatccagtttcattttcatggcccacatggccacctaggatatattcttagaaaaaggaatagtaactcaaatcaagatcaagcttctgatcaaatgctggggatacagcctgatgtaaaatgggacacctggatgcaatcagcaaaacccacaatgaggggaattctacactacaaatgatcctgttatatccaatttatgtatggaatggcttaaagaggcagagaaaagcctttggattaaaagagacttgagagacctgtcacccaaatgcagtgtgtggactttgaatttgaacaaatcaatgttaaaagcaaatttttttttttgaagtagggaaatttgagtactggatgttacctgatttatggaattattgtcacttttaagtacaggcaaaatagtagtgttggaattatactttttaaaagagtccgtatcttttagtgacagatgctgcattagttatagggaaattatgatgtctggaacttgctttaggataattcggttggagtaaggtgtgatttggggtaaaaaaacataaaatttgcctgatacgataattgttgagggtaagggaatggttatgtggggactcttctatctctgaatgttggaaatacaatagaaagttaaaacataatgacttacctgtgttctattctttatgatggctgctggctttatcaggcctacttcttttttaagtatttgtggggtaatgaatatttaaatatgtaacctttttacctcaaagtaatctaagtataaatatggtcactaactgcacaaccaggtctcacagaactgacaggttttatt

SEQ ID NO: 106359 - DNA, 1638 bp, Homo sapiens
gctttttattgatttcatttgggaagtttagggagaagtaggagggacacttgggaaatagaggcatttgtgccttcaagcagttcactcggggcacctgcatgaacttccaggtgtcctaagttagatttattttttattttgagatggagtcttgctctgtcatccaggctggagtgcaatggcgcaatttcagctcactgcagcctctgcctcctgggttcaagtgattctcctgcctcagcctcctgagtagctgggattacaggcacccaccaccatgaccggctaatttttgggtttttagtagagatgaggtttcaccatgttggccaggctggtcttgaaactcctgaccttgtgatccgcctgccttggtctcctaaagtgccgagattacaggtgtaagccactgtacccggcccctgagttagatttatacctcaaatgttttctgggtaaaagagggtcctaggaaggacagacactattaggtttaattgctgtgaaattaattgctagctgttcatctgcgctgctgctttgttttaacatcaaagttgacaaagtctccacggtgtagtagagagaggtctttgtgaagaaagctccttgccagctgtgggcattgacaggaaggcactctcttcctaaaccttgtaactgatattgcttttgcggtctcaggtaagaaggagaaaaagggtaaaagtttactgtagattctttagaaagcctatggcatttttgaagtcataataaaagatagattccagtggatctcctagaggctctctgtgttaactggcattgtttaagtgtaacatgtcttcagctttaggctccttagcctttcaagggcccttctgtcaagctgatgggctaccatgccagaaatgaagtccgatattaaaatgtttgttcaacagaaggtggatggagagcagcattttcaagtaatgggcaataaatcatggaattggagaagttactcaaattttggtaatgtgcccaaagaccctggccatggccttatgactgagacatgcatataagtggtggttcttggccttagggtgctaggaattggttgattggatgtgtgctttaaatagatgatattattggttcaaaataaaatgatggggtgagaactgtaaatgcctcctagaccatattctgggtcttttttatggagttgtagatagagcagattttgagataagtattcatttagttaaaggtgttgtcatgaaattccttctcaaggagttgacttgagctaacttgcatgttaacaaataccactgttctggctttccaccatcctgtatgaatatggaagttacatagaaataaaacatttaagttttcttagcgtttaaagcactaaactgtaacatatctggttaatactttagtattgtgtgctttcctattaatatgacttttttcccaagtaaaagatgttttctcctgtcttcctctctgatcagggaaaagaaaacagtttctgtttttctttggagagctcttcaggggatctttttaaggattgactcaactttaggaatttttcagttgagctgacattcattgcaatgtgtttgtggtttagcatggttcaaagtatttatc

SEQ ID NO: 106360 - DNA, 1067 bp, Homo sapiens
cccttatctgcggttttgctttctgtggtttcagttatctgcagttgcctgcattctgaaaataggtgaatatagtatgatagtatattttgagagagagagaccaaaactatattcacataacttttattactgtttgctgctatacctgttctatcttagtggttattgttagtctcttactgtgcctaatttataaattaaactttatcatggatatagttgtatagaaaaaccacagtgtatatagagctcagctccatccatggtttcaggcatccactaggggtctcagaatgtatccccctcagataaggagtgggtctgctttatattattttccaaaaattgcgtttgttatataaaaatccatgttgccaaagtttttaagctctgtgttttcaaaagtagtttaaatactataaaagtgcttattctactcagtcattggggagagtatttctggatcagtagagaaaagggaaattgcaagtacatgaaaagcttccccttattttttttgtgatgtaggcactggaggtacagatataaacaagatgtggaacctcccttcaaggaattcataatccagtgacaaagagggaaatgtaaataatcaattgctgtaaaatgatatagatgctctgattgtagcctggattggaggcagtgggagccacatatagggagtgatcaattctgcaaaggtaagatttcggtcaaaaatctatagtcagctgggtgccgtggctcacacctataatcctaacactttgggaggctgaggtgggcagattgcttgaacccaggagttcaagaccagccttggcaacatggctaaacctcatctgtacaaaaaataccaaaaaaattagctgggtatggtggcgtgtgtctgtagtcctagctactttgcaggctgaggcaggaggatcacctgagcctggggaggtcaaggctgcagtgagccgtgattgtgccattgcactccagtctgggtgacagagtgagaccctgttacacacgcacatacacacacacacacacacaaatctatagtctagagg

SEQ ID NO: 106361 - DNA, 1041 bp, Homo sapiens
acagtgaatgtatatagaggacagtcagcaaatgcttattgaatggtcagtttgatgatataatatttaagtttaattggattcttatagatgaactaggatacccttttcattctgagttgaccatttgcaccttgtaggaaggaacaggtgaggcttccaagtttgtcctccttcctgctctgtggaaccaaatccattatgtacacagcccctaccctaacagagacgatcacaatcacatttaaattatacagtgcacctacagagtttcagcagatgtgtgaatattaagttattaataactaattgggtgctaattatgtgccctggagttcttggagtgataaagaagtgtcacctactgtgtcaggcctctgtcttttcagctttggaaaatcatttttggcagatgtgccaaagttaactttggagctttaggttttgaatatcatttctcacaagtcttattttatttttttatgccttgtgaaaacttactgtgaaactgatgtgacttcccataagtaaaaattgcatgtaccgttttccaaagagggggtggcctgtgtgtgatgatagtgtttcatctctcgggagatggaagaactaacattaatcccaggggagaatttaaagctgctcaagggaattcagaagtgattctgaagcccagtgggtttttggtatattttgggagataactggtttggaagggctttgaacttggatcttgcaagtcttagctccatcactaaggatacgcatctcgtatttgtgcacacacgcccccactgccccctttttgttccatctctatccgaaataggactagtttggcttttgttaactggaagaaatcattgagttagaaagcctggataccaggttaggatactaggaatgtgatccatggtttctaagatttatagaatcctgttaaatttagaagaagggttttaatgagataatcattgaaaggctacactctcccctttctgtctctagttgcttgtaagctttagattgctggaactttgt

SEQ ID NO: 106362 - DNA, 1042 bp, Homo sapiens
cattagagctgcttggtttgctttgtcttttaaaattagcttcataaatgcacacaattgaagaggctcctgatcttggatattgcttttccttctcccactaagaacattaaaaaaatctcagtatttccaacccagggttaaaaatataatataaaaggtagaagggaaaactgaagatgaaagtaaacaaatagaaggccagagttaccaaatattgacaatgattaacacctgtttgttactggtcaagctggccaaaaacccagtgtttgcatttagccacagaaaataaaagctctcccagttgggttgtgattaatagctttgtccacaccccgcattccttttctatgctgtgtgtttgcccacctgttgtttggaactcctttctaggttttggccttaactgatagatgattcctggtgggatccagagactgtctgaggttcaggtttccagcctcccttgcagctagtgtgtgggcatgtgacccgggctccaccaatcacatgcatctgtcccagactttggatttactgctagttttgccaacacagacagaagaaaagacattttgccagttgctacaacatcctgttgacaagaatagcagtggtggtagagaagcctcgttgccttaacggggctagttcctgagctccattatctagcccacgggttggcaaattttttctctaaagggcctgatagtagatgctttagatcctatggaccatacaatctttgttggaattattgatctttgttgtggtgttgtgaaagcagccatagacaatatgtgagcaaatgagcatggatgtgttccagcaaaactttatgtacaataacaggcagttgcctgatttgactgtagtttgccaataccagatctagcctaaccagtgatcctgggagctgagctacccaaaactttcagtaaattctgtttcttagatcaggtagacttggtttattttccttgccactagggtattcattcctatttccagacttcataatctaacttactatgtgcag

SEQ ID NO: 106363 - DNA, 2234 bp, Homo sapiens
tatacttatagtgtaatatcaaaaccaagaaactgacattatcaattcacagactttattcagatttcaccagtttaacatgcacttatttgtatttactcagtggtgtttgtggtgtgtatgtgtatgtatagttttatgcatttttttcatatgtgtagatttgtgtgaccagcatcacaatctagatacaggacagttccatcactgcaaagatctcatatgctaccccttgatagccacccccacatccctaacctctagcaattactaacccattgttatttcgagaatgtcattatataaaggaaatcatacggtacataaccttttggtgctggcttgctttactcagtgtagctccccagacccatccaagttgtttgttcctttttattcctgagcagtattccatggtagggatgtggcagtttgtttatccgttcatctgttgaagaacatctgggcttttcctagtttggggctattacaaataaagctgcttatgaacatttgtgtacatagtttttgagtgaacctaagtttttatttctctgagataaatgctcaagggtgccattgctgggtcgtatagtaagtacatatttagttttatgggaaactgccagactattctcctttactaagcacgtgataactggaattggcagtgtttgaacagctcttcctgtctttcattttaccgtctttcacaccattatctggattaatttttaaacaaaagaggaattgcagttttcttacatgccagatattatactaagcaccatacacatactatctaatttaagcctcataacaactccccaaaggagggtcaataccattgtttctctaaagaaggaaactgagccacatggtatgtgcgattaatgagctagatgatcctgtaattgttcaggttcatccagctcattaaaagttatcaattggccgggcacagtggctcacgcctgtaatcccagcactttgggaggccgaggcgggcggatcacgaagtcaggagatcgagaccatcctggctaacacagtgaaaccccgtctccactaaaaaatacaaaaaaattagccgggcgtggtggcaggcacctgtagtcccagctacttgggaggctgaggcagaagaatggtgtgaacctgggaggcggagcttgcagtgagctgagatcacaccactgcactccagcctgggtgacagagtgagactccgtctcaaaaaaaaaaaaaaaaaaaagagttagcaattcaaactctgaccttggagctggtgctgcttttctgaaaccactgaatgtttggtgcccttgatgccttgagatgttcccttacgaagtgtcctgattgtgattgcggcctgtgaggcccgttatggcttgtctatctactgacactcccttgtacccatccgtgaatcctctgtcctcttgggttttatttttctgtcttgcttttgatatgcctgaagcccaagacaggctgcaacttcatgataagtggaggcttcatgtttgattaaaccagtcctatgcattgtcacctgagaatatcctgacagtggaattagtaaaggagactactgcagggtgttgtggacccccatggtgatgaagacactctgagattaaaataacatattaggagattcgttaacatagttgtccattcgttacccaggcaatccttgtttcattcataaggtctcatgactgcatcttagttggacttagcagcacctaacttctgcggattccctggcatccctccaggaccccattctttcctgccttgaatgccttcctgtgtttcacacataggcaccaaggatccaggtggaagacacctagcttgctcctaccaggctacacattttcacccgaggggaaatgaaaactgggcagcaaaagagaggttttcttttggaattacacatcttgaaatacctcagttcctctgtcctgagacaaaggcatttcattttttgttggcagctaaatgcagggtgtttgagtggggtgaccccaggctgatgcaccaagggaacgtctaatgcctgcacttcccaggctttctgctgcagaacacacactcatttggctgccatctgtaatacagtcagagagagagggcagacatttttctattaggttctattaccttgtattggaagaataatggcatgttgcttgaatgtttcccaagagaatgttttctgt

SEQ ID NO: 106364 - DNA, 1003 bp, Homo sapiens
ctttcttgtatgcagcccagggcttaatgggttgaccttctatgctgctgacaaaggaaggctacctgtgctttttctttttttttttttttttgagacaaagtctcactctgtcgcccaggctggagtgcagtggtgcaatctcggctcactgcaacctctgcctcccgggttcaagagattcttgtgcctcagcctcctgagtagctaggattttaggtgcccaccaccatgcccagctactttttgtattttttttttagtagagacggggtttcaccatgttggccaggctggtctcaaactcctgacctcaggtgatccacccacctcggcttcccaaagtgctgggattacaggcgtgagccaccgcacccggccacctgcgctttatcagcttattgaggtgtgcggcaggagtcctggttgcctggtgagtcatcctgcaggtggaatggttgagtcgccgagtcccctgccagattgtccagagttgtacaagggcacagtgctgcctctcaatgacaggaaataggtatgatttcctctctcttctttgtccttatttcatctctgattattgtcttcccagcatttaaccacatttgcaagttacgtttttcacttatttgttgacctgttcatgatattcattaatcctgtagattaagatcttcagggattgttatcagtttcacttattcttttatcatatggtcccaggatactgcctggcacatagtagatgttcagaaatatggactaaatgagtattataattgacacatctcagtcaagaaggagtggcagttatactcagttgtaactttttcttgaagatatgtatcttcaagttacttgtactaatgggtggttgcatattttggctcttttactttgtatttttttagaaacagggtcttactttgtcacccagcttggagtgtggtggcaggatcacggctcaccacagctcactcctggctcactcctgggctcaagt

SEQ ID NO: 106365 - DNA, 1041 bp, Homo sapiens
ggattcattgtgccctagtgtctcctgtatgtgccgtccctcatgccttcaactttctttgctcaaaatgaaaccaattgatgataaatgaaaggatcagtaggctttaaagcagttatttacaactgagcatttagagttcccacgcttaaaaagtgggagctgttcccatggctgctgagagtgctgcggaagctggttctctttgtccttaagttgatcgatagcaggcatcagcggggaagatgctttgtactttgcttgttaaacagagggctgctaagcagctgtggcagtgtgaccctggttgtgctgctgtgggtgacatgagtgtgcatgtggacagtggttatggtgcttccctacacactgggcacccaccctatggacagacacactccatgaaaatgtttgggaagtataagagctccaggccatgggatgaaatgggaaggacctaactctgatttctagatttggaattgaatctgcatgtactgttcaggtcattgttctggcacatatttgacggtttggttgtcttcaagctcaggggctgcgaaagttgccagaataggaatgttctggcctgatgcaagcaggcacccggtgcctgtggattcaggactggtcacactgcagctggacattatgaattcagatgtccctgatgagacggtgtcctaggacagtggctaggtgaggtctcaggatctcaggtacaaggttagaggaggcaacgtggagtcacagtggagagcctggttggtcccatagccagatagctacaggttcaggtaccagctctgccctcatctattttttgtgaccttgggaaagttagataacaatttgagctcctttttctatcttgaaaatagggatctaatgtctaacttagctccctggtgttttattctccccatctcatccacatcacacttttattttcaagtcttgttttctttctgtcatttattcccgagataagtgtatgcttgttttgttgtttattttcccagctaggatacaagttctttg

SEQ ID NO: 106366 - DNA, 1379 bp, Homo sapiens
ctgtgtacacttcttaaaagtgaaaaagcctttgcaggtttgtccagacagtggggtgaccaggaaggagagtcagaagagaaggtaggggtctggatcctgattttgagtgttcatttcccaaaaaatcttaggaagataaacactttcttggtaacctttgagtgtcatgttccttctctgaagagtgtattagattccatgtggtatacccagtagattgcattttgagtgtcattgatgattaatggatagagactgcttagaccactgtatggagaaggattctgaagtcatgtctgggtgcagtgggagagtgtcatgatacattgattattacttttcataaccgatttacctaaaccaaataatactagtttttaaattcctggatgtgatacacaatttcctttaaaaataaatttaattagaagaaatgaatggttttttttaaataaggaaaactagagtttttcagggggaatgtggctatggtggaaactttgaacatagtatgagaaagaatgaaattctggccgggcgcggtggctcacacctgtaatctcagcactttgggaggccagggcaggcggatcacgaggtcaggagatagagaccatcctggccaacatggtgaaaccctgtctctactaaaaatacaaaaattagctgggcctggtggtttgtgcctgtagtcccagctactcaggaggctgaggcaggagaatcgcttgaacctgggaggtagaggttgtagtgaggtcagatcatgccactgcactccagcctggcgacacagtgagactccgtctcaaaaaacaaacaaaaatgaaaaaagcacaaagaatgaaattctggaaacactaaggagatgaatgtttacctacctgacagaattgttttgggagttttaatgcaggtggcagcttgctgtgacttctaaaggcagtacagaagtatcacagtgtggttaaacttctttttttgaccaggaggtaaacctgaactcaaagtctcccaaagccctctctgaacaagaaaatagaatagtggtccagagtttggatactgaggctggactgtctgggtttgagccccctctcgcctctgttcacatagttagcgagtgatatatgcatttaacttccctgagcctcagtttctcatttgttaaaggcagtacctcatggtgttggtatcaggattaaaagaccatttcagaggaagcttctagaacagcacgtggttcagtataacacggcgtctacgggttgacaatgataatgatgattggatattaaaaaaacctgactggatgcgttggctcacgcctgtaatcccagcactttgggagactaaggtgggctgatacctgaggt

SEQ ID NO: 106367 - DNA, 1754 bp, Homo sapiens
gaagcctacttaagaaaagctgacagctgatgtcaggtgttttctttgttcaaaaatggtgtagaacagtacttggagtgaatgggtgacttcaatttagtaattgtttttacatttagtaaagaaattatgtaatggtagtgtctcctctcccttacccccccaattcatttgaattaataatttaaaaagtacttttaaaacttagacccagccatctgttccttcctgttgccttacagcagcagtaattgctttaggatgggcttggaaacaagagcggaaatggtctccagtgaccccaaatcataacagaactcgaatcctaagaaaaaccacaagtggcttatgaataagctgaaaacttaaatgcctcctcaacaatttaaatttggattgcatagcttatggatttggtgggacattctaacctcgatgtatctttaacattttctgcttttaagatgcaaaggcgttaacatagggatggagagaaaacttccttctaagttttcctagaaagtctggcacctttgacatagctataacagaaagaaaaatatatatatgtatttgatactggttctagataatgccattaattagatttaaaatgatgcttatagcaagcatatgtacaacgtaatatgttccagctacgactctaagcacttttcccattttaattcacttgcttctcagaacagttctatgagggaggctctattaggcctgactcatgctcggcattttgtacacgaggaaactaaagcaaggcaaagtcgactgcccagaattaccggctaataaatgtcagtcttgcctggtgctgcacacctgcagtcccaggtacttaggaggctgaggtgggaggatctcttgagcccaggagtttgaatctaactgggaaacatagtgagactttgtctctttaaacaaaatttttttaattaaaaaaaaaaaaaaagtcagtctggctactagtcttttaagtccattctgctgattctaagacttgatccacaagaccagggattggcaaaccatggcccatgggcaaacatctggcctactgcctatttttttgtaaataaagttttattggtcaaggtgtaggggtgggaaaaaagttttattggaatagagcccctgctatttgttgacttattgtctatggctgttttcttgctacaacagtagaaatgagtgtttgcaacagagaccatatggcttgccaagcctaaaatatttactgtctggctgttagcagagtgagtctgcctacccatacagaagaccattctcatccatatgtatagtccagaaaggtaggaacaaatttttaaaaatcttaattccatatactttcaaataagattgagttaaaactcatacattgaaggtccaagtatttggtgccattctccagtgttatgatgaatgtgaaatcatttacaggacacccctctatcaggcatttgggggaagagaaaggaacagataaacatgtgaaaaatgggagagtgtgtgaactctctatagtactctagaaagcccggctttaactctgcaaaatttgaaaatagcaatcttaaactttctgtttttctcgctgcttttctgcaacagcttcagaatagaaactgacaggcccattttagtagaaagcaaacggcagtgtgtgggtggcgccttataacacagcaactcaaggttaggtggggggagaccaagaattgagtttcttttgttaa

SEQ ID NO: 106368 - DNA, 1755 bp, Homo sapiens
acaggtttttcttaacgttctgtaggatacacattactttttctactatgtgtcttttattgctgcaaaagtcagttgtacttgagacagtttggcactgagaggggaatgtggcatatcttggcactgtggacagctggttgggtgttgatgtggtgacagggaggagggaagggctcacagaccagacacgtgctgcctttgaatgcaggtggtgatcagtgtgcttagtcatgtagggctgctcttcgtggaagaggtagcttggtagggtggttgagtttcagtactggagtcggcagaactagacttctgtccccaccctggctcactagctgtttgacattggacaccttgattcaatccctttgaacattagtctccttgtctctttgatggggataaatatctgcttcacacatagccctgtgggaagatgtgaaaagcccaactctgggtgtgttaggggcagataaatgctgagtgttagctttcctttagccgaatctgaactgattgaattgcattgggactcagtttgtagtcagtgacttatgttcaaaaacttgggaagacccaggagggggttgacttatcccgaaaaatcaggttctttttgaaaatgtgttaattctttcaggccagcaaggtgtcatctaagaatgtctgccagtaactagttcccagggagtcttaaagatgtcactgtagctttcagacatacctgagttactcttaagagcaccttgccttgtaggaatccattttgtgatatttgtttaaattatgtcacagcgcattgcagacttgtaatctgttttcaaaatggtattgtctgcgcccttattgatcagcgcgacatcttttacttgcttatctctgctttccatatggtcatactccaaagctagacctagagcagacccactaactcattaacctctctgacacgaaatagaaaccttctagaaggggaccagctatgggaggcagagttcttaaaatctctcgcagtcccccggcattttcctgagcctccggttgtaggtattagactgggcgcgagttttcacaacacggggaatttgtcatggttgagtctgctgtcgtttgaaatactgcttagttctttaagatataattaagtagaatcgcagaaaagagaccttcgttggcattttttgtttgtgttgtgactatcgaaatccctgctctccggaggcttgccctgacttggggtggggagtgtgacgtagagacactgcgaagccggagcgatcaggttaggtgaggccatgcttaagttggattcgttgaaaatatgattcaatttgagaacatggtagtgcccatttccaagctgtcacagagtccaggagatggggaataaaaaatcttcggcatctctcggggaagattattttgtttgaggtcttaggacttctcctgatactgtatgaactttctttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttctgcagtgtttgtgtccctgggtacttgagactagggagtggtgatgactcgtaaggagcatgctgccttcaagcatctgtttaacaaagcacatcttgcaccgcccttaatccattcaaccctgagtggatatagc

SEQ ID NO: 106369 - DNA, 1152 bp, Homo sapiens
gtgtatacctatgtaacaaacctgcacgttctgcacatgtatcccagaacaagtataataataataaaaaaaaaaaagaaacatggctttgcatgagaaaagcctattgaatgtctcagagatggacatgttaatgttgccttgagtagaaagatctggatactgatctccagctccccgctctttcagttttggattctactgttacctaatgtgtttaaagccatattggttagcagggagtagtgatcccagctactcaggaggctgaggtgggaggattgcttgaacccaggaggtggaggctgcagtcagctgagatcgccccactgccctccagcctgggcgatagagtgagactccatctcaaaaaaaaaaaaaaaaaaaaaaaagccatattagtactctataaatactccattaaaaaaaggtgggaggtaggagacgattccccagttgtccaaaaaattcgattgatgtgctgctgacttctgtttggtttagcagatgtttgttgagcagctgtttgttgaattggttgaaaatgaattaaaaataattttatcttgacctttctctttgtaactttaacatcacctcatgaggtagctggaaaagtcctggaatgtctttcaaactctgggtgggaattactgtttacaagttgtcagccagtgtcactaggtgataattcccctctgtgtgagtgtcatggttacagtatgcttttttgcctctaaaagaacaattatattcaagaaatttcctagtgcatttaaaaacagctgggtgaaagtcattttaaatccccaaatccaacacattcgttcttttgtgcatttaattaagcagaagttaaaataaattagaacaggagacattcagtgctgattgttgaatcaacaaagcaagaaacagcctagcattaccctaccacagatgtctgtcactcagtgctgttgccctataaatttccatcaactcttaccattttttgaataacaatttcttttctagtaaaaattggcatatgatgtatagcaagcaatattctttatgcaaatgatatttccatatatctctaattttttccccttaatgatacatttatgttggtggcttggataacttttccggaggatggaggatgtg

SEQ ID NO: 106370 - DNA, 1070 bp, Homo sapiens
gcagtccattgtagctgtaccctctgtctttgcatctttgatttctccagctcggagcatccccagacaagatggcctcatccctggtaaaaagttccctggccgagagatcaacgtgaatttcccatcctggcttccaggcgtctccgcttggcatctcacatttctagaaaaacagcacccaacctacttcccagacgtgtcataatcatgtcccattttgatacttattatacaaataaccccaaacacgtgtactctttctattggttgtttgtctaaaactttatttttgttctccaaaagtaaatgcccattgtaatacccaatagtctctttgaatttgcatcccccatacctaagttttgggaggcctcccaatgctcacccctcattagtatctctgtattatgtgcaatttttttttccttgaaagcatttctgcaataatggctttttttccccccgttaagtgacgacagtcatcctaagttaagtttatttgactaggagagggaagaatattcacaaagggcactggtctcacgtgattgagagactggtagaaacatggcaagattgggccacagtcaaatcagagtctggaaagcttgctgcctcagggatggctgtacatacaaactcccaaatgatacattaattgattttgattatatgactccaaagcttgagcatttcaaactgttttcaaactaatggccatcgcatttggcaaggagcccaactgcgcattgggttcattataaaaggagatcttgacagcctgtcaggaggacagaatgcatgctagggttttgagaagttgctcagtttcagaggacttggtggtgtttttcattaaaaggtaccagaaatttagcagcccgaccaagagccaggcttataagtcacggaatgaccctggtcagtacatgcagaaccttaacagtatgatcttaagatatctcattagattccagtgaataaggccaggtaccgtggctcacgtctgtaatcccagcactttgggaggtcaaagctggtggatcacttgagtccaggagtttgag

SEQ ID NO: 106371 - DNA, 1019 bp, Homo sapiens
ttagcttgtgaaaagcttcttttcttgcttttaaaaccttcactctgcgtttagaataaatggcattcctggatctgttaaataggcagttaataatgccacagaaactacccaccacacacccaaccacaaaacttgctcagaggcaggatgtgtattggaatattctgtaatgatccaatgctgaaacattacaatcagccttgaccctgcaatctgcatttttaattgcagccttcatttacagtggggtattggtctgctttcagtttgtcctgaaggttgactggatctcgtaatctattcatgtcagactgcctgctaggaccagcatgaattcagctcttcagaggaagcattgtcatacagagaggactcggccgtttgtttcaccttgatatatttcccaatatatgcttcattctctggggtagtttttattcctcttctatgaaatgtggattataaggactcatgccccatggaatttctatagggtttagatgagataatacatgtaaagtatttgatatgggcatgtaggaagcaccaaataaacagtagccattatgatttttcttgctctggatttaacttttttaagctcctgaattttggattagtaatgttgttgaccatggaggaaaattgaaaaaagatgttggcttcattttcttgatgactgaaaagtaaactagtggccgggcgcagtggctcactcctgtaatcccagcactttgggagactgaagctggtggatcacttaaggtcaagagatcgagaccagcctggccaacatagtgaaaacttttcgctactaaaaatacaaaaattagccaggcgtggggtgcacacctgtaatcccaactatatgggaggctgaggcaggagaatcacttgaacctgggaggcagaggttgcagtgagccgagattgtgtgactgcacttgggcctgggccacagagcaagactcctgtctcaaaaaaaaaaaaaaaaaagtgaactggtaatgagaaat

SEQ ID NO: 106372 - DNA, 2397 bp, Homo sapiens
ccaactcccagtcataatcctttgttcatgacattataatcatcaccacaagtggctaattgtgatgtcacaaatggaggattatgactcaaatgaggaataaacagcagtggcggattaattcctaagcaacgaagaagattctgttttgtgcaaatgccccagggtaataaaatttaaaaccagaaaaaggcaaggggaagacaaagctgaacatatgtgatctattagctaaattgtccttaagtggaaagcttttctttctctctttcttccttccttaattttccacgtggtatgaatagctcctctatggtagataaatcgatttggttttaggcctaacaaagctcaaggtgtcttgctgactaattacagggatgtcacacctgggctgaaaagtgagtcattatggaatctttgaggtgtttttattttccataaagttgaattgctcttttcagtcagcattgcaaaagtcaggctataaagatcagcacaatggccgaagacagctgggctgataattgacggcagtcccaacctggaaactctgggtaaggccagcagagccgaatggcgtcagtcactcaggacagttttctgaatgggtgatatgtaaatgaggcagtggtaacagctgttgctgtggattggcctagaaatagtagtcaattctctgtggagggtcaattttcgattctaagtcaaggatgtgtttttttcccttttaggaaataggtggttcccatactattcagttaaccaagcagccaaatccctctctacacttaacagctccctcatccttggggttacttggccgtctcaggaacactcttgagtttgtggccttttctaaaaccatggttgcagtagccaaactaaactggaaatccctttgaattgttttccttttcatgggacatagtgttcctttcttccgtttgatatatttcgttctctgtcgtgcttgagctctctctcgacttatgacttcaccgtcacttgaatattggaagccttcttgaaaaacattggtgaaagacttgaggctacagtttggcatcagcagcagagcaaataaaaccacactttaaaaacttggtaaatttagttatgaaggagacctcccattcgagtctaggcgtttaataatagcctgtatgcacaaagtagaaattatgtgattatcgtcttggggctgtgattagaatgtgttgctatatattggtaacatttagaaatgtgtaacttcatcccagctccatggtaccgtagggcaagcatgacataaacatggtcttgcagttgtacactggtttgagattccctggagactaaacagctatgagggagtcatgcttccgtttgccactgttgtctcctttgtctcgtataggctatcagagatgtttcctggacttttaagagtagctccaacagaagttttgccttctgagtagtaaggtggtcacaacttgtcctgtttcccctatgggagtgtatatgctggtggtgatggtgggggatctcacctttgtttccacatcagtatgctgctgccagctcccctccaggctgtgctgtcgggacacatctgtgtgcctgtatgtggctcattagggagcgggttgcctgttcttttgaggtgagcatacattttgatttttcttttggcatcttttggtttggaacatttacagccctttttaaaaatatagtcatttctgtgtgggttttctctgagccagtatttgccacactccagtgatattgagagaaacaaagggaacacgtccaagcccagaggggctctgtcttaacatctgacaggagcttctaagcccagtgtggttgttactgtgggaagtcgggaagtccattacccaaggctgtgggaaacacaggtcataaaagcgggggcctctgatcctggggcatttacagcttagtttgggagccaaaactggaccatgtgaaacagcttagaacaattgcagaaccaagaattagcaaatgtggattaatgtagattaaaacttgcctgtgagattccaaggtacttggaaatctgagttttacagttgactgggaaaggcttcctggagtagttgagtttgggaaccaggttttaaatgaaccaatatggggtggtgaagatgatcgtgatatctgtcaccagagacacctctgtgtgaatcccttccctgccattgactgaccttgggacaaattatttaacccaagtctagtctcctggagatgagcctttgtttctctctccccatctccctccctctctctgttactcctcctcccgctctccttctttcttttcccgctcctccgcctctctcattctctttcttaagtacaagactgcctacctccctc

SEQ ID NO: 106373 - DNA, 1412 bp, Homo sapiens
caggaaaagacgtaggaaatcttcaccagatttgaaggaaatgtttggaatggtttgacttaaacatcttattatctggcttatttggaattttctttagggggccttcagtgacacctcaagttggtccttagccatccaccctggtgggtgcccatagattcagataagcagtggagagcatgtgtgctgcactagccctgttcagggtaatagccagcatgtattcatacaacactggttaatgattcttcccggcagtcctactagggactccacctttgtcaaggccgtaaatggactttggggctgtacattaagagacctggcctgacttgatctggctaaacatggctttgggaccctcttgaagtttccagttgatattttttattcttttcaaaccaaatcactgcagtgaaaagaaaacaaaaaaaggagtttttaaatttatacaaaagtatgaaaaagaatgagaagttaggaaagtgtgaattatattttaagtaaggctttgtggctttgttgatcatggaaatctttttattaacacattagacaaattctttacatgccagtttgcattcacttaaacatttgtgggggtggtgtgtaaaatgtgcagcaatacctgctcctttttgggaaatccatttgttaaatagccctcagaatatgacagttttatagtaggattatgacttttttttgtttccatgtctgctaaaaaggctaacagaataggacaatttaatcacatgccattatgttcataggggtttgggaagctcagacatgtttctagaaaaggaatcgcgtacccagcttttccaagtttcttagcaaaattcgataattacttgatttggagatgtccccattcagccccttcttctgagggcatctggccttcctgagtgtggctgacatcactttcatgaccttggctctgttgaggtggttgtcagggaaggtgtgttgccagaactgtcctgtcactcttcgacagagagagacagagagacatttcctggactaatccatgtttccagccagatttatattatttacagggtattaggcaaggaccaggatttagccaggtgttgccctggagaattgtttcggacctcaagtcaaaaaaaggctgcatgctgactagcggaggaaacagctccccacgggccagcctagactctgtatcctggcatttgtcatcccagctggagttttttgaggcatcggagctagaataaagcaggagctcatcagaggctctcttttctcagtcgcctccatctttccagagactcagaggccaccagctgtggcagcaggtctcaagctttgtcggtgattagttgcacggcggggaaggctcttcgcattttcctctgttctggggctctctg

SEQ ID NO: 106374 - DNA, 1016 bp, Homo sapiens
agggaaaatatcctaacatgtctggcgtgccctttaacttgacagagagggcagaggctgaggaagtttggtggtacgactgcacttggttaagcagccagtgctggcgaaacaggccttacttagcccaggcattctgactgccatttgaggactgtttttactgtaataatccatcactctggactttatgctctaggaatgaaaattgtatttactattggcctaagaaaaacatattgcaattcatatttgaagctgcttagcaaagatccctaacaccagccagaagtgatttggctattggaattacctgttttggagagtgattcctataactgcttccctatcatcatctgtaatggttgaagctatgtgtatacattcacacgtttacacacaaaacaagataatttctttactgggtcttagcaaaaagtctagaagaattttcaataaaactggatgcatatttatgattgtctgacttaaaatgtagactgtgtggcatgtatgaatttcactttggagggaacagagtcttgagcaagcacctcaaataaatacataggccattactctctgctatggcagctgaaactaagaaacagtgagagggctatgtggctgcttatgtgggaagatttaatttctgttgtaggatgctgaggaccttggaaattgaggcactgaagctgaagtggcaagggcaagtgtgaattgcatcagatctttttctctcagggtaatttcttcatatcccaggtaaggtagcatttggatttctagtctttatatttattggtggtgagtaattctccccaaaaatggagggggagaaactagtatgcaaatgatgacaaaatagaagaaatctatctcattttgcagtgttcttatcccatcataaaaattagttgatcagataaattgaagttttaacctgattccatttatttcctactagacgcattttggaaatctcagtttgtgttctgaagattttctagctagaa

SEQ ID NO: 106375 - DNA, 1024 bp, Homo sapiens
ggctcacttgctgcttttctccaggataaatggcaattgcttgatgcttgatagggacgtattaaatacaacggctgtctcaggaccctgtctgccttgtttttcatcacctggacgtctgatacatgcaaagtggaggaattactgcaaagagtggaagacaggttaaacaaacattcaccacaactaactgtttaagcttaagtcactaaaacactcattgtgtttttgctctgaaggtccatgaagggatagattcgtccatcctccttctccgtcatcacacatcaaggccaggattgtgccatttatggattccacatcctaagagaaaactgttcactcagatggtttctggtagtgactcctcttctctttgaaatgcccttcaaagtatttagccagaaacaaagctttttggtttttgggcttgtgtcaggcttttgctagagagtgatttttttttttcaaggaaattaatagatgatacagtcaatgctagacaattttagatctcagagctgtcttccttgaaaggtacattactgtttcttttacatctctgagatgagactgctcagagaatgattgattttggggtgaattgctatgtttttacatagacaaaataaaaccacagaatccttcaatagaggaaataaaatatggcacgccatcaatgtggaatattaggcaccctcaagtgtaagtctatgtatatatgacatggaaaaatgtttaagatgtggttgggtgactttaaaacaagttgcagtttgggcacagtgcctcatgcctttagtcccagcactttgagaggctgaagtgggaggattgcttgaacccaggagtttgagaccaccctgggcaacatagagagaccccatctctacaaaaataattagctgggtgtggtggcacatacctgtagtcccatctactctggaggctgatacaagaggatcgcttaagcccaggacataaaggctacagtgagttgtgatcacaccactgcactccagcc

SEQ ID NO: 106376 - DNA, 1081 bp, Homo sapiens
cgtccgtgtgaagagaccaccaaacaggctttgtgtgagcagcaaggctgtttatttcacctgggtacaggcgggctgagtccgaaaagagagtcagcgaggcgaggtaggggtggggccgttttataggatttgggtaggtaaaggaaaaacgggggttgttctctggcaggcaagagtgggggtcacaaggtgctcagtaggggagcttttgagccaggatgagccaggagaaggaatttcacaagataatgtcatcagttaaggcaggaacaggccattttcatttcttttgtggtggaatgtcatcagttaaggcaggaaccggccatctggatgtgtacgtgcaggtcacaggggatatgatggcttagcttgggctcataggcctgacagaaatgagcagaattgaaagattcatgacaaaagttggctacttctgtacatgcacctattaagctttttttggtatgttgtacattttcttcttcagggtcttcccagccctattagtaacagttgtttttatagcaattggataagatatgaaactaagaactttattattaattggttgctattccttggaataaaaatgaaaaaaagattaacaatggaagaatattaaaagtacaatttgcccattcattatatcagatgtctcagttttatggtgaggtaggcatcatattaaggtacaactatttagcgagatgtataaatgattaatatatgagaaattatgaatttaatacccgtccaaaacttgttagaataaatgacttttatgttcccattaggttttgtgatgggaaataatatattttatgtaagagaaaattcagatgcttctacttattacccatgaggtgtccgtgaacttggcacgatattccttttttctaatatattctgaactctcatggttaaatgcataggtaatgtgtcataattgaatacatgttcttatcaatagtgtctgtcagccagtttccagtagattcagcagacattttctgcctattagggggctggacttggtgctgaggagtacccagggagggttaagttcttgcccttg

SEQ ID NO: 106377 - DNA, 1075 bp, Homo sapiens
tactcttttgaactgtttggctttttttctttttctttttttttttgagacagagttttgctcttgtcatccaggctggagtgcaatggcgcgatagtggctcactgcaacctccgcctcccgggttcaagtgattctcctgcctcagcctcctgagtagctgggattacaggcgcctgctaccacgcccagttaatttttgtatttttaggagagacaggatttcaccatgttgccaaggctggtctcgaactcccgacctcgggtgatccacccaccttggccttccaaagtgctgggattacaagtgtgagccaccgcgcctggcgtgtttggctttttattgcaaggtcctccattttttcaaaatttggaaataggagttcctgcattggcttgaggctcctgatgtcttaagagcattgaaatgggtggaccaccattggttagggttatgggtagggtcctgaaaggcttaatgtagtagtttctaggtctcaattttctctctatgagaacaagttccgttgactaaaggatttctgttccctttctacctctgatatccagtcccttgcagggtccaacttcatacacctcggcattttaggaattaattcgggattttacagtttggcttgatttgattttattttgttttttgatttttgactattcacaagatttttaaaaatgtcatacatttccgttgaagatatgatgagttctacagctagtatgacatgttccaggttgcagtggtgtagttcaagttttatgtttgtttggttttaattttattgtttttgccaagtgaacaatagttcgaatcaaggatgctaattatatgatgtacagaattaatcaattttgagattaaaacactactgtatactatatactaaatatacattaatgttaataaatacatccctagttcaaaaatgttagaatgagtgaatgagtatgttggcaagagggatggagtgagatagggatttaaggatgtgttttgacaacattctgtggcacagtcaacatgaggttgagctgattgggatgtaactacatgttc

SEQ ID NO: 106378 - DNA, 1022 bp, Homo sapiens
actctttagttattgattatacaactatacaacagtttgccagttttcttcttgttagaccttttgagttctttctagttttaggctttcatgagtaaagctgtaaagagcaatcttgtaaatgcctgttggtgcacatttgtatgcagttccctctggtgcctaccataagggataaggttaaatgtaattcatacggtgggtgcagaatttgcatttgaaccttgattctctataggcagagccttggctcgttaccactaccctctgctgctgcctgtaattttaaagcctgtatttctccccaggtaaggaagttgaatcttttttttttttttccccctgtatgaaagttcagtggactggcactttaagatggttcttagcagcttgtgtttgccccacttatataggtgccacaccattaaactgcctatcattttccgactgatgcctttctggaaaatagataaaggacatcagaagaatgcatcttatcagtattgatttagccgaaagggttgtaaagaaatcagttacagtaatgtcaaatttcataagattggttttgagagagtagctgtgtcaactaggctgacattttttctcttttggctttatttcgtagtatgggcattaatggtggagtgatccagatttggaaaccaaaaatggtatttctaaggcattccacagggctgggggagttgatgctgtatcttttcatgctcccttggtgctaactggctgtatggccttgggaaggccacttagtttctcctgcctcgctcatttgtaaagtggggggcataggattgtatcagtgaaacttcaccttttcttggtaatctgatggatgaccctctcctttgaaaaacaaacacaaatctgtgtaaatttcaaacccatttcatatgggcttgttgatacctgttagctcgtgatttcttaattataaaggaaattcccaattctattattaatgaaagttcagctctctgcattttggagaagtcttttat

SEQ ID NO: 106379 - DNA, 1038 bp, Homo sapiens
tgggtggctgagccccaggtatttgcttatcacctgttaatgaccacataccccataggcatccaccacgaaggggctcttggggcacctgagagttgaaattaagttagtgaagatgcctgcgctgggtgtgaggaacaagtggaaattacagttctgaaaaggcacttggaaagcagggagcagaataccagtatctgatgggttttgtttgttgggagagggagttggagggtgggagaatgggtagattctgattcttcttttattctccattatttgctcaaggctgctattttgtcaggggtttcaggctttggattttgtggaccagtttaaaactggaggcctgctgtaaagtagctaaataacttttaagtttgtccaatagagatgtttaaagaaaaaaaaaatactatttactgtcgccatcaccgcatcaaagaaaggatgctttgtcaccaaaggagtaggaggtgtataactgtgcaataaagaagagtcattgatgttaaatgaatcaggtgttatgggccttattcttggttattttaccaggacccgggaacgatgtcatcataggctggtccatttgtttcactgcacatagtagggattaaatgcttattactgcttagatgactgaattaatgaacagtggtaccccgtattcatcattcttggggaggactgatgcttgagcagaggccgtgaggtgccctcttcaatggcacccatcttcaattcttcctttttatcttttgcttttgacctttcctgaagtggctgaagattgtagcaatacacaagcatactccgatttcccctaagatgttgtgcctcccatctgcttcttgtttcatattgttctgttttcatgtgccctaagggacagttatgttgtataaagagcaagtcccccaagtgtcctccccacttcgggtctgcagaaaaatgattgattatgaggaatgtgatttcagtaatgcaggcaggattaaatgcttgccatctatcgacactttgcagtgccttaaa

SEQ ID NO: 106380 - DNA, 1027 bp, Homo sapiens
acatttgtctgtctctaaaacattagaaaagttttactctggaaaaagatatggcccatcagatacaaagttagtgatgttattatagtctttttttttttttttttgagacggagtttcactcttgttgcccaggctggagtgcaatggtgtgatctcggctcactgcaacatctgcctcctgggttcaaacgattctcctgcctcagcctcccaagtagctgggattataggcacctgctaccatgcccagttaatttttgtatttttagtagagacggggtttcgccatgttggccaggctggtgtcgaactcctgaccttaggtgacccgcctgccttggcctcccaaagtgctaggattacaggtgtgagccaccgcgcccggcctgttattatagtctttaaaaaattgtcctttaactgccatcgattatttttacaaatttgaattatgtaaaatttttatatagaaaaaatatatgagacatttaacagatgctaatatcttgtcacagcggcttaagactttttttttttaaagagagaacactggagaattggcaagttcctaaacatccatatccctttcttccccattgatattgtttggctctgtatctccacccaaatctcatctggaatataattcccatgtgtcgaaggagggacctggtgggaggtgattggatcacgggggaggtttccctcatgctgttctcgtgatagtgagggagttctcatgagatctgatggtttaacagtggcagcttcccctgtgctctctcttctcctgctgccttgtgaagaagatgcctgcttccccttcaccttccaccatgattgtaagtttcctgaggcctccccagccgtgcggtactgagtcaattaaacctcctctctttataaattacccagtctcaggtgatatctttatagcacggtgagaatggactaatacatctatctcaaaggaatatcttcttttgcttatgcatacttttatctagagcaaaactacaaaaac

SEQ ID NO: 106381 - DNA, 1050 bp, Homo sapiens
tagggtacatactagtttaccaccaatggcttttttttttttggtccttaaatctctaccatccaagaagtgagtgctaactctgtatttattagtccctggatagataagcagagtcagtactcactgctttgtgtagagtactctcctagacataagaggagcataatgacatactggatggagagggtctcctgtggtgagggtgctgggaacactgaaatgcatccagaatcacagggaagcttcagaaatggctctaagctctcagctcactgccaccgccacgcccctttcctttataactctttagggaatggtttgtttgcttttttccccagaattggggatcacgtcacaactctgaggttcctctaacgtcatcttgaactctgcagaagtgtgtttcttcctctgaagtgctattttgtggtaatttaatgtatttttttcatgaataatttacccatagagtcctaatatcttaagacagtgaattttgttgtttatcaaagatgtatctcaactaggagacagaaatcaatttcttattacaaagcaaagacaaaacacaagatcatctaccctgtgggataacaatctgttttggaagcattttggattattaatatttaagtcaggaacacatggataaagaaattattgtccctttttataaagaaagtggtatatttattactcatcttatgtgtccccattgcgtactctttttttctctcattatcttttcttattgttgggttatgaagtgtcctgaagtcacagcattttagggctaaaatacaaactgtacttaaactacctggtaaaaatacttgcttactttttaaataaaaactcccagctgggcatgttggctcacgcctgtaatcctagcactttggaaggccgaggtgggtgggtcacgaggtcaggagttcaagaccagcctggccaagatggtgaaaccccatctctactaaaaactacaaaaattagctgggtgcggtggcaggcacgcgtaatcccagctactcaggaggctgaggc

SEQ ID NO: 106382 - DNA, 1063 bp, Homo sapiens
accatgatgacaagggaattttttttttttttgagacacattcttgttctgtcccccaggctggagctggagtgcagtggcaggatcttggctcaccactgcctccacctcctgggttcaagcaattctcctgcctcagcctcccgagtagctgggattacaggcatgcaccaccacgtccagctaatttttgtatttttaggagaggtggggtttcaccatgttgaccagtctgcttttgaattcctgacttcaagtgatccacctgcctcggcctcccaaagtgtggggattacaggtgtgagccaccactcccggccaacgggaatttttaaactcgtatttaattgtaacatgcatgtggaaaaatgcatgcattatagtgaaccgctcaatgaataatcacaatatctgaacacagccatgtaaccaactcccagatgaaaaaacagtatcactcccgaaggtctccccatgctcccctcttcccacttcaagggctactaccgtcctgacttctgatatcatagatgaggtttggatggcaagaacttctgtcagtttatttcactgctgtatgtgcaggatatggcaggtgcaaagtacacattgattgagtacattaaaataatactggaagagagacctgtatttctgatgtagctagatttctaaagctgacctccattgatggattaatccccgccaatggaaaatgcagttagaggctttagaaatattatccagtggcaaaacactggccattataacttagacgattagatttgtcacttgtttctgctgcgttggccttgattatgtaagtattttagctgtgatgtctttaagtccactcttcttgcttgtaattttaatttattgtctgttctatttgctggcacttaatcagacatctctctggtgattgtcttacaggattatttaacttcttcttgcctttcaactgcattgtaaatttaaccaagcataataaatttgcaccaaattttacccttcagtgttgattcttccctagctggaattactgtacatttctgtttct

SEQ ID NO: 106383 - DNA, 1058 bp, Homo sapiens
gtttcagtactttattttacttaaaaaacatcatggctctatattaggtctctttattcatgtaaggtgatgaaaaaaactttttatagttgaaacagtaagtatatttgaatatgataaaatagggaatctagtgtaatataatctattgtatttgaggttagctcagtattacaaacaactagaaggaccatttataatgcagtgcttacaaaggaacacactttttcattttactttttgggacactcaccgagcacattttactacaattgattgaaatacaggcacaaaggaaatgagaggttgatcagaatatttaattacttttaacttaatttgatacttttgcccattgtaggcataaaaaaagattttcattttagactattgtgtgggatttaatgttcttaaatgctctttaaaatttagagaaaattgtgctcaatggagatttcaccatccttgagggatctttaatttgtttgttgatgtgccattaaaatagatataaacaacctacttaactgcttgtctgccattctggatatcttcgttctagatttgacaatgtgagtgcctgttgcttgtttttagttggcttatgttttggcagtatatctgggagaagaactaggactctgtatatgagaaccacccacccatcaccctaagtagttttcattttggcactggagaaccagaatttctttgttctgatgttttcaattttatatggaagctgacctattctcccaggcttctaagtcctttggaatgacctagaattggacatacagttaatgagaaatacccttatgtgttactacgctgttttgctttgatcataggatgtgcagccatattgtagatggaactttgggatgttctcatcacagacttactctgctttcacctttgcataacctttgtcatataatcacttttccctgtaggagataatgacatagcagaggtcaagtcgacatggctggttcaatacagtcagatgaaccagtgttgtggatgaatgccggggttattttggaatcctttgt

SEQ ID NO: 106384 - DNA, 1487 bp, Homo sapiens
tctcctcctcaaagaggtcatctctaatgacattttaaccaacacacacacacacacagacacccatggcctgacaaacctgagcatcaggaatatcacatttaagtagtctgaatagtgtaataatgaaatgggtttagaaaggaagaatacagtgactcccatcatacaggaaaatctgagtctctcgattttgacaaggtaagagtggagatttcaaaaccaatagtattaactagccaatgatgcttacgtctcactcagcaggaggaatcttaagtcaagttggttgctaggcagagagctgaatgagtgacaggtattttcatcagggagtttccataaactctgtctcttctcagaacttctactgagcctacctcatttccagcccgaagcaaaaaaagataaaaatattaccagacccgctcttttccggttagcgcggcgtgagaagccatgagcagcagtctctcgcaacaccctgtacgaggcggtgcgggaagtcctgcaccggaaccagcgcaagcgccgcaagttcctggagacggtggagttgcagatcagcttgaagaactatgacccccagaaggacaagtgcttctcgggcaccgtcagacttaagtccactccccgccctaagttgtgtgtgtgtgtcctgggggaccagcagcactgtgacgaggctaaggccgtggatatcccccacatggacatcgaggcgctgaaaaaactcaaaaagaataaaaaactggtcaagaagctggccaagaagtatgatgcgtttttggcctcagagtctctgatcaagcagattccacgaatcctcggcccaggtctaaataaggcaggaaagttcccttccctgctcacacacaacgaaaacatggtggccaaagtgggtgaggtgaagtccacaatcaagttccaaatgaagaaggtgttatgtctggctgtagctgttggtcacgtgaagatgacagccgatgagcttgtgtataacattcacctggctgtcaacttcttggtgtcattgctcaagaaaaactggcagaatgtccgggccttatatatcgagagcaccatgggcaagccccagcgcctatattaaggcacatttgaataaattctattaccagttcaaaaaaaaaaaaaaaaaaaattccagacccaaaggcccaatttcttcctataaaaatgtcctaagagtcacctactactgaagatatcaacgcaactgtttcctacgtgcctcatttaatttcccagagccaccggacatagtttataagaataaatgtttttattccagaataaaaaagcagatgtgtatcccatctgccttaactgtgtcttcgggaggattctgtgtaatccttactctcagtgtttcacagaaatattgacttccggggaaaaaaagacttgcaagctgtgttaactcttctgtgttaatttgcagtctaaacatttttcatacaaagagc

SEQ ID NO: 106385 - DNA, 2618 bp, Homo sapiens
tatgtatgaccttggtcaagttaaagttctttctgttgttgaagcttcagtttgcttatccataaaagggccccattattgggatcactgtttgtactgcttggtggtgttttgcaaatcaactaagataatgtatatgaagtgcttagtgtactgcacttcttggcacaaagtaaaggttccttgtcaacgattcctaatattaataataataatttgtctggactttcctatagttttttttttttttgtaaaataagttggttctagtcagtcatcctcaaggactatgattctacgaagtcacccaatggtgttcatttgacacccttcctgtatccagtggggtgctgcctttgtctcattgtgggttttcctctcttccagcgttgacagaaggctacgttggggccctgcacgagaatagacacggcagcgcagtgcagatccgcaggcgcaaggcttcaggcgacccgtactgggcctactctggtaagtccagttgttctaatggagatcacacaggccagttaacatcccattcaactcacttgaaagcacactttgaatcacttttatgcctgagttctgtttgctcaaatctttcgtagttcactaaaagttgaaatattcgagcctgtttttcctcaaggttataagcaccttaatttatctctaccacctgtttcctcaacctgttttcccctcaatttgcgtttatttctgaactttactgttaatgagttattgtaccaaacttgtaattttctgaaagacgtagtcttgtcttttctgttttttcaggggctgtgatttcagagagcagaaaatatatggctagtcttgagctgctaaatgtctgctaaacattacaaacatcacatatcagaatgctctattaggctctaagccaagaaatgcaactttatttttaaatcacatcttgttctttgaatatattttagctgtctactcgatggtaatctgcagtccttttcatttttatttttacttttacccttttgagctaatgaagggagagagcattgttctaactatgttgaatgttacattgcaaataattttcttacattttaaggggacaaaaatgaagaccgaaaactagggatagacttttctggattaggcttcccaaaactcccaaaatatgagaggtggattgttatttctagaagagatttttgatgctcaaaaatatatggaaaatgtattaaagctaattaaggaatgcttgagtaagatagaccactttggaaattactttggcactgaataattcaaactccttctatgaaagagcttggaggcatggagtattagtcttaataataaatctatgtattatgcaatgttgttgcatatagaactgaaagtattcttttcataatgatgctcgggtttaaatcctgaatttctcccagcaaatcctgttaaatttatgccagtgtaaaatttataggtctgatctttaattataccttatctattggctttttgcatccttttgtctattgataaatctgctgcccctgcagggagaatatcctatctgttttgttttgcagtgaacagatagtgattctgaagttttccatcacacccagtaccttgtgattagaattatctaattagaggctttttgtcaccatttctgataaatgaaggaaattggcagatgaaagccaaaattacatatatatagcatcttgccaagaaacccaaagaaaatttatcattttgtactctgtggctctgacatcagtcaggaggaggcacaaagtggcttgctatttacagttcatcagtttagaataataatgctgttagtcaggaaattggaagttatatcccattagcatgtccaattgcaaatggcagtgaagagatgaaagcccttaaacttttcccattatgtagttaagaatgaccataagtggtgccatctttgtgatggagtgattgttgatgtctttaactttggtagagttcagaagtctccattttgtatttctggaatgcattgtgtctgaatttgggtattgcctccagtagtagaaggactaatggttcaaattcaagagttggcacactttttctgaaaagatccaggtaacaaacatcaaaagccatgtcgtctttgttgcaactgcccaactctgccattgtagcttaaaagtacccactgacaattctggacagactggctgtgctctgataaaaatttacttatgaatactggaatttgaattttataattttcatgtgtcaggaaatattcttcttttgatttttttctcattcattaaaaaatatacaaaccattcttgctttgcaggctgtgcaaaaacaggtggctggttggatagggtccacaggttatatagtttgtgaacccttgttccagttgatttttttcctagaaatcagataggagagtcatttgaggaattgcttggaaggatgtggactggtttggaagactgaatgaagtcatttgttaggcataatggaaaaaataagagtaaaagaagaatagaatgggacagatatcaactgatggtataaagttcttatgcttgcaacagttcttcctgaca

SEQ ID NO: 106386 - DNA, 1685 bp, Homo sapiens
taatatagcctgggtttttagcagatgttagtctggtataacttttcacttctcattttaagactagcctactttatttccacttcactgcatcaccttggaaaatgcagacaccttatttatttttgaaatgttaaactttacctttataggcctatcaaacaatgcctttgtgaatacctgtaattttagcatagagaactatttattgaggaacctggagatatgtattagagttctcttgtggtcactggaagatttgttgtttctctggatcttaaatttcatctgctagtaaaaaagggggacataatatctgattttgacatgaaaacatcatagaaggtatgaaatggaacataaatataagttattgttgacataataatagcaatgtaatttgatgattgatttatatctttggatttctttttccttgtaccaacatagtaggcaaaaatgggaatgagttaagtttcatatagaattgtactgaaaaaatgcagtagtttaatagtatctcattggaaataataaaacaatttcttttctattaattttactcagttaaagtatatttctgtctttcttgaggtgatggtagctcatgaattttggagtttgcccagaacttctataattattgcacaaagagtaacacatgctaggcaggtcatcaatgcaggaaagagaaatgaaaaataaatcataaatctagagtaacttcaagtagaaatttgagggttttttttttttttttggagattggatcttgctctttcacccaggctggagtgcagtgcctcgatctcagctcactgcaaccccccaaccccctgcttcctgagttcaagcaattctcacgcttcagcctctcaagtagctgggattataggtgtgcacaatcacactcccagctaatttgtgtatttttagtagagatggggtttcaccatgttggccaggctggtcttgaactcctgacctcaggtgatcggcctgtctcggcctcccaaagtgctgggattacaagtgtgagccaccacacccggccagaggcatttttatatataaagttattttctctcttgccactcaaagactagagaaaaacaggtggtagtttcttcccttcctctgcttttttttgttttaacttaattctgtttcatttttcacaattttaataatctctatctcattttcccctgtgtagaaatagcttctaagaatcagtacaaggagaccatttctcattgttagagaaacccagaattgaaataggcagtgaccaaaattccccgtaagacatttctggcattgggctgggtgaaggtcaagcaggattattctaagaggcattcctgccatagccaggggccatccatggtcctctccaactgtcctgggatttgaggaattgctcagctgtaaaatggagatggctttgaggattaaaggtaatatatattggcacctgtagtatgtactttttggcctccaccctggagtagagtaggtattacctgtgtggctcttcattatatgccacctcactacactgttcatataaacatcttgttttataacatgcatgtgtgtgtctgggcgtgtgtctcatttccccggctaagtgtagaatccttgaagacaaggattattgcttataattccttgtttctcct

SEQ ID NO: 106387 - DNA, 1584 bp, Homo sapiens
gccctttagagttcatgctctttgaacagaacctttgtctgtaattagtcattgtatttccctgttgctacctaaatgtttttggataggagggcttcaagatagagaacaaattgtagaataaactgtttcttcctacagatactatttttcttttatagttcatgtgtggttccaagggtagatggtgtaagaaaaaacacatatggtcacacactaatcagaactttatgtacaaaggagaaaaatgtgttgccatatgcttaaggtacctggagaatttttcaatacttggccaagtttgggaattgcctctccagtgtttgaaagacgttgttctctctacttagagttcttttcttattttttttaaactttcatccttggcacctgagttctaaagtttcttggcattttctctgtggaggtggtttcacaagtgattgtaaagttaatggatgctaatgcattaatatattatcagaggacatgaatacattccttaggggccttgtgaccattggaaaagtctagcagtaagatgaaatactgtttagtgctgtgttgttatcaagtggtacatatcagtggtaacaagatttcaattgttgctgtgatggggtatttaaaacatgggtaaatggaatactgagagtttgggttttaaagtgactctgaaggtagtggggtgatggatcctttttggaggagagctttttggcaatatctgtgaaaatgttaaatactgctcatctttcatccagcacttctgcttctcagaatttctctttctgaaacacgtgtgcatgtctccaaagtagcattgtgtttaacagcctaagtgaccaaaatagggacttgggtaattataatacatgcttacaatgaaatgcttacctgaacatccaccaaaatggaggaggttgaactacaggatgtattaaaataatatgggtaatatggtcccattaatgaataaagctgaagaatccagagactacacccaaaagttaattgcggttatcattgagaaatgagggatactaccttttaatacttatatttctataatattttaatattttatagaagcatatctagaatatttcaatttcttctaccagtagattcataattttttttaatgacctttttattttagagtagatggctaaatggtatcaaattcaggcagttttctttgtaacaattttgagggggagaaaaagaaaaaaacctaaaagggaagccagaaggaaagcaaaaacctttttgtctctttaattggctgtatctaaattttttaggtgaaacattgtcagtggcatttcatttttttataaaatgctgatatgaaccttgcagaaattaatgaactgatattgacttagtttgaaatgaacatcaagatttattgagcaaagcagtaaatattgacccagccaaagataaggtcaatatttactttgacatagcataaatcctaatattcattaatgtataaatttattgtgtcaacacaaggcatacagaagttgtatataaatatttttttcatatctgcgatgaatcagagtcaaacat

SEQ ID NO: 106388 - DNA, 1008 bp, Homo sapiens
tatatcatactttataatactttattggctgaaatttcccatgttgaaattatcttagtttattattattatttttgagccagagtttcactgtgttgcccaggctggagtgaagtggcacaatcttagttcactgcaacctctgcctcctgggttcaaacaattctcttgtctcagcctcctgagtagctgggactacaggcgtgcaccaccacgtctagctaatttttgtatattttagtagagacggggtttcaccatattggccaggctggtctcgaactcccgacctcaggtgatccgcccacctcagcctcccaaagtgccaccacgctcggcttcatgttgaaattatcaatttgagttgaactctcattctttatcttgtgccttctcttggtggggtggtcttggtagcagtaagaagaacgtaaggaggacccatttcactggattgtgaacttttagaattgccaatatgtagttggaataagtgtctaatatatgcttaaagactgaattttctcgctgttcatttaagcgaagaaagtaactcagtcacaagcttaagtataatcttgtccctatgcaatagtcttatatgatcctgttgtgctcagtccacctggcatgttctttgagtgtaaagtggtggtgttagtttcagtgtttggctgatcttgaaatgaccatcacttctctctctcagctggtaatctcctatgaccctgtttgagatcagctacctgaagggtggttatcttcttggttgtctttcttgctattaaaacttaactgtcctatgtttcgtttactttaaggcccattttctgttatgtaactgataacttgtgtaggttaaaaacttatcagtggtgtgtatataacatagaactttgccttcttgagaaatgctttctaataacttcaggaattctcacttttcattcatgtcactatagtatataataatgttttccactgcgtgtagtggctcacacctgtaat

SEQ ID NO: 106389 - DNA, 1293 bp, Homo sapiens
gggaaacaaagtgaggacctgtctctacaaaaaaattaaaaaattagctgggcatggtagctcacgcctgtaagtcccagctactcggaaggctgaggtgggaggatcgcctgaacccagtcaaggctggagtgaaccctgatcacaccactgcattcccagcctgcgtggcagagtgagaccctgtctcaaaaataataataataagaatactaacaatgtattccttgagtgtagtattcattggcatttttatgtcatgtgaaaaatgactctatgactctcctgtgatacaaatatttgactttcacataataaagtcatttcttcttgaggttttttttttttaaatcaaggagaaagtgagttttgtactaataggtctttaacatctctctgtcacttgctcatacctctttttatcaagaagagataggactgacctcagtctgctgggagagtatcttagaatttgatctcgtggatttcattataccctggtacccttcatgtctggcaagccatgttagttttccgttttgatgtgttacatttcctattaagtcatatttgagattttataaaaagtgggccagtttaaagaaaaattttatctaagcagtagtacagctggctttccaatatggcaaaataagtctttctgtaggagatatcaccattttggcaggattgaaaagcctcttgttttgtgccatataatcaaactatatctgtgatttgaaaaatgacaaagggtataataattcctagaattggttttaaaatgaaggaaaatagtatcctagttcaaaagttatggctcattgtaagtgctggtctggtataaccatacagattgtttaaaatctttaaataaatacttggcccaatcccttttgttccccctttctcgctgccctggaaactccttctcttattttgggaccttttaaaaatcctaccttagacctgtaaacccactctgtaccatctgctgtgactgattattatctctgatttgttaaatgatttaagtttcatttctgcttatcatgacttggagggaatttcagagtgataggcctgacttggtagggttttgggatatgtattatactctgcaacccattcctttgtttttttacattttattttaagttcaggggtacttgtacaggatgtgcaggtttgttacaaagggaaagtgcgcctggtgatttgctgcacctatcaacccatcacctgggtattaagcccagcatgcattagctattcttcctgatgctctccctc

SEQ ID NO: 106390 - DNA, 1802 bp, Homo sapiens
gaagtgaggaggcatgagggcatcctcataccagtcttcattcattgagtcattcagtaaaagtgtttatcaagcacaagccaggtggcaaactcagttcgagattagggctaactacaacagagaacaaaacatacacagttctattcctacctggtggaggtggacagagcagcatatacaaagtaacatgtagtatcatcacatcattctgtgaaataaagtgtaaagtgaggtggtgcctagagagggatttaggggagagagttgttattttagcctgggaagacctctctgatcaggtgatacttgagcagacatctgaacacagagggactgagccttgtggctatgtgaggtaagcattgcaggtagagggaagcgggggagataatagcacttggaaaggttcaatgttataccttaaactactctgtgaattttaattaggcctccttctagaaccttctggccctgtattcttgcttaggataaattttgcattgttctagagaagtagttctcaagtggggactctttcctttttgtggaatatctgacacagtctgcagacattttttggttgtgacaattggagatggttgggtggccaactggcatttagtgggtagaggaacaagatgctgttgaacatcctacaatgtacagaacagcccccacaataaagaattatctggacccaaatgccaatagtgccaagattgacgaaccctaaactgaaggctcaccagaatccatcgtttttacacagttggtctccatgctgctgtgaggttctacctttctagccagtccttaattgaatgagtacgtggcacaaacacagcaaggtgtgttgtgcacagtggctaaggtattagagaataaagtgagtgtcatggtgttcaatcatctttggagattaaagagtagaaatggaaagcttggcaagttgaccatttcagaaatctgtgcatgaaatcataaaggaatgaatcacacttctggtcgtggtgaaaagcctacctcgtaatgtcacatggaggtgatgaatgttgattgtgctgcagtaaagaggtggtgagattgcttttattattattgttttatttttgaggtctcttgtgactatgccatttgtcaactctttgatctaagaggccgttaggaaataatattcatcttagtattgctaaccatgaaggaccctaaaggatcagctggccaagcccctacagcaccctgagaaaatttatagttacccagttgtgaaccttgacatgtcacttcagggctggcagggaatagcagtttcttaaatgatcacttttcactaaaggagtggaaaggaaaccagagctgtgaatggtgattgacaggctaccgtgatccagctttttgtcaagtgtcagcaccttaatatttgataagggttacataaatgtagtagtaatggccacagatatcttccagaatagatttctcacttttttgtataaattaagcaaagctaccttgtgatggggtataaatgcatgtatatttatctacacgtgttatggtggcctgaattttccacagagcagatggctgtttgtactcatttgttcccaaaccctcttgtagatatttgagtataaagatagattcatgtggtcaccgcttctatggagctcaaaggctctctttctcttttctctattgaaacccaatttttattagcattgaaggccactgacgttgtaggttaaacataaaaacgtctaatatatctatctcaatactcctattgcaggtctacg

SEQ ID NO: 106391 - DNA, 1357 bp, Homo sapiens
attttgattctaacatctctaattgataatcacattttccagatttctatctatatattaaaggagtagatctggaatttcagctctctttagtagactgcattatagaaaggaaactttgttcgtatcacacatgtattatttaacaccattattaatgttaaaaaaaattttttttttttttcgtttaagacagtctcaccctgttgcccagattggagtgtggtgtcataatctctggtcactgcaacctccatctcctgagtttaagcaattctcctgtctcagcctccctagtagctgggattgcaggcatttgccaccatacccagctaatgtttattgtatttttagtagagatggtttttcaccatgttggccaggctggtctcaaactcctgatctcaaatgatctgcacaccttggcctcccaaagtgctgggattacaggcatgagccatcgcgcccagcccagccattgattattaaacatgttacttagaaagtagaattaggacaggagcactggctcaggcctgtaataccagcactttgggaggccgaggcaggcagatgacttgaggtcaggagttcgagaccatcccggccaacatggtgaaaccccatctctactaaaaatacaacaattagctgggcgtggtggtgcacgcctgtagtcccagctacttgagaggctgaggcaggagaattccttgaacctgagagacagaggttgcagtgagccgagattgcaccactgcactctagccttgtgacagcaagattccatctcaaaaaaaaaaaaaaaaagaaagtagaattatcaaactccatttttttaactaattttttatgttaaaaaaggcataccattttcttttactctcattttgtttttgcttattctagtacatgatgatttccttgtagtaaatagttttttctaattttccccatgtagacaaatccaaaatgcatacatgctcatttaaataatttgtccactggtaacctcagctgagcgctgcccttggcagaatatgttttacaggatattaaatgtgtttaaaatattctttcatattaattggttggcatttagatgtcttaagttgttttaataaattagggaaagctagaatataaaaggtagaaaatatatacattttcagtgttccaagacactttggtggactatagaatgctttaaatgcaagttaagatgaatgttttatatttggctgggcataatggctcatgcctataatctcagcactttgggaagccgaggtgggaggatcgcttgagcccaggagttcaagaccagcctaagcaacatagtgggatcccgtttgta

SEQ ID NO: 106392 - DNA, 2193 bp, Homo sapiens
aggaaaatagttgtgtgggggagggtgtgtttgcccagggaagaggggtatgggggaggagaaaggttgattctcctgagttggctcagtgtctactatcataatgatttccccacagctttatgagggctgtgctgctgttgtgaggtgtggtcacagggaaatttcagtctgaaagatgagttccacatgattcacacacctcctatgaagtagtaaaaggaaaaactatgccaatttacattagaagtattttcctttcttctttatttcttggaaatggagcatttgtgtatgaaagagttccttgggggataaaatgccatttagtttaatgtgatgacaatatgtatttaagtcaccatatgaaaatatttactagaaacaatgacatttgaatttatggacgtgaattttgcgtaataccttccttaagagggtgatgatatatgggagtgtgggatggttttctttcactgaatttgggattaatagaattgtcacccacaaatgtttgttttttttgtttttgtttccatatagggttttactctgtcgcccaggctggagtgcagtatactttggcccagtcatagcccactaaagccttgacctcctgggctcgtgattgttccacctcagcttcctgagtagctgagactacaggtgtgtgccaccacgcctggctaatttgttctttttcatagagatggagtctcactgtgttgcccaggctggcctcgaattcctggccttaagcgatcctcccagcttagccttgcaaagtggtgggattataaatgtgtgacaccacacttagatgcccactaatggtttggtgaaaggattaaaccccccaagaactgaattttcagtaataaggaattgaagattttagtcaagccagagcacacatgattgaacttcagcagtgagggtaccaaagaatattacatttggaaattaaattttaagagagaagaggaaaaaaactgggcgtagagagtatggggagagaataaaatatggtgaatatggtgatgtgattcttgaactgtccttttgtttttttctgactgtaaagagtagcacattccccaattagacaatcagaagtgttttcagatgttcccacctatcccctggggagtcaggggcagactcctttttggtagagaaccctctgctgtagaacgtgcaagaaataataataaatagtaatagtatggaagagtatagaattattacatggtaaaggtggctgtgatttttgacctgataagcttatttagccaattccagaagtttccttattgcaaagtgggcggattttaagtgttccttaccaattgttaaatgtggtgagatggattttatttcccttggattcgtgctatatctgccatggaaagcctgggtggtgttgattgtagctcagattgaaaatgacagccaggagttgcttagttaatggggtatatgttggtcctcaatttgtgcaattcattgtttaatgtgaatgaataatttagggatgaatgattgggttcatttttagacactggctaccttaacaggatgatagttgacagagcttcatgttatatttcctcacgtgaagagctaaagttgttgcccaggttaagtcaaaacattagacaaggtcataatgttaattatttgaatatgttaaactgctgaatatacatacgttggtgcaaaagtaattgcaatcttttgcaccaacttaatatatacacaagtgtatatatatttgtgtggtggtaggactaattacttaaataatttttctcaactttgcatatacttttttcttcctgcatttaatctagtttcatttggattatgtctagtttctgtggaagtagcttcataaataatttaaatgatctttgatttgagactgactcttaaaaatggaaattgcatttatctgggttagaattttatctaggattttaatttaatagctgttatttttactttcaaattcatattttaatacaattaaaagttgggttttttaatttggggacagacagcaagctgttttattttatttttgcctgccaaggaatgctttttccttgacacggacaagggtgctctttctttttctgttctagctctcctgtgtcttggacttcttaattctttctggtgggatttttc

SEQ ID NO: 106393 - DNA, 1481 bp, Homo sapiens
gaaaatctgccaagtttcttactctatgttcagctcaagtttgctctggcaccaaagaggagagaaacggggggttgcagaaaacagggggttgagagctttatctttttgtcctttactttcatctaaaaaaaaaaaactttctatgtaagtcaaaaggcatactaattttatatttcagtgtttctttgagtttcatttagaccatacaagctgaccatgacatatgacttctatgtgttcagtcacttaagatcatcaaatgcctagactttttatttgaaatctttggcatcccttctaacttgtgttttgcagttaaattactttggagatgagatagaaatctgaaccaaaaataattattgtaactatgcaactcttatttcctaccttggcttaatgtgttcctatgtgaactgtgtttgtttggaacaatttaaaaatatatctcctctcatcctttttctttcctgaaccatagtaggctttggtgagcagatatgaaaattgtgatgaccaggctgggcacagtggctcacacctataatcccaccactttgggaggctgaggtggcgggtcacctgaggtcaggatttcgagaccagcctggccaacatggtgaaaacctgtctctactaaaaatacaaaaattaaccaggcatggtggtaggcgcatgtaatcccagctactcaggaggctgaggcaggagaatcacttgaacctgagaggcggagggtgcagtgagccgagacgatgcctctgcactccagcctgggtgacagagtaagactctgtctaaaaaaaaaaaaaaaaaaaaaaaaagaatgaatgaatattgtgatgatctctgaatcatcttcatgttccttctttgccaattcccatcggggccaaccagggacaaactcaggacttcctgggaaattatacagttgagggagggcgttaagcagggaggtgtaaaatatgttcttggagactactttgtctaccagaatctgtgaagcactcgtttagtgttgaatgaggaatttaggaatgattggcctttgttgctgccaatcatggtgatgtgtgtataggattatcaaaatgtgttacaaatcaacctgctcattcacattactccttttccgtaatgtctaatttttgtatcattaatatttttatattttataaagtataaaatattaatattgattttcttattatagctgatcaatcagtggaaaaatgaataatgtaacctgctattcctttcccccaagcctactttcctgagatcatgattataatctttgtacatacactcttttctttttttaagcatttgcctttggtgacatcattctcttcacaatgtagagtagatatccatctgagtcaatacataaaaatccatgtttttaaaaataactgcatctgttctgcagtgtagatagaccatatgttattcaaacatttccttcatgatgg

SEQ ID NO: 106394 - DNA, 2042 bp, Homo sapiens
cagtatggggattttcagatttgattatttctaccacaacgaatgggagaaatgagtggaactccataataatatagactgaaaataagtgaattgatcaacaatgaaggaattgcttttagaggcaacatttgaaaagcaagaaagacaagataacatttgaaacattagatgttggtttgctgaacttaaaacaaaacatgcaggtgtctatcttaggaaatatgtgtgttatcggctggtgtagggtagggtggtggtaggtttgcagaggggttgaatgtatgcaataaattatttggaagagtgtgttattgatgcagtcaggtggaaattgttcagaaaaaaagtgacaaagaccatacaatgatagttaattactaattagaaatttagaagatgaaattttaccaggtagaatatttgagaaataaaagtgatctgttgcttgagctgaagaggaagaggaaagataaacgcctaactacagaccattggtagcaatgtaataataataaaagattccaatttgatagaaagaagtggtgaaaactttcagggatgctgtggatttggaagatcgatacatgtggccaaaataaaagacttttgggattggacatggttattggataaataataatgtattgagcatttcttttgtgtaaaagtgttttaggttagtaatgtcttttaattcctcctatcagtcctaagaggagagtatgattactgctgttattatatagctgtgaaaattgaggttcataaagaacttgtccaaagctcactgctgtatcctgagatctcaaaaaagagcctaggatgctgtgtatgcttagggaaaaaaaattgtcatgtaaataaaaaagttaaaaccttctcccccattgactttttttttttttgagacagagtcttactctgtcacccaggctggagtacagtggtgtgatcttggctcaccacaacctccgtcccccgtgttcaagcaattctcctgcctcagcctcccaactagctgggattacaggcgtgcaccaccacgcgtggctaatttttgtgtttttaatagagatggggtttcaccacattggccaggttggtctgaaactcctgaccttgggtgatccaaccgcctcagcctcccaaagtgctaggataacaggtgtgagccactgtgccagcccagactttttcattcattccaggcttagagagtatctaagagactacagtcctttcccaaagttgaccgcatagaacacagcaaagcatgacattgaagaaagattttgtcaaaaatcgagttaattctcaagtacaaagtgcagatgagtttgatgactgaggggttcccagaatgggagacattcatgctactctggccagcacaccgggaatgtgtgcctgggaccaggagtagtagttattcatttatatgcattcagctaatcatttttgcagacgattgcatgaatataagtaccccatttggagtttgcttgctggcacttgaaaatttggctgtcttatatatacgaaatgtgagagttggtactggaactgttgcataagagtccaaatagtttacaaatgcagtgagatcaattgcagcctaaccagagtagcaccagaggacaagaaggccacaaagactctggcaacttcagttggatgcaaatttcaagtctgttccagtttgttttctgtttaaaaggctggatgtgtcttgcacactctcttgggagatttcaaagttaaaattattgttttataattagcatcaatataatcgacttgagaggaatgttgcatggattagtgcatgcaggcagcagggagtgaaggatgcttgcctaccggtgtctctgcttcattcctcatccacatatggctattgagcagcttctcgggttgttaagaaaacacagccttgaaaaggttattagttaaaacaagatgggaatggacgactgagtgacccagagattggactgtgtttgaccttttcccaaagtggagaatgtattcttttgtaa

SEQ ID NO: 106395 - DNA, 2154 bp, Homo sapiens
tcattgcattggtcaggttggtctgacccctcccacatctccaggtttgtatctagaatgttagcatcaagagtgagtgggagcgtaaagaatactgtttgctaagggaatggaactgctggccaatccagaagtctttggtcagtttatttctttgggtgagtgagacctatgagcttgacttacttccttaaaggttagatgatttttttgaccccaagttctcatttttattggaataaaaaaattagttgtatcgcatagattaaaatcaacacaggcgctttcccctgctgtgcgaaacactctttgaaatcccaggtgtcactttatgcttatggtaagaacccgtttgtgtctgttgttaattattttctcttggtcagaccagttccccagcctcagaaaatttcagaggagaaagtacatccatagtgaactgggaaagtactttctgtcctagaacttattagggcggcacctagtttactacacaagaaattctatccttttaactggaacatctgggttcttaatgctctctgcttgcaattatctgtagccttatattttgccacggtctgtcttgtcattcttgaacattctccatctgaatgctaatttgcacacattctgtaattgtgtgtaactgtgcttcttcttgtgtattaaagtcctccctgtctttaagagtaacttaaaaactacttctttgcctaagtgttgccagattttttattttgctccaccccttaatttgaattaattattgcacgcctgtataactttacttactatttctgcactgaactgtagctaactattgactggtatgttttctttgcatactggtttgtgaaatttgtgggggtcgaggttcaagtctcattcctctttgaatctttcctgggcctagatcagtactgcatatgaagttctcaaataaatatttgaagcatttcgttgaattgtgtgtctctggaatatcagaaatgacatttctcttagtcaatacctaataaaattttactcggtagctttattttttaaagatccatacaagtgctgtccaacagaagtttctacaatgatggcaatgttctatgctgtgctgtctaacacagcagctacttgccacatgtgaccatggagcacttgaaatattgccagtatggctgaggaactgaattttgaattaaattaaatttaaatttaaatagccacatgtggctagtggctaccatattgtacagcaaaggcagagaaataagctttcaatcttgatcttttcctctttcatttcagcaatctttattaagcacctattaggtggcaatacattttctaggccctgggaataccaagatgcattggttaattccaggactgagacaactgtcacggtactgcagagagatcaacaggatcctatcattcattaacacaggacagtaaatgcagtgctgttagggttagcagggaatcggagacatttagaaaagagtggtgtaaagccagggatcattttcagccaaaaccgtggaaatccgggaagacttttaaagaggtcaaggagggtatcacacaggaggattacgtgacaagaacatattttatgggccctcagtggggaggccatttgtggttgatctgtttctagataacgtgaaacatggcagagggtaatcacatcatctgttcaccatatttttattctgaagaaagtctcccataataaaagacagagtgaagtcctattactttgtccatttatttgactctaagccctgacattgttaaatttccagagtttcagataccaagtgtatttagcttatagttggttcttcagtgcctagtacaatacgtgccattcactcattcattcattcatgtaacaggatacttggaggcctgccccatgccaagcactgtggctccactggaggttgtaacccattttgttattggtagagggtctcaactgcaagttatccaggttcttggtgttttgatcaaagaattggacaaaacgctcagaaaagtgaggaaaagaacgaaggaatgaaagctgagatttattgaaaatgaaagtatactttacagggtgggagcggcaggggctcaagggctcctgttatagaatctcatggg

SEQ ID NO: 106396 - DNA, 1527 bp, Homo sapiens
aagttacaaagctgcactcctatgcaaacgtctgattgggtggggaaaagcaactaatcagagatactttcaattttccatctgctatgcagaaaacttgggatgggggtgggtttgcaaagggagtagcttctggtcctcttgttacttaggcccggaacgttggggtttttcttttgattttgttctaggaagtcagtgtgaatcagccttaggttccctgcccccagaccctattctcctgcctcaacttggtccctgctactatcctgagacccatcttagttggcctgtcaggtgagaaactagtgaacacatcaatagatagtactgacctactgtagccttgaaggagtgaaggatctcagatagataacagcagcaggattgattttaggcaatggtgaggggaaggtctcccagtcatgtgatgagtcagggaaagaattccaggcagagggaccaacaagtatcaggaccacgtggtgggaaaagcacatggtttgttctagcatctgagtgcagaccctggaagcaaagcaaagtgagagagagaggaatagtgtgacaatgaggtctgagagggagggaaggaggaaggaaggagctggatcctgcagagtcatgtaggatgcattaaagacaataaaatcctaaggatgatgaaaaataatcatttcaggaggatttacacacacacagacacacacacacgttctaagggagggaagtttgcaaaattttagtttacctttgaagttactgaacacttctcatggtcagtcatgttgctcttttgagatacctcattttggccatagattaaaatgcattaagaagctgcacagagttgtacattctcctgagagtgcttgaagctgagcaaactggggaaacatcagatgaatcctcggggaggaaaaagtggaagatataatgctatacaagtaggttttgactcccaagtctaattttaagagtaagcccccctatgagtggcagtaattggctggaagagtgtgattgcttctaattgccttcctaatgacacgtggcagtgttgggagctgcaggcttggtgcctggcactgtacatcacagatgacttgaccccggggagatagggctaaaatatctccctaaggtgagcctttttttgcagtcctccagtcagtgaagatggagggatgtaggttatgtgaatggtcctttaggcattttaggtaggcatgttccacctcagagggtagatatcctaccaaacctttcagctttaggaagattagcttcttaaattttcatattttagctcttgtttagtaatcagtggagtattccaagaagtttatgttgcatagatgctgttaatatcccacccacattttcttattttcaagcacttatatttttattttttgcatgctgacctgctgtcctcctgctggcacttgcaactctttccccaagggctctatggggccacagatgacatgttgccatccagaagggctgggggaatccatgtcc

SEQ ID NO: 106397 - DNA, 1022 bp, Homo sapiens
acatgaccattgcaacctcattgaatgggtataatccccagatctaagtggagatactttgtgggttgttattttgtgcagctactttaaaatattgggaaacaccactgttgagctccactgtgactttgagacctttaaggccaaggggcaaggtactttatatttccatcttcctttggcttgcattaaacttgcttaaagatgagcttactctagtgtagttatctcttctactgtctcctcaatgtcagatgttgtttattttccaaggtatcacttggctaatttgacaaaccaatcagtgctaatttaataatagatgaagacaatgctttattcatcaatttagtcgtgtgttaaatcggtcagtaaattgagtgtgaaccatcagccaggctgatgaaccctgccttcacaaaacttggtatgaaagacagacattggacatataatttcactaatctttgattttaaaatgtcatgtgtataaagacgtctggtgtacagctaaacaaaagtgctaggtgagccagaaactgtgaagttttaaggacaagagtaattgattttgttaattgaggcagagtgctctgatgaaacaagggctgaaagagaaaactgaagacgaatgtttaacctagttgacctggcgcattttagaacccttcgttttaagctgaaggttatgatatgctctttcattcatggtaataattgcttgagtctggatgagtatcgtgttttgttttgttttgttttgttttttaaatagagctagggtctcattctgttgcccaggttggagtgcagtggtacagtcatagcttactgaagcctcaaactcctgggctcaagtgatcctcctgccttagcctcctaagtaattgggactacaggtgtgtacaaccatacctggctaattaaaacaaattttttttaagagatggggactcactatgttgtccaggctggtctaaaactccttgcctcaagcaatcctcctgcctcagcctcctaaa

SEQ ID NO: 106398 - DNA, 3572 bp, Homo sapiens
tgagtattccatttgtaattcactttttaaaatatatttcaacatggcaagaccctgtctccactaaaaataaaaattagttggacatggtagcatgtgcctatagtcctagctaattgggaggctgcggtgggaggattgcttgagcccaggaggttgaggcagcaatgagctgtgtttgcaccactgcactccaacctgggtgacagagtgagacccgtgtcaaaagaaaaaagtgtatttattgattatctgcttcatgccaagcattcctaggaactaaaatacttaaagagtgttcattgtatttagggttgagtagatatagatgccagttcacacagtatcaccatgtgataactacaataatgcagaaatgcattggttgctataggaaccagctataatgtgtcctagggtgtggcttggtggacagggaagatgtctgtgtgtctgggtgatatgtgtgctgtggttgaggagggttgagatggtgtgtgctgcgggttgagattgacgttgagttggggtgggagtggggagctggcagcagcatgtttggtgcagtagagaaagtatgaacaaggggtggaagccaggactagcatagctcatgctgggtggagggccacagtgaggtcctaagccctggaaggaatgtgaaggcaggcactggagacagatgaacttgggttgcatatcggggccttgtcgtggagagccttcatgccaagttttggactctaaagtggagacatgacagggatctgtgcagtgattgactgagttaattggaggtgctagctggatgtactgttggaaaagttcatctggccattgggcatttgaacctgagcatgggatggggtcagaggtttgggattagcttagatgactgaaggaaaattatagagcaatatcccctgagaaacaccaatattaaagaagctgaaaaaccaagaggaacctgcatagagaaggctaggaatggtgaaaactacactgtggacctaagagcagtgggtgagccagaaactgctgcagaatttggaaggaggtgaataattggtgatgtcagcggggccacactcacaggagcctgccatcctattcccagcagctgatctgaagggcaaggctacatgctgagtggcagtggggttgggggacggggttaggtgatgttggattgagcgagaagcagccgtcatttaactaatgattttcccttccttcatttttttcagatacttatttcttaatgcacaccataatatgtaaatatttttgattctataaagacatagttttaacctaattgggtgggggagagagtttgtgtgagtgagtcaaatgaatcatagagtttattcctggaatgagtacggactgtggttgaggatgttgagggtaagttagcagctgacatctgtgtttcactttaagcttccacaagacttaagccagatctagttagctgatcatctgcatagttgttctttaagttgggtatgcataacgctggtagattaggagcttgataatttcattaagtgatcatgatctatttcttctgcctttccatttttacatgtagaagcaaatatcgttaccaaccaaaatgacccatttgctctcattatgaattacaattcttttaaagaatttagtatgcatatccttgaccttttttgaaattaaaaattatcttgaaaatttacctctccgtctgtaatttctgtggtgtgctcaagaacagcttaatagtctgaaaacggatgaatttaaaattagagagttgaaggtcgtaacccagcagtgataactcagctaatgaaatattcatttccaagtacgaagtggcactgtatatcaatatgttgtcactgtctgtcatcattacgtagagcacaggtatatttatgcatttataaatagctaagggaaaaaagaggctaattacatgcagaaatgctacagaaatttccgtggctgtgcttctaacaggcaactgctaaccatttttccaagccacgtttgtgaattaagtataggttctgcacattaacctctgccgtatttggtttttagaatgatgctcttagggggaggacaattcaggagatatacatactttttaaggtcatgtccacactagggatttgtttatacaaatgtaaaatgaaacgtgcaatttagcacctatctagaaaaattaaaccgaaaactgtttggtttgaaaaatctagaacattgtagaagagagatatatttatataattagcatcaccaattaagaatgaattgactttagcaaaaatcaatgtaattatctagataattcaggctaattaaagaccttcccaaatccttagatcttcattagctgcatgcttctggtaaaagcagatttttggggtgtcacattagctttatattttgcatcagtcttgctctattctgctgccgtagacctggcttcaaatgatagtgcccacttgataaacagatgttgttcaggagaaaataaaataggaaatataaaatattctgtgtcgaattgaaagcatgagggtcctcatgttcttagaatcttcttagaaatacagtataaaatctttatatacagatacacattgacaacaatagagaactcataagcagttacctgagcagggttgaacatataggtagggtcatgatgataatacactaatgaacagcctgccttacacacatgcctccaatacacagacacatacacacttagcttagggaagtagggccacttctctcctgtttgttcttttccttggattcctatacttccctgggcctgtcagtaaccatcccttctccccagtcacactttttctgtagtcccctctctaaacaggaagcgacaactactaattagacttataaataaaagccaccttaaatgaacatcatgtgtaggtttcccaagttatacgtgcctctggcctttttctcatcatttactatggaaataaagacaaacaaacatattttcccccataatctttggagggtagagtaggtagtgtcagatgtgcctgttatggtggttgttcagaaattaaaagagggcaatttgcattggccaatggacactttagcttctaaaaaattcattttattcttcttctttgattattcctagcttttaatctgagtaaaggacatagattgtggcttggccttacttcatggcatgggaagcacatgatacgaataaacttgacttagtactgtatttggccgtggcttgacttgataccttgagcctcatgagttatttcatcagttggtcgctagttatggttctttatctttcaagggccttaacaaaaatttttaaagagccaggctggttatcgtaactattataggaattcaagggtggttggagagtcaacgtagcgaagagttagaaaagaggaaagaaatccacccccagactgggtatgtatcattgatagtgtcagaaacaggcaggagtattatttttggagaaaagacctacttttacctttgtgcttctattttta

SEQ ID NO: 106399 - DNA, 3641 bp, Homo sapiens
tttattgacttgatgggctgtaaaacagtttccgtttattacgggaattaccttcttaggtagacatttgtgaacatgacggctttagtgatacccctcgttacccagtggagtcctgttaaaattcctgaaattaggccatttattccctcaaggatatcgtctccagtggtgtctttttttcttgaagatggctcccgctatctcagacaaacttgtgagtttgtctgaggaaaataaaggatttgtagcagtattcaaaatgttcccagtttgacagtagctcccagttagagaggctcctgctgcttgtgtctacctgtcctcaaaggacacacggccaacttctttccttttcccagtttaaaagtgatttactcccatggttgagactggttttcagcatcaacgtgtgctgcatggcgtcttctaagtatcaaagcagagattcacttttcatttctgggtatttggaagatgatcaggtgcctaggactattagatgtataataaatatgtttcacttctcaaccagagtacacagggttacagagggaactaattttattgagttatcaaaatattaaaatttgtgattggcaatgcgtgaacattttattaacacattacaagatctactagcacgtataacaactatcataatattaaagttgtcatgaatgcctgtgacattttgagatacctgcagcaactgtaatgtgagtgatttctcacaatgacaaattctcaaatattgctaatagtactgtggattttcctacattggtaaattgaaggaattgctaaatgctgaattcagcaaccagtttgagattgttgaaaataaagattgtttctttttcaatgcaagttcacagatcactggagttctagctacagtttgttctagaccagaggttgcagatatttttgtcctataaagagacacatggttaatatttttggctttgtgagttgtatagttttcgttgtagctgttcagctctgctacatgaaagcaaccatagaccataccttaacaagtggtcacttttgagtaccaataaaactttatttagaaataacagagggctggatttggtcctagtttgctgaacccttttctagatgaaggctcctcttgccaagactggctccctaccttggctgacaaattctcactttgggacttagtcattgttgctgctctctgttattttgcatgtcttttctcatgtttaggtgctgtgtcttaatacttttttcttacatttaatttaacaatcattactgagcgctggtatgtctagtttcttttctcttctttcctccttttcttttctttttttctttttctttatttgaaggctctcactctgtcacccacactggaatgcagtagcaggatctcagctcactgtagccttgatgtctcgggctcaggtgatcctcccatctcaacctcttgagtagcaggaacaatgagtgcatgccacaatgcctggctcattttttaaaattttttgtagagacggggtctccctgtgttgcccaggctggtctcagactcttggtcctgatctcaagtgatcctccagcctcagcctctcaaagtgttaggattacaggcatgagctactgtgcctagcctctagtttcttataatacagagatgattaagacatacttcttgcccttacagaaattcatactagttgaatagaccaacacacagatgggtaagtgtaaatatagtgttataattgctacagtagtgcagcataaagtgttgctggaacaatgaggacaaaaataacgtattcctccctcatgggacttttcagtactttgcattcagtactttatatggatagtgttcctttctttccatgacctgatatatctaaagatcaatgtgtctgtatttaagtaagtattttatttgaaaaggatgaagagttctgaaaccctaagtgtttgtatatggtaatggaagtttattcacaggtaatgataacttactgctttggaggtactttgtttcacgagttgattgttatttgaggcttctgttgtaagtgaggtgagataaaaaataatgcctaaaacctagtcctctaatctggggacagtaaattttgtgcatggagtgaatttccataactggcatatcctgtcctggttgagatcttgtgcatcacatgatttagtgcttcattttcagcagctgtttcctggtaccatcagggtcggcatggccgtgggattcagctgatgtgcttattccagtgggtggtttctccctgtgttgcagagttcacaggctgtacctagctcagtggagtagactggtgtgatcacttagccgtgtctgtcatgggcagtggagtacagagggtggttgccctctctccatttcacacttgtactggaggaaccctgaggctagatggtttttctgttaatttagaaaatctttgtcccctaatgttgctggacttgctggggtggtgaaccattcgagttgttgccttctcttctccgtctgtcccttccttaagcacagagtacttcgggaacaccatcttgtcttcatcactatcttgggcatctatttattacaaacttggaattgaacaaaaatgttttagtccagtggtttggattaaaatcaaagttcataacaaaactcagaccatgttctattttactgaaaacatcaatagtgagtgtactagagcttttggagttagaaaaagaaccatggaaagcagagttgctgctgatgtgttttgcttcttggctaagtttgtgtataagtttatagatgtatactttccctatgtatacacatgaggaagtactaaagcagaactttatagctatttactttacccttggtttcacaaatagcttcactgaaacattacaagagaaattctcagtctcagaatccctttcatttcagaaattctttgacttctgtgatttttttttttttttggtttggtaatttttcctgaaattcagttattcactttgtgatttaattatttcatctaggaaaatatgtcgaataagtcattcatctctgacataggtaggtacaaggattgatttgttgatacttttttgaatatcaataagattaaagtatatataaaatctgagtttttgatctgttgtatgttagcaaggatatttgtaattaaaatgaattatcagtcagcacctcctttttccttttactgtggttaaggtaaagatgtcggttaacagtttaaaacaatagtctaatcaatggttgccgtgttgctaaattattaatgaaacagggaagaagtatggtataatttttattatttgacttgacttctgcacctgtttttatgtataattgatcctaagctattagagctgaagctttgagaatagttttgagaagcaagaaactgtcctttcttagtgggctggaaaaacaaagtcagcatttatctcaggtatttacaatgtattgtttcttagatttgtcatttaggcttactcccacagagtctgggaaataagtttctgttgcaacggtttcttgaggcatgctgttccagcctttgagtcaaacttaccaagtgactttaggaacc

SEQ ID NO: 106400 - DNA, 1014 bp, Homo sapiens
ttgtagaaacttgccctgcagcaaagattattgatatgttttcctcttacatgactcaaaaccaaaaaggaatgtaataaataacggctgtgactcctggagtgattaaagagcactcaggagccaggagagctgatagctgccagctccagagcctgagtgggcagaacttggttccttgagacagcagctgcctaggaaggacaaagtctgcatgacgctctgtggtgctttgtgtgcaagttgaccattgtggcaaggtcataggatagcatggtggggagggggttgcccctttgtgtttgttgcccgcacctttgcccttgtgtgcaggattctctctgcttccttttgtggatgaatccttctgactttttaggtcatagattttgtgttgattcttaagtgtggcctctacagaggtcgtttgccccttaatatgtttatattgttgctgttaactttattgtttttgtctgtcttaccagacacaaggcaagattttgtttctctcttcactctcttttctggcttaacccaagacctggtggtggcacatactaaccactccaaaatttttagaggctgaatgccagctgttggcttaatccatatgttttcatgaaaccattgtgttcatctgttttctcccgggtgaagggttagttgttggattcagctttatatatttggaaataagaaatcaagtgagggactgtaggaaaacgtagagcagctcctggttttgcgaggttgttagaggccagccggcacagaaatgttcgtattcttcccaggagctaagatattcatcatgagctctttgagccaggtttccatcatctgtgaaatacagaaatgatgcttactgtgttctagctccccttaaggattaaaccatttaacagatctcactgatgcagaaatttcttcttcacattttaatatctctgaaatcggaatatacttttcattgaataatgtttgaaaattgttggatttttttcccccata

SEQ ID NO: 106401 - DNA, 3171 bp, Homo sapiens
gagtagagttgtaaagccaagtcctgagtttgtatgctggtgttagatcatgctgactgcccggagtgtggtgtggagaaggagacttgacagtgccctcagtttcccctcctgggttacctgatcctcaactctaatttttaatgtcaaaaagaaggaaagatgaaggagggacgaaaagagtgggagagaaggagaaaaaaatgaaaaaaacaagaaggatgaggatgaaatttttaaaaaaccaggtcaatggactattcttcccagcataaaattaaagaaggcagagagatacttgagtctgcctgctgaatccaagcatgtagtaatactgttgagacagttatggttgaataattttttcttcattcttaaaatgctcgtctgcattttaatacagacaattgcataaattatctcttataggaataaactctctttccacaaagattaaccctgcccagtatcatggggagcttttaaagagtttattagctgtgatataggaaataaacacttcagatgattgtggaaagaaaatagatacaactgtagctataaatgctaaaataccaactcagcatgttaggatcccttccccaacacacacttcaccactatgtaggttcccaccaaaatcccgtatgtgacagtaaatgacaactagttaattcttttggtaggttaagaagggcttttagggtatggacagtaatatcaggcatgaaattactttatcagtgtaatgtttatcagaatcacttgccaactcactatgcttcctctgagacttatatccaaaacatttccctgaaaggaataaaaattttttcacagtcactttgcattttaaagagtctgttctttaccacctcatcaggcattcaaagtgctgttgttgttgctgctggtttttttttttttttttttaaaccctttgagttattttgaatcttttcacttttacctttggaagggacccttagtgaaggtcttgtcttttcatctgtagcatcttccaataaaagttggctcaacaacagcccatctgataactcaagagtcggagacaagggcttgactagtgaatgaaatgttctgcttttgtggataagcagcaagtagaaaaggaaggtcagtggaacagaccagaggcatggtgagtctttggcctcctgttgatggggtagagctgtgcggtacagagccagccttccgttcctgagcagagttctcgtcattactagaacctgaaaccttgagggtttcttggtctttttcaccttctctccacctgttagggacataaacattaaaaatttttttttattttaaaatagtttttgatttatagaactctactattttcataatagtgttatgaaatactattatgataattgcatgaattatctcttacaggaataaactgtctttccaatagtagtatgaaattctattatgaaaataaagagttcccatataccccaaatccagttttttctattgttaaccatttacattaggttggtacatttatcaccagtaaagaaccaaaattaatacattttgattaaagttcatacttaatctgtgcagtacaaagccagccttcccttcctgagtagagttctcgtcattactagaaccagaaaccttggctattcagatggccttatttctacctaatgtcttttctgttccaagatcccatacaggatgccacattgcatctagtcatcatgtctctttaggttctgctggactgcgacagtttctcagactttccttgttcttaatgaccttggcaatgttgagtactggtcacatatttcatagaatgtccttcaatttggatttacctaaagttttcctcataattacatggggcttataggttttggggtagaagataacacaggtaaagtgccattttgatcacaacctatcaaaggtacttgttttcaacacaatttatgaccttgatctcctggactgagttggtatttgttagatttctccactgtaagtttgccccccaccatactgtactccttgtaacaaagtcactatgtgcagctcacactttaggaggtgggagttattcactaaccccttgagagtgtggacataacatttttccccagaacagtaagtgtatttattttattgttcaaggggttgaattctgaatttggaagatgctgtactatcacagttaagagtatggacactaaagccagactagggtgggtgtgaattccaaccctgctaacttcctagctgtgtacctggaaggtaatttaaactctctctgcctcactttcttcatctatcatatggatctaacaatggaaatagagtgaaaaataaagactctgtggtacaatgcttagaccagtgcctggaaaattgtaattactgaataaatattgtgtgactgtgtccatcagctcgttgtggggtgggagggtaggatggtgacagatatattactggttttaagctgatttggtatgttttttcatagagccagtgttctagaaggtggtaggttttccaggtgagttgaagacaggtgacatgttattacagctccaatttcaaaaataaagacagaaaacacaaaaaaaattctttgggtcaaaaataccctgagcactagtagaggataaagagtttttacttgaagtttagtaggtacaagaacttggagagtttcccaaggaggcttctcggtgccttggctgggttagagattgttgctagttcttgatggcgtccaagttacctccatgccagagacttccgtatgaggttggcacaatccctagtctgatttctcaggattagtgtttcaagttgggtgaagaaagtcatgtttcctgaggtaataggtgtggagaaagaagggtgttccgtggtggggacagaactgtgcacggtactctgtttttttttttttgttcttgttgcccaggctggagtgcagtggcatgatctcggcttactgcaacctctgcctcctgggttcaagtgattctcctgcctcagcctcccgagtagctgggattacaggcacccgccaccacgcccagctaatttttgtacttttagtagagatagggtttcgccatgtttgtcaggctggtctcgaactctggacct

SEQ ID NO: 106402 - DNA, 1034 bp, Homo sapiens
aggcaggagaatcacttgaacccgggatgtggaggttgcagtgagctgagattgcaccattgcactccagcctggccaacagagcaagactccatctcaaaaaaaaaaaaaaaagactcagtgtttcaggtcatgtcagttgcatcctaactagctccattatttgtgcagctggttatcttagcaccaagatacatgctgcaccctaccctacagtctgtttaggaccttaaatcaatttttaaaaatggaaattatcagtaatatacaaaagtaggaggagtaggagaatgagccctggtgtagtcattgccagtttgggtggaacttttaaaaatcaccagttcatgatttgaatagggaaggtgtgaccactgagacgagaaccagcattattttccagagatggcaaaatagagcttgagaagctggccaaagagaagatgaaatgaatgctggttgcacagtgttcagtatgtagacatcaagggattctggccctgttagatatgttagaggaaaggtttgtttaacattaatacaatgtgctacaggggaagtgttgtcaaacagttatgccggtttcttaggtaaagttggccagtattcttcttgcaggcctagtttgcttcatcattaggataactgtatgcattctcattggagcctattatccagatataattgttaattatgtccattctttcattctcaaaattgatttggtttggaccatttatcagtcctgggtagaaatgcacattttctgactttctgactgtctgtctctgtggagagcctctttgtatgacaccagctctgcagcaggagtgcttgtgcacatggccattatgagaaggccagttagatttcaggagtcatggggactgtgaggacctggaatacccatgcccagtataaaggtaattcaagttcagatctgtgcaaaacccacgctggatgcaaaaacacatttgctggccaaattcagatcacaggcacctggtaggttcatcttcttctttatagggaac

SEQ ID NO: 106403 - DNA, 6204 bp, Homo sapiens
catcatttcaacctgcaatcgataaaaaaaattattagtgaaatattttacattcttttttttcctgcgaagtctttgaaatctgatgtgtattatactctgtaagcccatcccatttcttactaagggacattgcaattgcttaattggccatatgtgcctggtagccattgttttggacaacatggttcatgttgtccatgttgtccaacatggacaacatgtaatgcctcaaacattctgctaagcacactgcaacccacagtactatttcaacttatgttcacgttttactgcatacttgatgagttattttttcccccaaaggatttttgttgttgttgttgcttcctgaatgttgcacttttacaataaaacaatgttgaaatgtgaatgtctggtggttggctgggctctctcactgggtgacacaccaccatatactagctttcaggtgctcaaaagtaatttcttcctcaagagattgaaaaatacctatttgtcatgggtcttctgggtctgttagaataattaccaagtatttggatagttaaaagttgcaacgctagggtcttttatacttgctctaggacatagttgtcaggtatgaaaaatttaccatggcaagatccatttgttgtattaatcactacctttcccttagagttgatttatggttcagagggatattctggaaaatgcttagatcaaacaagaccacattcattcatggagaaagagtggaatgcaggttcgtagtaaagaaaaataatttccagggctcctgggaaaaagctttggtcacttaaatgcccttgggctttctgtaagtaaacatctgcagtcctctctattggttttctagcatatttcacacaaaagcaggggagcagagtagtgttaattaccctgagccaagtcagtattaatctcaggtctccattgttgtttaagattgatggataaagatgtgactgcccagaactacctttgttctcttactggaaagatgtggacttggaggggcaatctggagttaatagtcagaactagattgtatcctccttactgggatgtgagctctgtcacctgagtaaccaatttctttgtaaagggatgtaatctcaaatcttagctttcaagctgccaggcttggtttgcttttatatccccaaatggaaccggaaccttctttattccaatggtacattgtggtagactgtattcggcaaccttttgtatgaaagggttaacatagatctgtctcatcagtgtctttctgtttaaggatagcataaaagtgctgattgttaacttcacttggtcctatgcttattctttatttttactgtaggatttactttttcttttcctgtgtctttctctctccaaaaaaaaaaaaaaaataaaatctaccttgatgtgtcaaagagataaagaagatgttataaacattaaacaaaagttcacgtttctgtttctttgtgcccccggtcccccttttaaaaataggcctcacagcatcaggcatttgccagtgcagcagttttgaagcataggatttttccccttcctgatgtataaatgccagctctcttcccccctttgcagacacaggcattttcctcttttgagttttagttttatgatagcacattacaaagagtttgacagatcctttaagatgaagatctgttgatgtacttcctgtttatggtggctcccagcttcactggtgatgaggacacaggcgcctgaaacccagaggcagggtggatctgcaccacttctctgaccttgccagggctgaccttcatcattctaagggaactttttttctttttttcccctccctaagcagtggttctcaatttggggctattttactccagaaggggcttttggcaatgtttggagacatttttggttgttacagcaagacttggagctaccagcctctagtgggtagaggccaaggatgctgctgaacattctacaatgcactggactgtccccacaaaagaatgttctgtcctgaattgttgatagtgccaaggttaagaaaccctcccataagggatgttttctaggcttaaacagtggcctgtatgtgtctttctccttatttctttatttcaagaaaagaaaaacgctgccaaagcaaaagccatgcagtatgttcataataaattaccttttaaaacaaatcccaggcctactcttcccgaaaatgggaaagacaaaaaaaaaaaaaaaaaaaaatcaaagtgccccatggcacaagttatccactgatgacatttccctctgaggactgttttctgggttagggtaattaccacaacccagaaggtcatggagtctaagttaaagggcgtcactgattcagctctcagatgagccaccccactgggatgtatgatggtataaactgcaattaaatcttgtgctgtatttactgtgtgattggaaggacagaagggagatttccctttagtcattcttacctagagcaaaactcatgtttttttagtgtaatgtgatttcttgagaatggtagatgttagtgaagtggggcagggagatggatttacaaatcttggagtttgcaaaatatgacttgaccttttgttcttatgttgtgggctgtgttttctattaagctctcgatcatattctctctttgccatttaagaaaaatacagcacaaacctctgtcagattttagtatatggtgacctaatttggtgggatgattgctaaagttctggaacaggccctttgtagctgatttttgttgaattgataagcatcgaatatactaaatataattttttgtgcctaggtctcttccaaaacttgcataccatttttagcctgaactcagtgttatcattttggtcttttaaagtggagggagggggagagggagaatccaattatagcaagcctgacttgattgaatgatcttagaatgaaccttgtgggaaataatgtgttggcgagaaagaaagttgagtttctaaagttacagaatctgtagatctgttacacaagtgcatgtaggtaaagcctccctggaatgattcaaaaggtagttgtaatggatgggttaaagacttcatttcaccatcatccttatccaggttctgaatacacatgccctgtcgggtctgtggctcattttagatacagtgagtggaaaattgaatttaatgattaagtctttttggtttctgatttgtggattttcttgtgatttttgtacttctggatttatattgcatcttagtgaatatcattttttttcttcttaaattatctaaaatatgtgatagggtagttagcaaacctgtgttggttatacctattggcaaatgaaaggagatgacagaaataggctccgatgggcccatggctgaattacagagtggtaattattctttaaatactgaaataagagttttgcctattagaagcctcataaaaccagtgtctacaatctatctgattttgctgttgatgtaattttaggaaatcaaatgaactgggatggaaattaggtttcatactccgtggcttgtgtacccctctaagttctattaaattttataggagttttacaggtggaaacacagcagcaccacagcttttgtcacttcaaagagcagccctttcataaacagagaatacagaatcatgccttttatcttgccatttaaaaattcttcattttctgcacccaagtgatttatcacatggacggagaggacaattcaggatattgtatttcgaaaaagggaaagagaagccattcaaattcctattaaaatgaattgcactagctgtacatcattttctaatttctgagacgacttgtaaatcacaaggagagagggcattctaccattggtcaggggaaaaatgggaaatttaatagtttgtcaaagattgataagaaaggattaccactctgagagaccctaacttgatgagcaagtacattttgaagttcatcagacgtataagcagttggagagtttaattaaagttacttgtcattactcaagtttacatccggtctgtctctgggccagcgtatatggtatgccagtgacattgtcagaacttagttttgaccctgagagctgtgcgttgttcttttactccctcttgattcctctttcatcatgtagaagctgatgtgtattttaacattgtggtcaatttggtgacagaggtcttgatcagtgcaagttccagtagttagctgaattttatatttttctttattttttagctgataatgattcaagttgttggaataatctaagactgctagaaaataacatatatacacatatgtacacttgtgtaaatgccatcttgataacagaatcataaatgtgttcatgtaagggtatgtgtgtgtacgtaaatatgtattattgaatcgtattgggatgatttttttttgccctttcagatgtcaaattgtatattgagactatttattccattcttataagcaaagcccttcctttccctcttgttcctgcaaagcagctcagagaatgacttttaactgggcaaccatatttttgatcttctgcagagctaggagcactctgacatatggttcaacaaaggctcgcagaccggggcatccagtacttgtggtgcttctgttaacgcctgtttatcagattattgaagggcaagctgctttcctcagaacgtgcttgctctccctgactctgtgtaatcctatccaggcacggagctgatattgttatacaaacaaaactcaataggcattactgaaatccagagagtggattctttaggattggaccttttgtgtgtgtaaccacatttgaaggagacctaagaatcatcatctggaactttttaaaattgcagttactggaaactaaagccagaaactaggagaaaaccctccgattttttgtttggttatttttaagtggagaagttacaaaggtgttagctgttaagatgtggagtgaactggaatccagtggctctcaaatcttgcagctcatcagaaacccctggtgaactttgtacgtggcactcacccctattccttaactgtgaaatctatacatttttttttcatccaccccagataaatcatatgtaggtgggctcttggtccagtttgggaacccgtaaaagaagttatcaacctcatcataaccttcccaggcaggaatcaatttctttgaatataagccattcaaattccataatatgatactggctctaaaggcacatttaattatgtaggacacaccatccctttcgcaaaatcgcacaaagatttcaacttaggcctaaaatctttggcacatacgttgcactgggcacggatcccttggcctagataatactgaattaaactcctccctttcctgccctcccacacagaatttggccagagaagctcagtgaaggttattcttaaacccatccccgttgttcaaatctggcagtaaaaaaggctttacaacttgggtcaactcctaatggggccttttgatccaagtgctttaaagtttagaccttttgtatctttgttgataaaaactgaggtgtagtataccattaaaatttttaaaaaattatttctactgaacctgttggatttaatctgtttttgctatctagtaggcttgtgaccttgagcagatgacttaactttgccacatttttttcttttcttgtaaaatgggggtaatataatccatagagttatcataagaataagtaaaagaatgtgtaaagtgttagttcactgccttccacatagtgaaggcccagtaactgttgtttcttattattatcacggtgggggaggttagtgggggaaagttacaaaatgaataagcagcagactttgccttagtcaagagcttgcatcctcaaatttggagtaaggtataattatattaccatactagaagtaggaaggattaaaagaagaaaataaagatgcactcttttttcagagaaaaatgtgatcactgatggctttttgctgcatcttgaggggagacattgcccatgaaacagttttctgagctgagcccagaagaataaccctaaaggagtgggacagatagaaaatccaactggaagaggaagtggtatggtgtactagtgtctgacacacagaag

SEQ ID NO: 106404 - DNA, 1033 bp, Homo sapiens
gagtgcaaggctgtcaccaggagggcaggttagggtgaatgtggcagcccaggtgaggtagacctgatgattgttcgaatgtgacactttctccctgtcatagcccagcagcccctttagtttgtgactctgctgtgcctcccaattaggcctgctgtggacatctcacttctggctgaactttgggctgggttttgtgatgctctttggtcagtggaatgtcatggaaggcccatgaatagagtgcttgaatgtgcttgcatgactttacttggcctctctgttctgctaggtaccatgagaaaagcatgtcctagattcacaggtggaacttcctggccccaacctgttgcttaactctcagtcacccagtgtacccaaacaccagtgagcaagaaataaatgcctactgttgttcaataccaaaatccttttttcccctcttgcttttggtcccacagtattgttgcagtagaaatctgaccaacacagcagacaagttgactaatatgtctgctctttggccagaaaaccaacaagagccagaatggacagtgatgatggaaatgaattagttgcatctagggccatgtaacttgccctccatttgaccaaagctgaatttcattgaagtgtccattccatcatgcctgagttctatattggaaaatgatctgctttttcacaaaacacaacttcagctttcatatcctgattaacaaagacaatatgcattattagacttaatttaaaggtgtaatcagccatgcgagtcagataagggaaaaaatagtaccatggaccttttccaaattcccacaggcttaaaatataaaaattccctcaagagtgctgacagcataccttgcctgttattacagcttgagttttattttgttcctctgccagtaccagaataaaattaggttacaaatcagatctaacggtttagattattgttcatcttgagctctgcgctttctctccatttgttgtggcatagcagaaataattaaatttattagtaggcctg

SEQ ID NO: 106405 - DNA, 1162 bp, Homo sapiens
tgggaggtggaggttgcagtgacctgactgtcacactccagactgggcaacagaacgagaccgtctcaaaaattaaaattaaaaataaaaataaaagaaatcttattgtttcattttactgtcttgattggctttaaccctgtttccaatgcagtcttagagatggaatacattataatggggataaccatgtctcagtgtcatctctcatttgatctaatcagagaatacgaggttatatattgacaagattgtagggacccagatgagggggctgcattgttttactgtgcaaaagtagtttatccgttttttattgtgagtgcttattgagaacctcattgctctgtgatcttaatcattactaagcaagttgaaagatacagtggctgtttattaggttaagggaagcccacacatctatccaataaatatctgtaaagcacctgttacatgctgtgcactgttacaggcactggggatataggaatgaatacagcagaacatgttcctcatttgccctaaaaacataaccagtgtttggaaattctagaatggacctctcattattttcatttttatttcattttaggctattttatttcctaaagtcactggtgactggccatctttaacccttgaaaatattactacaagtgaagatctcttgatagcaaaactgatgactttaggtcttccctgcctgctgttgaataactcttttaagtttgttatgaaatctgtaacatgacttcagtatcatctagtcaagctcctacatttacctggtgaggaaattgagatccagggatgaagttcaaatagcaaggcaactccattcaaagtaggaattgtgacatgctgttgttttgtgtcttggcattcttgaacagaatttcaaaaacccagaaaaaggctggacgtggtggctcacacccataatcccagcactttgggaagatgaggcgggcagatcacttgaggttaggagtttgagaccatcctggccaacatggcgaaactccatctctgctaaaaatacaaaaaaaattgctgggcatggtggtgggggcccgtaatcctagctacttgggaggctgaggcaggggaatcacttgaaccctggaggcggaggttgcagtgagccaggattgcgccactg

SEQ ID NO: 106406 - DNA, 1051 bp, Homo sapiens
gaagctttttggtagtacctgagagtttcagtaatcacttatatatatattatatatatattatataatataaatatatatactatataatatatagtatataatatataatattatatataatatataatacatatattatatataatatatattacatattattacatattacatattacatatgtattacacataatacatatattacatatatataatatataatatataataatatataatatataaaataatatatataataatataataatatatataaatatatatttatagagagctgttgggaatctccatcaaaagtaagtgctgaaccttttaaatcactgaaatttttttttaaatggttcaacaattttatagaaaacattggtagggggagatttttattttggggggagttggtaatttaatgtaccttttcatatttctaagaaaaataaaatatttagttgattgttgttggctttagaatcattatagttgagttttcaatgaattctgagaagaaaacaaccaataatggcagtttttaaatcccaaattcttccatggaaaaataaagcaactaggaaagctaaactataaactcacaaacaatatctgtaatgaaactaggttatgaggtatctccatcagtctcagaatatgtgtggatgggacaaaccacctacagctacgagacctgcgtggaattggccccagagggaagagacagaggacctgaagtctcaaatcagctgcatattgcagatgcccatgggaaagtgtgctgggcctacttgggatgtgcattgaagagtaggcatgcttccatagcatacctagttcctggatgagtgcaaggagactgcagtggagcaagatgtggtgattttggggctctatcattttccaaactaataacctgaatctgccttctaaggtaaaacttgcaagaggaagaactgctgggggtagaagtcagaatgaacaagatggggcggtgagagtcaagtatagacaaggttcagataacagtgtggaa

SEQ ID NO: 106407 - DNA, 4759 bp, Homo sapiens
tgtttcagataatcataattggagtgtccagtgaatttggggaaggatagcactagaggtgacacagttttgtggccctgaataaatttgtgtatctaggcaataattatcaatggccactagcatcacaaatgggggagacacctagactttatataattctccataggagaatgcagtactacctataaggtagttctgccaacaaaatagggaactttagtctgatcaagcttctacatctatcaatttacagaaattaaactgagtatcatgttaaatggcaccatggggatgcaatcagcaaaacagacaaaatccataacatgggaatctttatacaacagagggtacaaaatgtttttagcacaaaaaggggtaaatggagataaaaggggaacctatagattaaatgagattaaggaataccttgatttatcttaatgtgtatggcccttatttggatcctgattgaagcaaacacgttgtaaaatggaaaacattataactagttgggaaaatgtatgtgaatattggatttttaggaacggatcattcatattttttaagtgtttcctgacattttggtttttattaataataaaaaagaatacattggagaaaaagggtttgagtcatcagtaagcgaacataggatgttgaatcactcatttgaaattttagtagatatgtgagttagggttcttcagaggagcagaaaaaaggagatatatttttaaaagacatttattataaggaattggtgtgactgtggaggctgagaagtcccacagtctgctgtctgtaagctagagacccaggagagccaatggtgtaaattcccatctctcttggaggcctgaagaaacttatggccctggttaagcttaaacactcaggcagagagaagatgttttcccttcctctgcctttttgttctattcaggcactcagggtgccctgaatgggtacctacccacattgaggtacccactcgtattaagtggtgcccacccattgaggaaggccatctgctttaaacagtctattgaatcctaaacaccctcgcagacccactaagagataatgtttaaccaagtatctgggcaccccatggcccagtcaagttgacacacagaaatacccatcatctcagaaaacactcccctttttaatttcttgttcctgtgtctctgttttttttttttttttttttttttttactgtggctttagggataaaacagtaattttggtgttgaatcacggtgttcattaaaatggagaaagcaggttttgctcttgggtagatagaggcgcctggctgctggggattgtttgagtaacagctagctatagcattcatcttcaggggttcctgttttgcacttcctctgtgaccgcagtgagaaattgtatatgagtgagacttcctagggttctttggccacactggagagcttgattacttgttacctctaacacctttattggacatggtgtttttttgattcactgtgaacatttatggattttttttcattacgccaagcatttcaaatattcctttccttatccaggatttttaaatgctgtgtttcttttggactttgtctacattttgcagtattctcctcagcatagatttctccttttaatggctacttcttcagctttatgagtttaactttttcaataataaaaacagcacaaaacatattaatcatattagttatgatcagttctcatttgtctgctcttcttgttttctttttttttttgagaccgagtctggctctgttgcccaggctggagtgcagtggcgtgatcttggctcactgcaagctccgccgcctgggttcatgcccttctcctgcctcagcctcccctgtagctgggactacaggcgcctgccacctcgcctggctacttttttgtatttttagtagagacggggttttaccgtgttagccaggatggtctctatctcctgacctcgtgatccacccgcctcggcctcccaaagtgttgggattacaggcgtgagccaccgcgcactgccgtctgctcttcttaagttgacagaaaaggagttttacagtttttacatttcttaatcctttatgggaaatagtatttctttcgttttgcatgccagagaactgaggcttaaatgataagtaatgtgctgtgacttataaagctaataaaggaaggctaggatgaccctaagcatagaagacagaggcaaaagaagaggggaaatatgaaagttaaagagatataaacagtagagggtaaggggtcgtgaggtgagtgtatgaatagcagtatgagcgatgacaatactgaatatgataatgattgagaacatccgcccaagatgcatgctaagcgctttactagtattatatcactggatttcacagcacctttatgtggtagtcacagttattttctccattttacagatgagtaaacagagctgttagaatattatgtaatgtgcactgggcaggctctgccaagtgcgtgcagaagcataagctagcaatttaactgcctctcaaatgcatcatagtaatctatcttcctccttcatcatcagggattaagtaactgcaccatggacaatgtaagtaacttgcctaagtaattagtttcagtcactggcacagccaagtggagaatctctcttttctgacctggaagtattatgagtttgctcagtgagtttgtttttggaaatgctcctctatggcaacattcttgcctattcaatactgtttctttgacttctgtgtctgtttttaattgttcagctcttctctttccacccacatccccaaatatgcagtgagtagccgttgggtttcacgttgtaattggaaaaggtaaaagccagcctgaaaataattctggcctgttgggaatgttggcttcatgttttgagaatttccctcgtgtccctgacttcagagttaactatttctttaatgaggactaacatgttagtgttgtctctgaactttatttgcagtaattcactaatggaagctttcacagccaactctggtaatgaatgtagaacagcgaccttctgtagaaaaggaaagaaaaaaaatgctttctgtcctcagagggatctttcctgtttggaaaaaccaaatggacaagaaaaataaatcaagcatttgaaggaaaggagctacatcctttagagtgttatatttgtgaaaattctcatagcctagagattttctttccaatttaagcaaggaggaattttccaatgtgaagctatttttacatggccattaatggggtatttttggtgcaaaaatagtttctggtccttggtgtagcaacctttacccttttagtcaaatgttttattcttccaaccacacacagtaggagaatttcttctctaacagtcctcataccttccccaaaaaaggagacagaggaaaggcaatatttgttttgagactgattcgttacatggccgatggtgacttgaaaacacctccctgtgtgtgttttctgggaaagagaggaacaagtgagtgttaattctccactctgactgggggccaacatccctttgatactcattgtgctgcctttcctggttaggagttcttggggcacttaattaccctgggctgaatattttttaccatctactccatcccatcatgcgtagtttgcatttgcaagttcggttactttgggagattgatggagttgaaattgatgatgagccagttgcacaggtttgtttgtttgtttttgttttgagatggagtcttgttctgtcgcccaggctagagtgcagtggcaccatctcagcttactacaacctctacctcccgggttcaagggattctcctgcctcagcctcctaagtagctgagactacagacacacaccaccacaaccagctaatttttgtatttttagtagagacgggtttcaccatgttgagcaggatggtctcaatctcctgacctcgtgatccaccgcctcggcctcccaaagtactgggattacaggcgtgagccaccaggcctggccgcacaggggttattaattagtggaatcatattgctcattgcagaggagcaagtagaacttaaatgtgttatgcattttgggtgtaacaaatttatgcatttagaatagatgttaatgtaacaaaagtgatgaaaaacttaaagattattatggtaatttatatattttttaattttgtagactagcttaataaggtgaaaggaaaaacaacttgttcttcatggagtttaagttcacatggatttatagtgcaagtagaaatcaataatgtaggacaacggagaaatgccttcattcttggatatgtctgtccagcaaatatactgataataaatatccctgttataaatgatgatgaagctgggtgcagtggctcacgcctgtaatcccaggactttgggaggccgaggtgggcagatcacaaggtcaggagatcgagaccatcctggctaacacagggaaaccccgtctctactaaattacaaaaattagccaggcgtggtggcgggcgcctgtagtcccagctactcaagaggctgaggcaggagaatggcatgaacctgggacgcggagcttgcagtgagccaagatcgctccactgcactccattcagcctgggcgacagagcgagactccgtctcaaaaaaaaaaaagatgatgaaaaatgagttgacagttgt

SEQ ID NO: 106408 - DNA, 3634 bp, Homo sapiens
ttttgagacaggttctcgctgtgtcacccaggctggggtgtagagataggatcacagctcactgcagcctccatctcttgggctcatgccattctccctcctcatcctcctaagtagctgaagactagagctgttccctaccacatccagctactttttgttgttgttgtttggtagaaatgaggttatgctatgttgtccaggcttgtctcaaacttctagactcaagtaattttcctgcctcagcctcccaaagtgctgggattacaggcgtgcgtgagccaccactcccagccaatcttgttaataaatgatgataacagtaacaattttggaagattcatggaaataatgcataggaactacttagcactctgcatggtacatagaaactgctcaaatatccttaactctcattatcattaccagctgtcctattgttttaggaggataaaatacatatcttaagttaaaatgtttttttatttggttgtgtcgttttgcacggaatagtagggagaagcctcctgatttgtttctctcgtggaaatttgatctgtatctgctaaaaaatgtttatcccttcttctgtaaaagggactctttcccctacggtgagtagtatatagtgaatatcaatgctgatacatttaaactgtggaggcatcaggggaccaacctgcagtgatgctaagtggaactgacaagataatgacatgcgggttattgttgattaatccagttcactggagaatcattgggaaatgcatttatcctttcacctgaccctcccaaccccacaaaaatgatttacagtaatcttggagtcacccagtcctttcttccacatcttccagaacttaaaaaaaaaaaaaatccgatgtttgtactatttcccctcttccctacttttgatgacggccaatttgttaaaaatgtaagaatggccagatgtttggtgtttgtgttagtggcagcctggagctaagtatgattttttacagtgaggtaaaatacttgcttcttactctaccaagtactttttacacctccctttatagccctttttgtaagcaaagatgcctgacttctgtttctcatctgtgaagtatcataggtctagagtccattagacatgatagccaaatataaaacgttctaaaaatggaaaggtttttttttttttttttccgattatgtggtggcaaaacctaacctgtcctgaaatcatttggtgattgaagtagtaattactatgcttctagaaatatttttagctctccatctccaggcgtatggtagccttacttatcccgccctcttctaagttgagcatgactctcaaactcaatcaggcaactagaatgagaatatcgatatgaatgaggatatagacgtttgttgcctttagttggaatctttcagagtaagggcatgctttgctgtgttcttctatcctctatagtcagggaagtgtgaaggtggagctaccctctcagcctgggtaccccagtaagggagatgttgggcctagtcccctaagtggtgcatttgcagcatgagcaagaaaacatcttgctgttgtaagattctatttggaggactggtttgcggcataacgtagttcacccagagaagtatgtggtaaatatagggctttgatttttagtctttcatgtaatcagatgcactttcggagaagggtttcaatctcacttccaacctttgtataccttgttcctaatcacaccccatcatactataggaaaggtggaaggtggacagaatctgggatcccagcctcactcatggatccaaggtcagaaatcatctcatgtctttctgccagtgaatgtccttctcgtgacctcatgatattttgtgacatccctgatctgtccttcagtccatggaaatgcccctggctgtagtcatatttctctgtctatctaaccatgtgtctatctatattttcatatttatctggttggaagcatatatatatatctttcaaatactgggaaggcccaatattttgcctcattaggttatacatacatgataaacagcatgatatacattttaatatcaagtagataaaatacaagcttttctaagctataggtcatcactggtgaccctatcctgatacagttactttagagatctaaagagattagatattatattttcttattatatagtaccttaaatatgtctataacagataataaaatagtgcattagctcatatatactacctaaagagagacacttaatcttactgtatttatttggaaagtttaggtaatttcttacattaaaatatttttccttaaattaactgctgattcttagatcaagtcagttatgtattattgacctaaattccacgtacagtaattagtttttgttttgctggtcatactgagtcattgcgatatttctctggtatgtgattttagtcttctacatgccctttttttctcagtctatcaaggtacattacatagtttatttattctaagcgtttctacgaaatacaataattgtcactcactttttaaaggtttaaattcctaggctagcaaaggagtaagttattttcctatatgcagtcaaacctgggtgacacagtatggaagatgtttaatatctgtccatatgtctgtttattctttcatacagcgacacatgtgttgcacaactataacataccaggcatagtcagtagcgtctgggaatattcaagtgaagaaatctaagttctagctactccatggagaagatgcttttagactagaacaaggtagacaaggtgtgttttgcacgtagtctttcattttcatagtgcctggcccatgcttaacaccaaataggtagaaagtgaatgcatggacttgtaaccaacatgtgtctcatctggcctttcaaggaagtgctgtgtgaacccagaggaagtgctgtgtgaacccaggggaggagtgactacacatggttggcgtcggatgcattggaaaggcttcagataggatagtattggacttgagccaatgggaattggcttggtgaagacctccaggggacagggtgacaagccttgcctgcagtgacagcagcttgtgtgaaggcacagtgacagggattatgtgaaaagaggtgagctgtggttttcatgtccctgagggatctgtttatttgggccaataacctatatttcctttttttcccttggtcatgggtggaagatatttacctatatgactgattctgtacccagaagaggtgaaagcctagaacagatgatttctccaatatttaaagtgtaggttttgtcagcatctgcatgtgttatatagatatatatccttagcacgtggtgtgtatgtgtgtgcatgagcttgcctgtgtgtgcccgagtacgtgcctatgagtgagagagaaggaacttacttggcatgggatatgaaggaagatactcagtatttgttccgactcatgcatcccaacaaaggcgaagtaaatgtctctgtggtgtcccacataaaacatgaagcactaaataatattgagagagcctcgctgagccctccacaaatagtacattaatgtcaaggaagtgttgaggaattcc

SEQ ID NO: 106409 - DNA, 2161 bp, Homo sapiens
ccgtgatctcggttcactgcaacctccacctctcaggttcaagtgattctcctgcctcagcctcccgagtagctgggattacaggcacgcgccaccacacctggctaattttgcgtttttagtagagatggggattctccatgttggtcaggctggtctcgaactcccgacctcaggtgatccacctgcctcggccttccaaagtgctgggatcacaggcatgggccactgcgccctgccgatggatctctttatcgggaggtataaatgcatcaaaatttgtggagctgtagtgaaatttgtgctttgtttttacttggtggcttcctttcttttttcaaagacctaatgagaatgtttaaataacagacatctgggttcagcctttgaagccttagcttgtactgtctgatattctcaagtttttgaggaatatcgggtcagtgatggacatttagctgcaaaatatattcctttagtgatccatctatttaatctcactgataaaaagatactgatactgatgagtatctttcctattttcatggaggcattattcaggcataacccaggatactcctagctgctgttgcagaatttttcactgaaatatagaaatatgtgtgtaaacatctgtctcacaacttttgtgaaagagcataatacccatttatggtgaagagaaggaataagcagttaagaaaggaagcagttgagtgaataattttgtcatttgacttgcataaaatcattgggataatttttacttataaatataccacacacaggaaggaccttttgttccattttaaaaattgcaggtgacacctgtttttttgtttttgtttttgttttttttaacctcatgttacttctcttgcttgatgttcaacccagcttaaagttaaagcagactcaagccaccattcattcattctgttgaggacagcatccatctggtatcttcttactttgttaattcagttattctatctacaattgtttctcacattgatgacttaggaatttcaggaatggatgagttaggaaaatgccaatgaccatggaaatagagaaaaaggtataccaaattttgggtgctttttgagttttctgtcttatgggtaaatgatatttttgtgcctttttctccattgcaaaaaggaaatagtttttcataagaattgctggttcaaactgtatatagataaacacacacataggatagatattgatgggtggtaaaagttttctaattggttcagatgagaagatttaaaaattacttaaaagagaataaacaacatcttgtctataactattctaggtggtttgtttttctaaaaataatgtaatattttaaaaatgtttctagatgatttcatttatacatggatttatacatttgtatcttataaatatcccagaaagagtcaatcaaaaaattatatctgccaaaataagtgtaatcatgttgttcagcctaacaagaagggggtgctttgcatgcacaattccatgcaaatgaattcacatttccatttagctgtaatgggcacattctccccacagctgtgcttttcgttgtgacatggagatagaagctccactttcaaaattattggatttggaaatggagttagaatattgaatttggtgcctaaaataataactatctctttttaaaaacattattatatgctcaaaaccccttccctggactaagtcatttaattctcataaccctatgagataggtactgtgatcatcttcagaacagagttttggagcatagagagtgggtaagcatctggggcagggtcatacaactgggaagaaactgacctggacttgaacccaggctttctggctttggaactagctctgttaagtgctgtgtgtacagccttcagggtatcaggtccttatctgacattatctcaccctcttcccccagtggatcttgtagggtaggtatcattatcttcattttatagctgagaaaactgagatgcagaatatgctgctctgatctttggtttttacttacttttttaaaaaaaatatttatttctagtttgtatttcagtaggtttttggggaacagggtatttggttacatgagtaagttctttagtggtgattcatcagattttgctgc

SEQ ID NO: 106410 - DNA, 2272 bp, Homo sapiens
tgcctgtaatcccaacactttgggaggccgaggcaggtggatcaggaggtcaggagatcgagaccatcctggccaacatggtgaaacactgtctctactaaaaatacaaaaattagctgggcatggtggcgtgtgcctgtagtcccaactactcaggaagctgaggcaggagaattgctttaacccaggaggtggagtttgcagtgagctgagatcgtgccactgcactccagcctgggctggagtgagactccatctcaaaaagaaaaaaacatgaacattttggttctgatgtgagctgccaattttttctcatcctggaagtttcctaaggcaaacatattgggaatccagctctcagaaattagacaattgaattatatttcatctagattgcccacccaagctagtgaaagcttgggttttgattttggttgtgtttaataattacaatccttttggctgtgttttctatctgaaattcagctagatatagaaataaagtccaaatatacctaagattcagcatcataaatgtcaggttcatggaaggattatttatacttgtattgagaattatgctgtccagtttggtagtttccaggtgtctcattgtggcagaggcaggctgccttcctttggtcgttactgtgcctcaattacctcaatattctcttgagagaaaagggcttaggttattccattagcctctggtcagcccttcctgactctactgttactttctcctgctccagcctcctttgtaaatgtggaagtcaatttcctattcagtgggatcatgtcattcctactccccccttccccaggctggagtgcagtggtgcgatctcagctcactgcaacctctgcctcctggattcaagcgattctcctgcctcagcctcctgagtagctgggattacaggcacacgccaccacacctggctaatttttgtattcctagtagagatgggatttcaccatgttggccaggctgggctcgaactcttgaccttgtgatccagccacctcagcctcccaaagtgctgggattataggcatgaaccaccacgcccagcccgttcctgctatttaagtccttaatggcctggccttgttggtagtctgaagtgtcacatcagtggttcttaaaccaacctttttatcaggatcactttgggcatatgttaaaatatacacacgtgggccgggcacagtggctcacacctgtaatcccagcactttgggaggccgaggtgggtggatcacctgagaggtcaggagttcgagatcagcctgggcaacatggtgaaaccccatctctgttaaaaatgcaaaattagccaggcatggtggcacatgcctgtaattccagctacttgggaggctaaggcaggagaattgcttgaagctgggaggtggaggatgcggtgagctaagatcgcgccattgcactccagcctgggcaacaagagtaaatctccgtctcaccccccgcgcccccccccaccaaaaaaaaaaatatatatatatatacacacacacacacctgaaccccactgcagattaatggctctttggatatttgtaggcctgctctttgttcttacagctatgtgtaggaatcactggtaagtctttaccttccttgtctcttctctttccaaaccattgttctttgtttaggcctttgttatagaacatagcccttttctgttcatccactaccctctgacctctctgattcatgtacccctcaccttcctcattgttttctgagtgtgtagtacatagtaagtgcttgaaagtggttgaagtaatgcagtttaaagttgtaacattttgaggcctggtgttgatctacaaagatggtaggctcagttccaaacaagacactagcctttcctgtctcctggaggccagctttacttagggatagtgataataaaatatagcagctactatttactatgctcttactaccttccgggtactttgcataatgcctctcagacattattgacatcaaggcctgaactaggaatatcagataataatatctattgccatcactttgtagttgaggaaatagaggtgcagtaagttttaataacttgctgaagatgatgcagtttgtaaatgggtgaagttctgtttgaaaccagtttttttgttgttgttgttgttttttgtttttttatttgtttttttcagacggagtctctgtctgtcacccaggctggagtgcaatggcacaatctcggctcactgc

SEQ ID NO: 106411 - DNA, 1055 bp, Homo sapiens
atatctcctaaaatgtgggatacagtaaagtaactggaagttgagtcacaagcagggctcctgtttgcccatgtcttgctgaatgttcggcatgcagggggtactagactattaaaggctgaatacggaggtgcagcctgaatagtacgtcatagacaagagcggatcagcagcattgattgaacaatagcaaggttttagcctggatttttgtgtttgaggtgaaggaaggggatgaggaatgtctgtacacgtacacatgtaccatatttttcacttgagggtgctttcactgatcaattttgagggattattgaaaataagtgaagacattgaaaccagatgtattagtccattagggcagctataacaccacaaactgggtgacttaacagaaatttgctttcttacagtgcaggaggctgccagtcaaatatcagtgtattgcaagtttgctttcttctgaggcctctccccttggtttggagatggccaccttctctgtgtgtcttcacatggccttccctgtctttcttcttcctcttacagggacatcagccttaatggatcaggcccccgacacttttgcccacatttaaccttattcacccctttaaaaaccctgtctccaaatacagccctgtgagggcttcaacatatgaatgttgcaggggaggcacaattaagttcacaacaccgggatggttaaacaactgccctgagatttcagatggtgaatgggagggaactgggcctaaaagctggtttctaggacaagtggtgaaggtgctcagaattattgtcctgaactcagtatgtgagaaatagttaaatggggaaggttgtgctgttgggttatctacctgaaatcagttgaagaatcgtttttggtttcaaataattaaccctagaagttgggcctgactggagacttaggccaccaaaactagacaggtttatatagtttcttttccctttgaaaggtcccttttggatttagtttcaaaataagatggccaaatttaacctccctgaagtttcatcataccttcaag

SEQ ID NO: 106412 - DNA, 1067 bp, Homo sapiens
ctctcaactctcacccccttccccctcgttgcctacacagcattttttgtcgttataaagctcacacccttcaatgcatttggtatttattttgtaatcctaatgcatcttagagttgtgtgtattttatgtggtactatttctttttcctccaaaaaagctgctattaaaatgactgcgtatttcagaattcatggagtcttggaatttagagaatatagcacacatatatttatgtatacacttatagtttatatgcacatatatatttagatgtgtgcctgcattttccccttgatattatatcataaacatttcctggtagtattagggtctaggcacttgtaatgtctaaatcatattaatttatgtgattgtgactttattgatatgattttgcttcagtcacttaggttgcttttagttttttgactaagtgtagttaacattcttaagaatattttttgctagttttctgtctgaatatccaggacccatttcgatctgtattctttagttactaaatctttaaaatttaaaatattagggtttttaagcccatataattcaagaagtaaatgctttatatgttgaattatgatttgggcaaatgcatcttattgttttagggcaaaaaacttaagctttcttctattaaagtgatttaataagcactttgtaagtgtgtaatgaggatgatttgggttttattacaaatgatgtcagtgtgaattgtgtaatgatttcttgctttggtcatactaatttaagctctaggaataaatattcttttatcaaagaatcattgatgactgggcactctgtgggtgggtacatgggacagagaatatatttttacctttggagtttatattgggggagggacaggtcatgtggagacaaacaatgcacaagtaaacaaatatataggatacagaaaatttcagatggagttttttttgtttgtttgtttttttttttttttttttgagatgaggtcttgctctgtcacccaggctggagtacagtggcaagatctctgctcactgcaacctccaccacctggg

SEQ ID NO: 106413 - DNA, 1025 bp, Homo sapiens
tgatttgcagtggcttgggcatgtattaataatgatggtggccgtaataggctctcaaatctcagtggttcaacagaataaaagtttgttcttaacttatgcaaagttagtagcacaggtatggtgagtcagtatgctcccctccaggttgtcattcagggaccaagtctccttctgtcttgtagctctgccatccccatctaactgggaacattttatgggtcaggcctagaagtagtaaatattactctgccactttccattggctttttctttttctttttttttttttttttttgccacacatacattgccctgagagggtttgaaaaattcactttatctgtgtcatccagaaaaaaggaaacaagttgtgttgtagcagtagaaatctctgttacagcataatttaaatgtgtactgcacatactaaatgtaagttgggttgatttaatgtgggccttcaatatcttttctattatctttcctctcttgccctggaatacaaggaggggaacatgtaatgaaagtaaatctgaactgtcttcctaaagggacatttctggtactttcgaaggtgcagactgaagacttgagtcaaggattgctgctcaccagactggcgagagagcatataaatgtgtttgtgtgtagtgtgcatgtatgtgttgcagtgaaattacagctttccaagtgtatggcattgcctttagaagcaataagaaacgttattgctgctgagtgatggatgcacatagaattgtgatatttgaaggaggaggttgctaaccttggctgttctgaactaaacatggtatagggtgtgatgcatactcagagacaggctcatttatctcttgtcctgttcagtgctgcattggttcttataactgtgtttattaaataaaactagaaattgcaatcctataaagaaacatttagctaaggctttcatttcttgtatacttatcagggttgctgtgtcacaacaaactctgtgcataccatctacaatgactgtcata

SEQ ID NO: 106414 - DNA, 1005 bp, Homo sapiens
gctactcgggaggctgaggcaggagaatcgcttgaaaccgggaggcggaatttgcagtgagacgagattgtgccactgcactccagcctgggcgacagaatgagactccatttcaaaaaaaaaaaaaaaaagagttgtaaaatgtgaattttccaagctatcaatgacatgaacataaactataatattattttacttcacctgaaatttgcagcattttaagtgcatggaattggtgacttggaaaactgggttttttgtttttttttttaaagaaatgtccagttttaagagattttctgctggtgctgacatcaactaataatgtttttactttcactctgttagaaaatgatttgagctacgatttcagagttgtaaagaaggaaatttttctagtcactggaaacctgccgatagaataaacatttttggtagtaaaaaaagagaagaaaattgccttagggataaacctcttagttttgagaaagactgtagaatctaggaactgccaacattattaaaatatctgacatacaaccctaagtcatcattttaacttcttcttcaccaaaacttttcaatgaatgtttcattttgcccaccttgaattgtctcaggatactccctgaagatagatactatcttacattgtattcatttatatctcttattttttatttgtacatgggtctgtttctatgatccgtgtgtatgtatgtgtgtgatatacatgtgtgtgtatatatacaatataataatctatattggcagtaccacactgttttaaataccaactttattctatgctttttcttacagtataaacccttgattttgtttgttttgttttttcaagttatttctgatggttcttgcttcagatgggctatagattaacttggccattttcaaatattggtgggattgtggcttatcaaaatttaaattgacattcggtaaaactggattttctttgcagaatgaatcaatatgaaactgaga

SEQ ID NO: 106415 - DNA, 1248 bp, Homo sapiens
acattgaatggttagatagtaatagggatacctacatcaaataactggcaatagttgaaaggttttttaactatataaactagggcaaggctatatctgccttatttgttgtttctaatcttattacagtgcttggcacatacgtgctaaatattcagttcttacgtggttgtttatcaataaagggaaaattgattcattcattttgtcattctctttcttttgggtttgtcacactttccccagcaacctaccttaagcattttatgagtggagttgtttcatgttcttcttttgtgtttttaaagtattagtgatttaaaaggcacctgccaaatacctggtaggtgcttggtgaatgaactgtcaaggtttttaatgggtgcagaaaactgagggaggtgatgggagagcagcttgtggttaccgtgttgaaatttaacaaataattttaggttatagatgaggacaaataacttaacagtgaggacaattaaaccgtggggtggcctcttgaggcaaacagcagagactgttgctttaggcagccaaaggcaaatgtttccactgggaagatgtctattgatcctattatcccgggacttgaaataacatttccattttccccttgaaaacccatgatgctgtttttaaaatcacatacttcatccttaaactctcatgcaaagctattacttgagttaaacctctcaccagaaatgtcttcaaggagtattctctctgtaaaggtgtatattgtggaagatgaaaaaaggaagctctctttggttctctgttacacggggtggctgctttgcaaggtgaatcacttcggagactgtgaaatatttcatgtcttataatgtattttccattatttttggtccataagcatgtatattaataagttgtacgaaatcaaatgtcagaggttcagggagacagttttgaaatcccagcattttgtgagtggaggttgtttcctattcttttgtgtttttaaagtattagtgatttaaaaggcacctgccaaatacctgataggtgcttggtgaaatgaactgtcaaggttttttagtgggtgcagaagactgagggagggtcccagtttgggatgtgaatttgggttccagatgtaacattaatttgcgctgtcaccttgagcaaagtgcttaacctttgaaagcctcagcttgctcatccattaaatagggataataatagtaattattgtgaagattaaagaag

SEQ ID NO: 106416 - DNA, 1140 bp, Homo sapiens
aagaccaacctgggtaacatggcaaaaccccgtctctactaaaaatagaaaaattagccaggtgtggtggcacatgcctatagtcccagctacttaggaagctgaggttggaggattgcttgagtccaggaggtggaggttgcagtgagctaagatggcaccactgcactccagtctgggtatcagagctagaccctgtctcaaaaaatagagagagagggacaatattttgcgactgtgctgtctagtacagtaaccactagccacatgtggctattcacattcaaatagatggaaaaataaaattaaaaattcaattcttcggtgtttggagtggagttgtttcccctttcccccagtcatatgttgaattcctaacccctagtacttcagaaagtgaccttctttggaaataaggttgctacagatataatgagttaagatgatgccatacgggagtagaatgggcacctaatccagtataacaggtgtccttatgtaaatgggaaatttggatggagatacaagcacacggggagaacaccacacaaatgttaaggcatggatcagggcaaggcatctactggccaaggaaccccccgaagattgccatcagcccacgggaaacttcaagaggggcatggagtagatcttcccctcatggctctgagaagggcccagtgctgctgacaccttgatcttggacttctgccctccagagctgtgagacaacaactgttgttttaggcacccagtttgtggtgtgttgttattagcaccccaggacactcatgcactcagtctcaccggctgtattttgagggctcaggagccagtgtggctaccatcttggacagcgaggacactgaacatggctatcactgcagaaaattctaatagacctccctccttcggggattccaggttgctcattgctccaaaaactcaagccaagaagatagaagaggttcaaatgattgtatgaagcatgttctttgtctggaaatccagaacaaaacaaataaatgatctttgaaaaaaaaaatctctgccttaaagttgggctggtcaacatgtccagatattcacagagacttcctgttctggaagagatgcagacagaggcttaagacagccttc

SEQ ID NO: 106417 - DNA, 1387 bp, Homo sapiens
taaacattgttcaaacctaaattgcgtttgttcttgcagtctttggagtacactgggccttttgcagttgggacaaacccatttcctctctcagtgggaaacactccaagtattcctcttgaaacaaaacgtcaaagattatttttgcagacttctgtggagtcatttttggacaacaccctggaacaggaaaccacagtttctcctaaatttgtacaggatggaaatagataacattcttcataaaaccatggccacaattaatgctttcaaatcaacataatggtggatggtttgttttttgcatttcttacctgaatagattatgggaacctgcagcatgggaaatttcatgaataattttacagggttttattttataaactggaaatgcggtgaaaagatatgtgtaggtgatgaaaaagagtgctataggattcaacgtatttgaaagctctccctgaaagatggatttgaaataaaacagagtctcgcaccctaagttatgggaatgagatttacgctcgctgactgaagcccaggtgctgctaaaggttaattagtgagagaatgtgatgaacttaatgaaataggtgatgatgcagtgtgagggaagcccacacagtcatcaaaagataaatgcactgagacattgtatttttcttttctttgctacagaggagtagcaacaactacacatagaacaaatccagaggagtagctacagctacacatagaacaaatcctgcgtatacccatagcaggtccggaaggactggggtgcttaactacagactttgctgggagccatcgttccataactgctgaaactccttttattttaggtctgtttctgcgaagtcctgatagctgagttgacttaagaggagttggactaaatttttaaggctactttatttttatgattgatttttaattattctaagcaatacatagttattttctctgggcgaaaagttgaaatgtttcatacaaacctcatttccttgtttcctaaccccagacccttctccccttcttctcaaataaaagctagcactagttttgtgcatatactactagtttgcttttaacgtgtatgtatgtttatattttcttaggaaatatttaatatcctgttcttttatttatttatttttattttttatttttgaaaccgagtcttgctctttcacccctgctggagtgcaatggtgcaatcttggctcactgcaacccccgcctcctgggttcaagcgattctccctgcctcagcctcccgagtagctgggattacaggcacccaccaccacacccagctgatttttgtattttttagtagaggtggggtttccgcatgttggccaggctggtcgtgaactcctga

SEQ ID NO: 106418 - DNA, 1071 bp, Homo sapiens
gcttgtccttgcggagcttacgttctactgtgggaaacagacaaagagtaagaagtatgttgtatgatgataagttctaaatagaaaacattaaagcagggaaggggggtttgagaaaatggaaattttagagaaggtgtgtgcgaggttcagaatggcccccataatccccacttccaggtattcacacccttttttagtcttgttaaacaaagagagctggtttgtgtgatcagttgacgatggcagaggtgacactgtgtgacttcttaagaccaggccgtaaaggaattgcggcttctgcctttgggcttactattgattgtttcctttggaacaagctcactccaatatcattagaacgctggggaagaactgaggctccaccaacagctggtaccattttgctggccatgtgattgaaccacttaggaaatggatcctccagtccatgttaagcctcagataactgctgacccagctgacatcttgactgcaatctcatttagaaaacttgtttcagaactgcacagctaagccattgctacattcctgacctatagagatggtgacagataataaatgtttattgatgttctaacttagtgagttttgggggatttagttacacagcatatgacaactaagatgcagagtgctaggaaagtctttacataaaatattccttttggggaattcactgtgacccctttgttttctcctccaagttgatgtgttctggggtgagctgttttccttctctgggctctaggaatggacacatgacccaggtctggtcatttaggttgttaagattgctttgattggattggagatgaatatgtggccatggccatctaatgaaagtctcctgtgctttacttcaaatggccacatcaaagtccttcctgtgctgaggcttctgtgcttttcagaacataagctcagaggaaccggtggccattcaaaagagaaaggcctgtttgagagtgcagccagcactggaatgcagaactgagttgacagcaagagaatgagatctcttgagagaacagcagccctgtgctgcta

SEQ ID NO: 106419 - DNA, 4834 bp, Homo sapiens
tttcttttgtttaggccactttgaggtgggatggtttcactttaaaccagtgccctgagttttcaccataattataaaaacattgagcctcggtttcttatctgtaaaataggtctgatttcacctattctcatctataggctgtgagaaattaataagggaagacaggtaaagtacctggcaaaaaattgattcctctgtcttctctatttactctgtttctccttcctgcaactatgtaccccattttgtttgttctcctaaggtctgtgcctgttcagtgtgtacacatacatattcatggacatatgaatacatgctttttaaaacgtgcactattagggaaactgtactggtgcactgtaatatacatgcagcattgtcagtctgctggcttatcaagcactgtgctagtggactagatatagatgagatacaggaaggtcttttcccgtaagaagagcagtctcatgtgagtgggcaatacttacctgaggtttaaactaggtatcaggtaagattatagctatttgaagatccacatatcctaaaaacctgtaatatgagggtcctagagaaggataatgctgacagtgtgatagagaaggttccgttatattgctggcttattaataaaattgcatattacaattttgaatttaagatgccaaattctatgttttagcatttttttctttggtgcctaaatcgcacatttgcattaatttttctagtagagggaatgccgctggtttatagtggtatgaagtatttttggagatggctgtgatttaatttcttcttattttcactgcatcagaaggtgaacgcagttactgagtggttctcttgtttgacaacaagcctttcccttgcctgttttgttcccagccttgtacttaggtccctaaaagtgttactaagctctctgggattgcagctgctgaccttaagacatgagccacctgtaaggtaaaagtaatagtatagaaagctttcataactgggctcttgttctagattagccgcctttccttttcttgtaggaattcttcctcaagcagttctctcagaaccatgggttttgtagtcatctcattgcagattgtaccttcagtgttttgtaattaatctcctctagactttcatggtgtagagaaagatgttctcataccccttccaaaacagcaggattcttgcccaagtctggtggttttcaaagtgtgttctggaattctgtggttgcttggagtcttctaaaattttactttctatattttggtcttccatgtaaaacttcaaaactcagtttcaagaaaagcttctaaaatagctttaaaatgttcatgttaaagtagactttatagtcttgtaatgttttactaaggggtataaaataatatgaaagggtaggccttttttttttttttttttttaaaagcaaagcactgatttaattatagtaatttcttacttttatttctctcttagtacttctcatactcttggtttactggtgcttcaggcctcacattaggaagcttgctgaggtgtaagcctgaggtagttggaatgctgtcttgctggggggctctgggaccttggaggttggcattaaaccaaggaagtgtggagcaacagccactagatgtcaaggtgttgtggaatgggggagtgggtttcccttgaattaggaagaaacagatatctctatatccctctggccacataacttaaattttacttcttcctatttccagaagaactttcccttcctcccatcatgttttccttattgattgggaggatgctagtgatattgatgggtgggtgctagtgacagtcaagtgtgatgccctcagtctcttgtacttacgtagaacattaagactaagggtcttttaaattgtaaaatacacataacataaaatttaccattttaaccacagtgtacctctcagtggcgcttagtatattcgcagtgtgatgcacccatcaccattatctagttccagaacattttaatcactccaagtggaagcctcatacccattgagcagtcactccccacttcccatttcccaccgccccggcaaccactgatctactttctaagaccaagaattttacaaggtattttagaaattacaaaatttatattttaagctctagcataagaacaagccaaaagaaacagttacatggaaacgaagcccacagtttgcaccatgatttcattcttcttttcatcatttctgatttgccatctcaaccttggttccaaaacattttgaaatatatccttccatactttttttctcattgcatgcatacaagtgtattcccgtattttgattcattttctgcactgtttataaatatagaactatagtgtacacatccctctgcaactagctttttctgaacaggttttgttaacatgtctccaggtcattaacaaacaactctaacttattcactctgtagctgtgtaatatttcataaggtggctgttccacaaattactcattatgctgctcttggaggccctttgaagaattagtaattaatgcttagaaagtcttatgaggaggactggacaggtagaattagcccattttgtatgttggggcactgaacctcagagggtaaaccatttaaagtcacataagcagtactgctatatgatgtcttgactgctgtcgctcaagctgatgactttcaagtcttctactgcattttctctacatgaggctcctttattttcaaagaaaaaaaatgccctttatgtgggctatttctttttctgatcatttcccatcctattttcctatttctgtgtgtgtctagtatctttttttttttaccccctctctcaacatagcctcatttagtatttggcagttttgcagttgaggtaaccaatgcctcatcactccagaaatctcatattgtaaaatctttagaattaaaaaatccttatacaactgaagaaaatacaagagagtttcaatgacttgctcaagttcatacagacctccagtggccaaggcaagacttgaacccacctcttgtgaattcatatcccatcataggagacagatacacagcagctcccacagcaacattcaacaactggtagtggctctctacagcaccatgtgtgaataaatctgagactttgattgattaatgatgtctgccatgaatgggatgggtcagggagtagactagagagataactaagtggtgatgcatgtgccatgggttgcctttgccccagcacagcgtattgacagtgatgattcttgagtgtgactcgataattattttatttcaagggtttaaaaggtcagcctggggaccaatcacaaagtcagggttgagatcctatatatcacaaggctttgagactacctgaccaacatgggtttaattactaatcctgcaaagactaatatagttcctaacgttttatccatgttttattagtatgctgatgttgaatgttgggtgtgtgttgttggcgtcttcattttttttctgcaatcaaatatggctttctttctcctttggaagaaatgacgtaaggtgggtgaaattgggctatcacagtctcagcattatggacattggggatagctaattatttgttgtgggggctctcctctgatatttagcaacatccctgcctctatccactggaagtcactgacacctccctcttaacaccaggtctttaatcttgacaacaggaaatttctcccagacattgcagaatcccgcctgtatgagaaccactggcttaaactgatacatgttttcaatgggttgtaataagttttttaaaaggtaattttctctatggcccatttgtattgtgggcgttggaatagtgacagaaaagcatgaaggaaaacaaatgtttattatcttttgtaaggcagtgggaagcttttcttttctatagtactgaataggaaagccacaaatacagaagtacattttacaacaataggtggcacactactaccagaagcctagttcagaaagtagatggagacagttttataagtgaatgtatttcaatcgttttttattaacagtattcccaacttcttcattttatttctcttaaaaaagcatattctgctttaacagtccttctaaagctaattttatttttaaaaatgagcataaatttgccatttgctttgcaaaacaaacctgcaatcaatatagtatttataatagagatgtcatataattgtgggattaaaccagattaactttgatgtcaattattttttcaatgcattatagaaaaaggcatttttttaaagcttttctggaatattaggtgttctgtatgtattttttaaaacaagtaaatggatgtttagtctctattagtacttaagaaacactattataataaatatgacttctgttgaaaacaggtcatgagatatcaattgagggtagctgaaaatagggcagctcaatgccttcttttcttttaaaaactcttaaacttttaattatgatgcctcagtgtgtatttggagaagactgtaagttgaaatttaaagattataaccatggtgcttagagctagcataagagactagtttattacaaactccttttaataaactctctgcccatacattgaaaaaataaatgctctccgttttcttcctgtttgagtaaatagcacttccaatgttttaagtatgcagagcatgatcaaagaatgaggagatggagacaaaaagttgctgagtgaatatttttatttttgtagttgtgtctctgacttgtttaggagttg

SEQ ID NO: 106420 - DNA, 1427 bp, Homo sapiens
tatactgcctcagcctctggagtagatgggattacaggcacgcaccagcactcaccggctaatttttttgtatttttagtagagacagggtttctgcaggttggccagactggtctcgaactcctgacctcaagtgatccacccgcctcagcctcccaaagtgccgggattacaggtgtgagccactgcgcctagcccattttttaaaattaaagcttttcaggtaactgttgtttcacatgcagttgtataaaataatacagagaggtcccttttatacttttcccagggtgtgtgtgtattaagttctacacaattttatcactggtgtagattcatgtatccgtcaccacagtcaagattctgaataagtccagcaccacaggcagggttgccacagccaccccccttccctgtccccatctctgtccccaacccgggcaaccactaatttatcctgcatttctaaaactgtcatttcaagatgttgtataaaaggaatcatagagtaagtagctttttaggattggcttttttaattgtctggttttctggacaatcatccaaattgttgaagatatcaatcattggtttctttttattgccaatttttaaaaatatagaatgttactttaagaagatcgtttaggaagctgagcctgtattatgatagtttcagtcacacaaggtgtaaagggaggtcgtttgctatgattgttgttctccagagtctccaatgagtagctttttcttagtggggaaaaaaaaaattggcacagtcactgcttctcaaagcttttgtcaagctgggggccaaaaacaaaatcccacgaaggcattgatcaaagatatcattgtaggaggaagtcctagagggcagaaaatgctgtcttccttttgctgtcttgccacagttccctgttattagagtcctgtcctttgtcttcaaagctttggagaagtgcttcacataaaagacaatgaagcaggggccacctaagaggcttgtctttgttgttgtttatgcagaaagtactgttctctgctattggcaaagtaattttcagctctagatgagcccagatcagtcacaatagttttcacaagcctgataggaaggcctagagtggtgttaattagtcagagatgggagaaggaggacatgtgttagcatattcaatcaatgcagagtttcttcaactggcatgggggcattcctcagcagtcactgctacagtagggcacttaatgcatgccgatgcccgtgggtttgattgcactatttaaattttctgccatgcatcccaatggtggcgaaatactgctgttttagagatgcattatgagttgtgaaattagattgaaagaaccttatgggggcagaattaagatatgacacaagcagaggtgaaaatggtaaacatttg

SEQ ID NO: 106421 - DNA, 3428 bp, Homo sapiens
agcattcaaggattttgggagaattaaggcaaatcccagggggattaggaaaccagagtcatttggttgtcccttgatctttctttaataaacgatcaagttcagctttgcatggtgaactgaatttgtttcagctcttaattttttaccttgtagctataattctctggctgctgttgctgtctttaaatccggttcaccagccacctggagcattccaataacacaggcgttttaaggttttcacttcaacatctgtgctttggaaattgagaagagaccacaatttaggaatatgctgagaaggaggcatggaagaccaggggttccatctcctcgtaatgtgtggtatctgttctctcattcttcccagattgctccacaatgttcctctccccacttctatttaaatggtccaggggaagctctgtcatgatatttcaatgtctcaggaaggcccaccatgccagcatgccactgtcatggggtcacattcagtcattcattcccttgctcacgtgctcagagaccattttatgttttgcctgttcctaggctgcatgttcaagcacttggctgtgtttgggtttctggagactggaagtcatttttgctgattaatggggatgatggtatttttgtccaggagcaaactggggagttgctttaggtatgtggccaggagagaaatgccttggatatttgtggggttaatactgggcttattagaatgctgtcagtcactccttgctctcaactctagccacccatgccaaacccccacaacaatagtgacaacaacagcagtaataatagcagctaccagttagagagctacatgtgaggccttgtttgagcgtctcatttaattctccaaaaatcccacaaggaatgtgttgttattttttacttgttctagctgaggaaacgggatattagagttctgagtccaaagcatgtgtcttgtaaatggtgaagctaagatttgaactcagataaccttgacctagtacccaagtttgtaccaactgtgcatcattccctatcaccctaagctagggagtaggtcgaattaagggtactaccttcatatggatggcccgatacctggtcataatgaaatcattctttcttggccttggtctctccacctgccgacagggcaggtggcagcaagctgcttacaccacatgagcatgacagagcccctttgtcttctcattggccaagttcttcttcctctcttcataaataacttcagatttcctagcccactgctctagaaaatgtatttcctctgatggccacacagccggagcaaccccagaaggcctgtggtgttgtgctgctctttattttctgccagctgcatctgtactcttctagaaaatgctgagattcagcagttgctcaaaaggcactgacatctaattatcatcctataggctgttgccacaagtctgcatagtgaagtcaatgctgagacaggcttcctttgccagtcagaggggctctggcttgtttacagatagaatctttaactcctttgaagggccagcgtgaggatactgggaaggttcctgtgggacagttttataattgaaccagggaactcctctgtgcctgctcatatgtgatatggataagtcatgcagcaccggtcctcctgcatccaggaatgggctgacattgatctgttcactcttcagggatgctgtctcaactacttgcacaggtataattttattatattacgctgcatattaaatacctgcacttcccttttcccatcctgatacagatgatttcattttgcccacagtaacacatgcttctgtttgcacgtgaccatgatcattttctctacctctaggcttacagaagggccagaggtggtgctaatcaggaactggaaacttctgaccccactgtgcaggctggagtagggttgaggctgtggctgagaaccagaaggagaaagcaagggcaagtccccattctagaatacctggctaggatgtgggggagagaggtgagcatagctcctttctgtaaaaattacacttacacagagcttccctggctttggaactgtttgctcttttttttttttttttttttttttttttttttttttgagacggagtcttggtctgtcaccaggctggagtgcagtggtacggtatcagctcactgcaactttgcctccctagttcaagcgattctcctgcctccgcctctggagtagctgggactacaggcatgtgccaccacgcccagctaatttttgtatttttagtagagatggcatttcaccatgttggccaggatggtctcgatctcttgaactcgtgatccatccgccttggcctgccaaagtgctgggattacaggcatgtgacaccgcacccggccaaagtggttgcttttattctaacaacgtctgtgtttgcaacggaagagagaccacaggagtgctagagcctgagttcagggaagggtttgacaggagtttcaaggcttcttgttggcggggtagaacatcatccttccagccaggagtagctcttcatcagattgcccgggattggaaagggatcagtaccagatggcctcctggccccagaagttccttctggagcagaacagagttttcttgtcgctatgattcagcaacagcaggcattgatggcggccccactgggtgcctggcatggcatcataccccctgcctcccagaacctgcggccctcctccatggccaaggagcaattgcatgtggagccataccagcagcccccattgagctgacttggttgcctgaagtgagaatggttaaatgggtaattgatggaagcaaaaagccaagggaaggaggtacccgctgggtaactggttagtgtaagaggctatgtgtgtgtagctgaagttgatcaccattccaaggcgagtcttttcccctctcttctttccctcctttttatttaacaataataataactttattgattcattgctttttttgaggcatgcattaagcccttcacatttattaacttgaaaaaataggggagttgagggcccagaaaggtaaaatgaagtacccaaagtcacacattttagtgagtggcaaaaatgggatctcagggcatggttcctatctcttgacaatctaagctcttcaccctgtacctcttttccatctctgcagccctctctccctctcttctttatagatactctgagcgtttatcttgcatccagttagcaatgcagtttcagagatagaggacataggacgtcccttacggaactcaaaattgagtttgcagagacaaccttaacctttgtaaggtgagggaagcctagagtctcatgtggtgtgtggggcccagggatgcgtttgtaaagcttgggtgcagtggtct

SEQ ID NO: 106422 - DNA, 1137 bp, Homo sapiens
tggcctctctgctgcctgatgcactgcgtccaacctgccttgagcctgggcattcaacactctgccttctttccctctgcctttccttgttcactttcccccttccaatctcttttcttcctccttttaaattttccttgtgtgagtttgattttaaaggttttgttgggcaaagtgaacacacttggcttatagaatcacccttagggtaatttgttacagaaaattctgtgtaatgggacagtttttttgtttgagtcagcacaaataaagcaaactctccagggttgtggtcaaatgctgtttcttacagttctcaaggtttctaagtccaggctctctagttctcatgttatttggaactcctttgggcattggtctttgtatctaaaatggtctcatgtttaattcaatgtgcgcatttataacaaggtctgatttgatgacttgttcagaagggtgttttttttttttgaagattttggtagaattgtatgattttctggtctttggactagtcacttctaataacttttttttggtgagtgagtctggtcttctccatagtttccacgcttcataaagcattaggaggacggcatttcacttgccgttccccatggtctaatctcctgctgattttattttaactctgagggatttgctattggtccagctttaccatcagttgcatctccatcaatgaggctgacctggagggactggattcaaatagggagcagcatccagttccctctacctagagattgccaacttctctgaagcatttccatgaaatttataatttaatttctattttggctcaagagcatcttggtacaaatccttgggtgtggccctcttttgtaagaagtacagaatgaaagaccatcttgcctgcaaactgtgtgcagatctttgtgagaaataaagtcatgtttcattattttggctgcatgacttaaaaaatgtcatgacccagaatgaatattgcttttcagtcaggtggttgcacgtttcaagatggctccagtggcttctgaaatgtgtttaccctgcgaacattccaaagttgtctgtgctttgtccagaatccctggatgccattcattaaccctcccctcccctcccctcccc

SEQ ID NO: 106423 - DNA, 1059 bp, Homo sapiens
agtgtaagaatgaattcgagctgtaaaaaatgtgattctttttctttttttttgaagagccattgggcaggagtaaattggtagaaccattttggggagctgtatatattcagtaaagttgaagatttctatgctgttaggatcaggtaatttcatttgtaatttagagaaattttgatacatgtaacctgggtgacatgtacaagaatatttgtaacagcagtttgtaagcggaaaactggctacagcctcaatgacattcaccaggcagtaggtgaatttgatgttgtttattcataccttgggagaccatgcaactgctaaaatgaatgaataggaccagcagatcagtgtggatacatttttagctttactcataagatgtcatatcttaaaacatctgatacagaaatagaaaaatatgaaatcatattttaaatatagtagcaaaaaaatatagacatagcaaaatacggaatcttattttaactatagtagtgactgtatggctgttgattctgttgtttctgggcatttgcagcatttcttacttttagatagctgtcggaaaagaaaaatactataggatgggttatgggttgcctttggcatttatttttaatgttatacaatattgtatttttgaggaaaataaattggtaatgtgtggaattgggtaactggggggaggggtagtttttgtccactgtattctctgcttattttttatttactttttaccattggctctctggtataagaaaaactgaatgatgattaagttcagttgacgcagtataaatgattagctaagtgatcagggctctgaggctgcctttctgggtttatgtcccagctctcattcttactggctgtgagataggaggcaagagactcaacctcctcctgccctgttgcttcccctttaaaattgttcagtagagcagtgaggattgaattggattattcctgttgattcaagtactggacagtgtttgacacagaataaatgttagctgtttttgtattattatagtttgatatggaagaaggaactgt

SEQ ID NO: 106424 - DNA, 1007 bp, Homo sapiens
agaatattttgcattttaatttgcagggaagaaaaattatattttaaagtccacagtttctggcttttatttacatattttggactactttggttatgcagggagcacagaaacatgccttagcatttggatatttattattttctaagtattaagaacgtggatgttctgcagcattggagagatgtttgagaatgctggcctggcctggccctcagaagttaatttagggtttttaactctggtgcaaatgcttaggttaccggcagggggttaataagtaaaccacagagaagccacaaaggtgcctacatgtggttgttgtgtagtttatcattagaccagaaagcgggggaaacagctgaccaaccaattcacagaaatttatcataattgagtggttaatgcaagcatactaaacagattaaatctcaatagtttttgtgtataccctggtagaaaaagtagtaactgcttacttgcacatcggaaacatgctcatgggatgttaacgtgtttgcatgcagaagcttatgatgcaatgagactgaaataatgaaaatgatgacagtaaaaaggagaaaatgtaaaatgcatgctagttggtaaaagaaaaaagtcttctctttgcttccaaggtatttaaactctgaacaaactgtgtgtgttgtggaatatattgggttagcgacctttcagaattaggaagaagaagttgtatttttgaatatagaaggccagcataattactcagagtacagtaaatgtccctatcattctttgagtttaatcttaacataattagctcctcgcacaatagagtgtttaatttgaaatgctgccaaggctcattaagtgagagaagtacttcctgagatctctgttgttaaatttgggattttttgtatgagataattttctcaagaagtgttagggtatcagaattgttgttcatattctgacatttatcacccaaactcactgaaacacttaacattttctgtttt

SEQ ID NO: 106425 - DNA, 1119 bp, Homo sapiens
gaggtcttcttttctttctttctacggttttctgtagttttcagtgtataattcttgtattttgggggataaacttattcctaaatattttattctttttgattttttttaaacgaaattgttttcttaatctcatttttaggttaaatgagattaatccaaaaactgaattttattcagtcatatgttacttaatgacagggatatgttctgacactttgctcaattagtttattggatctaatagttgtttagtagattttaaataatttctatatacaagagcatgtcatctgtgagcagaggtggttttaattcttcctttgcaatctatatgccttttattttttcttgcctaattgctgtaactagaacctccagtgcagtgttgaatagaatagtgagagtggacattcttgctttcctaatggattttagggtttatatccttctactatctgtatgtatatttttatcctagctcagctccgtatggtgctttgtataagcctttacgttataatgaaacaaatcaaaattccttttacaactgagaatgtcaaaaactgaaccaaggattgtcttcactacagcctatggtttttcacatgaagtattcacttcaaaaatgacctagtgatggttcctttgacaggtccctttgtatgcagctttactgcattctgtcatgagacagcaccactagtttttgattccagtaatacaatgtcacatctggcagggatttttaaattcatctgtttatcacatatttattgagtgcttatcaaataccaggcataattgatgttctggggaaataacagttaataagaaacttagagtcttgctagaggctgacagattaagaaattgacaaatgtaaaatttttagactatctccccactgctaccttttctagaatttgtattttagaatacatttagcaacggaccggccgtgcacaatggctcatgccgcacacaatggctcatcccagaacttcgggagaccaaggcaagtggattgcttgagctcaggagtttgagatcagcctggccaacagggtgaaaccccatctctacaaaaaatacaaaaattagctgggtgtgttggtg

SEQ ID NO: 106426 - DNA, 1004 bp, Homo sapiens
tggtaatgctatattggacaacacagtttggatctaccaatacagtggagcatttatagactcactcttttccttctctcctctcctctcctctcctctcctctcctctcctctcctctctcgacagggtcttgctctgtcacccagactacagtgcagtggcactatcgtagctctctagggacttgaactcctggactcaagtgcagttcccgcctcagcttgagtaactgggactataggcatgtgtcacctcacctttcaccacctttttgttgggtctaaatcttgggacctgtttaatacagagctggggtaggtagggtagattcttattcagccagctacactgatagtcattttcttacacttctggtgccttcagaatggaccacaggtagatggaagacaccacatgcacacacagggagagagggaaaccctggacactgacccaggacaactcgagcaccaccccctgacatgtcatgtactacttggagaaagagagaggagaacctatcatggaaaagttatcccacagtttagataacttggaagataacttcgctattcctgctcgatccttccttccaatttcaaatcagaagaactgtcttccttctgaggaagaaaagtgggtaagtggattcaggtggagaaattataaccataaccctcctcttataggagatggaggttaaaactgttactttttatggctacttgaggagacacacaaaagtaaacctttctgcattgagttttcaagtctcaatgactacctagtagttcatttacttacctatatttgtatattcctctttttgtagagagtatttttgaatattttggtttgagatcatggggaaatcgttgcactgatcagtgactaggagtcagtaagatagtgttgaaggatattgatgtctgatgttggatggtctacaacttgtcctgtatgccttccccgccctgccccttgccacctccactgctgttag

SEQ ID NO: 106427 - DNA, 1044 bp, Homo sapiens
gtgaggagagaaggaaagttgaaaaagaaaattcacaggacgatactctgctgtgatttctaagcccctggcaatcatttctttgctctaactaagagccattaaaccagttctaacaagagctctagacatagtgaaaaacacatgctaagaataaagagtccagcaaaactttgaagattttctcacttagagatttcccagtgtactgtttacaaacatgtccccagtcttgaagtgtattcagatttctttaggctaggaaaacaaaacaaaaaaccaaaccaaatgcagacacacaccagaaaggaagttcctttaccaattcatgaaattctgggaactttttatgtgagctgctatttaaccttttgattgctgtgtggtagttttggacagtaatcacattacgtggtttgactactgttgttttgcaaattctatgccatatattaccagaccttgattatggatgatggctttcagtaagttaaaaaaaaaaaaaggctgatggttaaatcatccatatttatttagggcaaaaatgaagacctcagagtatctttgcatatattctttattcttaaagaaaaattaatacaccactcatctatattgctgaggtcacattcctggaaatgcaaagatattagaggaacattacttaaaatctaatttttcacagggacaacgttatagattcagtcagagagctctggagaataccaaaatggattaaagtaagtccaagtaaaaaaaccaaaaaacaacaaacatagagccaaagtcaaagacacagaaggcgctaaaataggtattatgtgatggtgaatcacgtcttcctctatactgtgaagaggttttggagtacctttgtattattttataatttcaaacttagagaaaagttgaaagaaaagtacaaaaaccgtctgtatacttttgatctagtttcactaatttttaaatctttgtgtgtgtgtgtgtgtgtgtgtctgtctgtccgtctgtgtgtatttattagtgaagttttagacgtattat

SEQ ID NO: 106428 - DNA, 1004 bp, Homo sapiens
atgttttgttactttacatccatatgaaaagatagctctttgttttataattagtaagtacttttgccaactttgatgagtttaatattacattttattcttgaaaatttgatgtttttacggatagcaacttttttttccagatatatatgttgcatgtttaaaaattttttaaggctggttgcggtggctcatgcctgtaatcccagcaccttgggaggctgaggtgggtggatcacgaggtcaagagtttgagaccagcctggctaacatagcaaaaccccatctctactaaaaatacaaaatttagccaggcgttgtggcatgcgcctgtaatcccagctactcaggaggctgaggcaagagaatcacttgaatcagggaggcgtaccattgcactccagcctgggtgacagagcgagactccatctccaaaaaaaataaaaatacaaataaaaataaacttaatctcagtgacctttgtcatcctccatcctaccctgcgtttgatcccagctggcttgactctatcccttgaaagaccaattttctgaatcccctgaaagacaatgtggagattttctatgtgtaaaccatttaattttagtctgttcatggaaacacatctctacagatttaaaagaattgtttcattcatagccattttttggtgaatcaacctgagaatcacctaatgatggtgaacggagacagaattgaaagaatgaactttaaggtcaagaatgttgttacagatgcttaccctctggaaagcacatgaggtagctgagagcagtggagatcatcagaggctagttttaaactagaaaacgcattttaatctaaagagaggcaaagtgttttgtaagccattatacacaaagtacttcctgaaatatttttgatcctctatcatgggaaggctcagtttcttactgtaatgaagatagtctgtgtaagatgttcacctacttttgtgttgttccttgtggaaattagcatta

SEQ ID NO: 106429 - DNA, 1252 bp, Homo sapiens
ggctcaagtgatcctctcacttcagcctcccaaagcgctgggattacaggcatgagccaccatgtgatttcaatgctgaaataggtacctgggtcaggcgcggtggctcatgcctgtaattccagcactttgggagggagaggcgggtggatcacctgaggtcaggagtttgagaccagcctgaccaacatggagaaaccccttctttactaaaaatacaaaattagccgggtgtggtggaacgttcctgtaatcccagctactcaggaggctgaggcaggagaatcgcctgaacccgggagggggaggttgcagtgagccgagatcgtgtcattgcgctccagcctgagcaacaagagcaaaactctgtctcaaaaaaaaaaaaaagtacctgggtccctttaattgattattgatatgtatgtgtattaatgaatgaaataaaaattggggctcactttgttcagtttttaataagaccatcttaaggggttaggctggttaataactaaagagtagatacaatacagcataagaatcaaactcgattcaaaaccttcattcccagtttctaatgcagggatgtaacagatgttcttacatttagactgttatcttgatgggtggcacgtcattatcgtcgactgctgatgaggtgcagatgaatgctgctgggagccatgtgtgatagtggaggaagttctaattggagtgctctcagtacagaaaatttaagaatttatcaatgttttaggagatagcatattttgggaaagtcagtgtgtctgcaagctgctgaaagatgttcttgtagacttgttgaagaattatgaactgcaggatgccagtttttgaaatcccaattcctttggtaataagtataaaaatagccactataaattgagccccaggtactgttaaactaacttaattctcataagaaccccataaggtagtcaatgtcaatatctctttttagcattttgggcaaagtagatccagagtgattacccagagtgattgattattgactgtaggtggaagagcccattatctaccgttagctttggtagtcttaaccgctatggcgcagctgcctctgcagtttggatggctcatacaaaaatccacttgaggactgggtgatactttttttggtaagacaggttttctttcatctaatgaggtatgttttggagtctttatgtgaaacattttcttctaaaccatgattattaagggcaggagctac

SEQ ID NO: 106430 - DNA, 1059 bp, Homo sapiens
tggtgggggtgttatttgcagagaaagcagctggcactaagtttacaggctaattagaaatggtcacgcctctaatcccagcactgtgagaggctgaggtgggcagatcacttgaggtcaggagttcaagaccagtctggtcaacatggcaaaaccccgtctctactaaaaatgcaaaaatcagctgggtgtagtggtgcgtgcctgtaatcccagctactgggagctgaggcgaaagaattgcttgaacctggaaggtggaggctgcagtgagccaagattgtgccacttcactccagcccgggcaacagagcaagactctgtgtcaaaaaaaaaaaaaaaaaaaaaaaaaaaaaaaaaggtcagcttttatcttatctggtgctggaggagttggaaactatttaaaagagtaaccaaatttaatctgaaaaagatggtttactctgttggcagctgagaaataaaaagactggagtaaaaattggaaagagttcattagtaataacaaaacatttatttttgggatccatgctatggtttttgacagtcatctcttatttattttcatttttctaacagctcttagggtgaagaacagtcattaattcccctttacagataatagagacttactaaaggtaatcgcctaacttaatgtcacccagatattagatattaagtgtcaaaactgtgatttcaacttgggctttatggctccagcaatgaggctcttaaaacatggtcacaaagaaaaccttcttccttgggatgaatcagatttgagaagatcaagggagtaacagctacctttgcccttggagatcagatccacttagtagctctaagttattaatcttgcttttatttttttttttaattgtatgttagcgatccttttgttaaatgcaatgctagcatccctctctgtcaggagtttgaatctcagcaccattgatatttggggccccataagtctttgttgtaggagggtatcttgtacattgtggaatggttagcagtatctctgggccctctgcccccatagctgtgacaacc

SEQ ID NO: 106431 - DNA, 2232 bp, Homo sapiens
catgcctggctgtatacatctttttaaacattgcacagaggtgctccggcctcattgtttgcccttatgctgctgcttttttctgtcttcctcttcttctgactttatccttgtttctcttattgtatctctagaggttatgctttagataatttgggcaagaaaagttgaagcaggttctattagatgatacatcagaatcatctgagttcatatttaaacctagcttttctggtttggcagttgaaataggcatgataggttacattgcgttgttttgcccaggcattacctctcctcattgtatgatttttgcaatggagtctcttttcttattgaataaagcatgtggcaaaggtctttaaatggaaagaaccttcttttgatggtctacttgctgttgaagtgaataaataaagaagaatgaagagccaaaagaggaattcaaaaagaaagaaaatgattctgttgattctggggtaagattaatctgacttgagccttggttctggaaataagtaacattgtgtccctggacaacttgctcaatcccttgttatttatttgtctgtctgtctgtttagagacagggcttcactctgtcacccaggctggagtgcggcggcgccatcatggctcactgtagccttgagttcttgggctcaagcgatcctcccacctcagcctcccaagtcactgggactataggcacattccaccatgcctggctgattttcactttattttattttttgtagagatggagtcccattctgttagccaggctgtaagttttttaaatttgtgaaatggagacatctctctgggtgggttaaatgaaataatacaacttacctactctgcctagtgcctaggttccttgtgtgccctccataaatgatggttagttctgataatggtgtgttagttacacatggaatgggtgaataattctgacagggaagaagaatgaaaaataggaggtggttttggaatgattgctgagacagaattgctaatatttttaggtaaaaggaacgtaagggaaatattttcaggaaaaaatccaaaatgactgaaacagttgtgtttgagagtgaacatggtgaaaacttgtgccttgaaagtgatttcatatggccttttaaaaggccccttcaggagagagagctgtcggtttctgctttggtgtcatttcagtcttgcttggaacattgctctctgttgttgtgctgtctatggaaaaaagggtgaacctccagaagactcaccaggaatgggtcccaaaccacacttccctggagactcatcggggaacacctgctactggattttcagaacctgtttgtggattccaattcagtagatttgggggcagggggacaggcatctgtatatagtttgaaacagagatcctaggaaattctgaaatggggccaatgtgtcagtgggattcatcgggatgtcgtgggatttagcagctgtagtagcatcttcagttctgctaccaactttgtgtgtaaccccaggaaaatcacttaacctttttgtaccttctttaactcagccttctgaaagaggaggcataagggataataactctgacctactttacatcgttgtgaagaattactttaaaaaatgactgcaaagcactttgcaaatagaaattgctctataaatgtctgttttttaaaaaatgtaattttctaacacagttttaaacacaaatagtcttgttgagtgcatcagctcaaattacaagtatcaaatgacatggtatgatggctagaaatagtgtttttttttttaaatacccaaagttagaggcaataaggaaacaacacaaggttgtaatgtcgtcgtttatctgtatcatcgttaaaaaataatgctgacgctaacctctacatccacattttccggtttgttttgttttgtatttttaataggctactcccatgaatttgagaatttaattagaaaaataaatgacttctaccattgctgctgtgctgttaattctccccctccttcccaatctctcaatgaaaggcctgctcctcctgtcattagacacatctgtggatctgttagaagtctgtaaatggacgcacacctgcagagttggcaaagactctgtaagtccccatcctctgatgtaaggtgtgttttcctgtcattcatccatccctgcaggagcaccccaaacacctcctcttcaaatctgct

SEQ ID NO: 106432 - DNA, 2466 bp, Homo sapiens
aggtccacggattgtaagcttattttccacctccaaatttggtggcaggatggttgaggtggtaacaaatatcagacaagttagaggacagagtccatgtgaattcagaacacataattttaggcacttgtcactatatgtgtgtactgtagttaaaaaaaaaaatcgtaggtggcagtacagaatagttgctctggagtgtcaccagccaggtaaaaatcctggtcccgctgtggttttaggcaagggatctaacctcacgaagcctccattacctcatctttaacctgtggatgctaacagcaataatctcataacaatgctgtgaaggtcagtggaaataagcatagaaacttgttagttcagcgcctggaacatactaagtgttcaacatagctgagcgctcttaatctgctgacaaaggcagtggtgcccttgtaggaatagatggcaaaccatatggactaacgtggatttcagatgttctagtagtctacatttaaatatttttaagctcggctaccaataaacttaatggcttatgttttgttgggttttctcttaagttatattttgctaccatgtctgtatatatctgtagtttttcatacagataacacagtatgatgctttgtgcatccttcagcagtgtgttattgcaaacaaggagtgtgaaggttgggttggtaagcaaagaactgcctccatatttgagttctgtgatgcaaaaaagttactggatggctttcaactcttaattaatgtttctattgactgctgatgctaagaaagtattatcacttgttccctctgggtggtatacactgagatgaggtagataagaacaaccttggatgtactgtttcagttcccttggaaactataaatccaaaggtgaatttgcacgctatgtgcaagatgtatatgcttcccaatttcaactgcagttccctcagtccacagagaagtgttcttgttttgtactgtctattgactgggctaagcgttaatagcatcccagattcttcaatccagcaagctttagagccttttcacactgattctgagataagccaatttgccaactgctttcctagggtgaccacctgctcctggggtctgaaccatctgattttagataaattcaggctccacaatttgtagaatgccatttctttttcctttactttgtaacattgatatcactgctagatatctggaccttaaaaaagtaaaagaaacctctttaataaaaaggatgttttaaaatgatattacctgataattatgcttgcctatttttatacctcttcccccatttttccttgatgaaggtttttgtcttgtaatgaaacgtggtaataaagagcatattggatgggaaggtactctattgtcctaccagcttggtgtggagaaaataaaacgttaggtatacactgaattgttggttatcacccagtatgaattgtccttctcaccatggggtgtaccatatgcagactgttagcctgctctggggacctggagagatgccacattcttctgtttccaggctgattggaactgaaagggttgggcatgaatgttagggtggcctaaggtagtctttctgcctgcttgtttggaaagaattaggtgggagaacatgctgagagctactttccattgtatggttcttaatacctcagggctgattatagcattggagggagaagcaggtgcttgctagacaggtgcatgtaggcccaagggaacaaatgtaattcattgagccttagtttccatcacctgtgtattaagattcatcaaatggaagacgcccttgaatgtaagacctgctatcttttatgtacccctaaggaagaaaactcactaccaattaaactgtgctatattgctaagttaccatcaataatagtatctgtcctgatttcagagataaaagatgtaagttgtaaaatataaaagcacttatatcataaatttctaaggaccacattagatagtatacctgtaaagtatcagcagtgtcttaacatatagtgagcactcagtaatcattaactgtcttctctcagccctctctcctggtagtatttggtaaatacttcctacctggtaaatctttattgagcatgtaatatgtatctatcattgttttgtgtatctggcatatatcagtgaacaaaatagtacatagatcctagctctgttgcttatttttgatatcagggatataatgtggacttagggacctgccatcttggtaactaggagagtcgcccctcaactcagctctcctttcccaccaggggctgctttacttggccttgtctttggggttgaatgtgtgtgccagtagcataggcacatgtaagacctgccaaactccttccagtctcattgccttccagtgttttctgtgtaccttacactctgtctaagctgatggcataccttgcc

SEQ ID NO: 106433 - DNA, 1924 bp, Homo sapiens
aatgcgatactgatactgcagtcacgtggctattggcttctttttttatttttagtttttgagacggagtcttgttctgtctcccaggctggagtgcagtggcacaatctcggctcactgcaacctccgcctctcgggttcaggtgattctcgtgtctcagcctcccaagtagttgggattacaggtgcctaccactaagcctggctaatttttgtatgtttagtagagacagggtttccccatgttggccaggctggtctggaactcctgacctcaggtgatccacccactttggcctcccaaagtgctggggttaattgcgtgagccaccgtgcccgggcctggctgttattggcttcttaaggaagcccacttaacagtaattactggccaaagatacatgtttttattaatgcaaatcagcatgtcacactgaattatataaacatatagtgtgtatattaaacaaattaagtcatgaccttacaatcaggtcatatggtggtctgtacttaattatttttatattttattaacaggaagtgtgtaattaagcacggatggctcttcccacccctttcctttttacatatgtctgttctgtcttctcacatttctggactgacttaaacttgtcagccagaaagatggatgtcattcaggtattggcaggaagagatgcttctgtaaatagtctctttcacatctgggtgttcagttttcctgctggggctgagagaatctgatgagctttgggtatttctttccacagccgggactgatccagcctgtgcctcctctctggcgtaacctcatcctgtccttcctcatttttaacacccaagtgcagctgcaggggctttcatccgcctcagacttgccagtacccaccacttgaaactgggccctgctgtgattgtaagtctccatccagaaggagctgggtttttttctcaggactcaagagactgtgaaagtctgaaaaaattttgtgccaagagaaagaagtgcaaacatcctctgttttctgtctctaaagcagggtcagtggtttccagtgctgtgtttttatgtcatttgactaaccatctccctacaggcccaagcaaatgtgggcagtgcagatcaagcctgcttcccaggactttttgagagtgacggtggtacagtatttcactgtttgtagcatgcctatagactgccaatttacaggatttaaaaccttcctggcagatgtccagaggcctctggctcatatctacctagtttcatggttggctttctaactcttacataacagctggggtttttcactacatttaaattgttactcagaatttaatgtagtctttctaaaatgctgtcccctaggtggcttaacaaaggtgtaaatccagtctgtagaagccaagaaaggcattgcatatgagtatagctggtatttacatttcacatatgtatttttttccagttgacaaaaatcagcccagtaattttaccctgggttttcatcctagtaaagaaaattgttaaatattaccaaagtataaagtgatctttgattctaattggaaagcctttttttttttgatgctcaaaagtaatgttgtaaatgggtagaaaattgtccatttggttcctgctgtctgtcttttcctgcactttgatgaaggaaaggctttttttcccccagtccctagaagacctcaaaggagctgctttttgaaggaaaaggcttcattctccctgctcgaaagattgccacactatagatatttgaaaatcagatgcggtaatcagaaagctattctgatagtctgactgctctgccgatacaggttatattactctcacacaatatgttatcacgtaagggctggggaggacatacatacttcagtgggtaaactgaggttagggaca

SEQ ID NO: 106434 - DNA, 1054 bp, Homo sapiens
gagttagatttttaaaacgctgtctgactactgttgctcctggctacaacattaaaaaaaggtgtcctggttttcttttcaggaaagagcgatatttttatttttttcatagaaaacagaattaaaccaataaatgaagttattacacttttgagttggacaacttaaaacacacaatgtttgaaattataaagcatttttgcaagaagttgttatttggggtaacatattctgtcacagtatgctacttattccttctcttccccaacttcccccaccccttttttttttatataaatggtgtcatagtaaatatttattatagaatatgataactactggcctggttcttaatgcctggtttatactcttgctaagaaaagctcgagggtgactctcaaatctcaggctaattctaaaaccaacaattgagaagcctcctttctggatccaaaggcacatggtctctctcccctgcctccatgatcaaggaagacatcactagttgatcaggccgtcttcccagcagagcccagatgtgccctcctgattcttctcagcattgctctgaaagctgcctccatcagtcatgtcgaattggtactcacgatgaaatctctttgacatccttgaataaaagtgtgtttttatggaaggtccttttatgagcaaaaccctgtgctgaaggggattgcagaaaatcctttcttctgggaatttataagtctagtaaggaagattattgcagcactgggtagaaccataagcaaaatgcagacaaaagttcctgtaattaagggaacacagatgataacgattggcctggaagaattcttggttgctttgatcttatctgaaatcggactgtcagtgggacttctttctcaattgtggtaaagctaaggagccgatttcctttgtaactgctgagcagagaccaaggtacaggtctgaaggaacttataaagtcagtattttggaactggatgcagcggctcatacctgtaatcccagcactttggaggccatggtgggaaaaatcacttgaggccag

SEQ ID NO: 106435 - DNA, 1052 bp, Homo sapiens
cgtgtattgatccatcccattcttacccattccccacagggagacactttgtttgtcctgatgaattttgcaaatttagtgaatttgtttgttgccgaatgtcaccaaaatgtgctccatcacttcctaggatgactctactgttgctctgcaccatctctgtttgaacatcaagagtcatatgagcttaccaaagattctcattgcctcgtatcctaatgttgtccaacccagtgggtatgaaatggtaactcactgttttaccttgcctttctcttgttgctggtgatgttgagcatcattttacacctttaaccactggattttcctctcctggatattgcctgttccaatttgttcctgttcctttcctttctatgctggtagtgactgtgttttcttaattatgtttaagaaattgagagtgaagccagccttgtagtacctggtgcaggctttgtgtctgtgagataactcccgaggctcctcctagaatttctttttgtcttttaacaatccaaggctgtcattttccctatgctgttgattcccacctgctttccccacagaaccccctgcctctgttcggtgcagccaggaggaaatctgagcaagccccagacggtccctgctttgattaaaactgtcaggggcttcccttggcacttaggtggaaggcctgaatctttgccaggtctcagccccacctcccatgattcaattcttgactctggttgtcccccattctttatgttctggccacagaagacctctgccttattcttccagcaccttctctgggctcagcacctcttattccctctgctgctcctgttgtcctctctgcatcctctttcacctggataacgtctactcttccagtttctcatagtgtctttaggaaagcccctcttgaccttcatactcctctctcctatgacaacctctatttccttctttcaaaccctttcaatacttatgaactgatacttaatacatttttggtttcaagacaaagaggggaagggggcagagacatttcccttgtgaac

SEQ ID NO: 106436 - DNA, 1172 bp, Homo sapiens
ctttggcttcctatgttatttttactaaatatttgaacctatttttccatttgggactacttttgattctgcttttcacattcactatgaaaatacatttaattgcatttttcttgttgattgaataaatatacttaaatacatatctttctgttaatattgtctacaagtgtatttttaataggggatgtattttacatgtcattaccttaaatgtcattatataccatgctgctgcgtcatggtttgtatgattgtttccccattttgaagcattgttttcaatttcattattttataatgaaatgtaatatttcttggtataaattaatttcttttttccccaagttacttctttgaaattactgcgtttgaacagctcttattaaaggctgctagatcatttaaagaaagattgaagttggtttcattgccagcagtgtgtacctgtttatctagagctctaccaaaaattgaattttataatttcattgtattttaatagctgtgaagtgtaactttaaagttgtttcaatttgcatttctttcactcctggtaaatctgtgtatttttcaccaggatgatttacgcccccaatttcttctattttaattgtcagtgtgcatcatttgatgtccttctaatgtaattaaatcttttctttttgtgagtggtgtaaggagcgagtcctcaggatcttatctagctgccttctatttttatgaagtatttttgtagcctcataggatttccttctaagagtattccttggtactcttagaaaatgcgcaacagtatagtcagctttagaaataccccttctttatatataatttccatgggaatgtagttatggccccttaccactattaagaccaaaacagtcagcaaacaaaacaataactcttctatttacttgggtgagaactagcccactgagaaggtaggaggaatttgcataatgaagagggtgttttcttggttcccttttaaatttaaaaattactcatggatttgcattctgtagtgtctcagcatcatttagaattaggctttgcttactgaagtcaaactgcaaagcttcacttatgtatgacttaattaccctttaatgttaaaaagaggaaaaagtaaagaaaaaaaatcctttggaattggtcatcatgattga

SEQ ID NO: 106437 - DNA, 1673 bp, Homo sapiens
gactttgaatttctgctccctgctcatttctagagaaatgttccagagaaatgtgactcccggcaatatttggtagctccttgccatctggtagtcatcattgactgcgtctctttcctgctatgaatacagcagtgtaggaggcagatacttgcctatgtccttgttttcacgttccgagtttaagcatctgaaagtattcttcgtaaattagttagaacggtcttggcctttatgaataaacatgctgttctgaaatgatactagttttccccctttagagtcaagtaccttcctggtttcattaattcaatcttcttcctagcttatttccaagaaattacaatattgacccatatcgaggtataattacctcaatatgtaagtaattttaacatgtagaaacaggttaggaaagatacacacaaaacaaataaattgtcatgaactctcctttgatgaggaggatgggcataggcagagaggaatacgtgggctttatatgggatgcattttatttttctccaaatgttaccatattgtttgagtctttttaaagcatatctattacatacataataattaagtgggctgggtgcggtgactcacgcctataatcccagcactttgggaggccaaggcgggcggatcaccaggtcaggagttccaggccagcctgaacaacatggtgaaaccccgtctctactgaaaatgtaaaaattagccgggcgtggtggtgcgtgcctgtagtcccagctactcaggaggctgaggcaggagaatcgcttgaacccaggtggcggaggttgcagtaggctgagatcaagccactgcactccagcctgggcaacagagtgagactctgtctcaaaaataaataaatgaataaataaaaattaagtgggcaagattttgaaacttatcttaagataaatagctctgtcggttctccatttccttttctttgcatgtttggaagcagggcagtgtttctccccctattttcctgttctgtgttttctgaatatttcagaacatctctctcacttcttttctgttgacttcaatatggcagtggaggggtagttgagctgaaatctgattaatgtagcaagagacggtgtcaagttagaggaaggcattgttgttctgtaattagagccgtgaaatatatcttatttgtcatcatcttattattctttggcctgtttctagagatcagcacaataaagtttgtaaatccttgttcagaagctatagtttaagccttgctgaatgaggccttttaggaacatattttttctttctttcttctttctattttatttttttgagaagtccaggaagtatctgattatgtttcagatgctctatgtaaatggaaattaattcttcagcaagaagacgcaatcacagagggtaagattggtgtttgcaaagcatcataatatcacttgatttaaagtcaaatatctgaacctgaatactataggaaatcccaaatagtgacactgagtttaagacagcttgagttgcattttataactcctggctgaacagcacaaataattgcagcccattcctgaattaatgtgtctgggtgtgggtcactttgcacagatgagggaaaagtagtcaagtaaactattcaactgcttttaattcttatgcat

SEQ ID NO: 106438 - DNA, 2131 bp, Homo sapiens
tcacttgaagccaagaggtggaggttgcagtgagccgagatcacgccgctgcgatctagcctgggcaacaagagcgaaactctgtctcaaaaaaataaacaaataaataaataaaagaagaagaagaggaagaatccaagcaggcattgataaaggacgaggcaaactaatgaatcatgtagcttagagatcagtaaaacagaagttagaagaagcagtttatagaactcttgaattttttcccctataacttggtcagtgataaatgagatgaggaggaaaatatgaggcaaaggcaggatggtggagagaagttccaaggaagacactaatcaaaaaaatacttggattgagaccaggatagaatgatggaaattttgatgtcaatgtgaaagtgaggcattctcaggggactaaatcagagagaaacgagaattaagtacaagttgttcctaacacatttatactcatcaggcttataaatgagaaaggaaatcagttattgaatgggaaatatgtatatatatatatacacacacacagagtatatgtacataaggtgagtatatgtgtgtgtatgtatttaattctcctatgatgcattgtggtactctgaagatactgttgggtgtttgagatactaattattcttttggagccacatgtaaaaataagaataagatcgccctgtacaaatagtactgaggataggaaatagtatggaaaagctccttatatttagtaaaagccatacatgttgtctaattattgtaactttaagctcaaaaatcacatggccaagaaaggtggcaaggatagcttcctttactcctttaaggttttgaaagggctgtatttgaattagataccacaggtggactggggagcggtgatgggaaatgcccttactgtcactgaatatggcagggatttaaaccatttctcgctacctctctcctttgtttttgtctgacacaggttttatattgccagccaacttatccttattgatttgttttacactgtgagtcaaaaggctacctcatttcctggtgggagatcgtggttctgtaaatactcctttatccctttgtaaatgctgttaaaggcttcttgaggagaattcggtggttgtgagggtgggactaggcaatctctgtagtcccttcccacagtgtagtaggagagttggttttgcacttggttccctgtgcctaaaatgttcccaaaagtcggggcattgatgcttgtaattcctgtgattcctgcattcccagtcagagatctgaactagcatgcttggtaagcattgcttttgaactgccaaggagtactggtttttacatggagtctagccatcagataccggctcatctcctgcttcattttcggtgctgcgttgaggttggagatacagatgtggttgatcatgcacagttaagtaggggagtgttttgggtctctgcaaagtaaggatgtggtagaaatagcaatacatctagagaatgatcacatggtgagtctgtttattagccaacaaatagaaagcaaatcaaaatgcagacagtatccatgtggtcatctgcgatgtgtgcatctctatgccttaggtgaaattccagggtctaaacagctttgtgcctccctccacgatggagtttcctacttaatgatgagcatgaattggaggagggttttgcccacagctgtcacaatccagtaggggtcactggtccatttggggagtgaagatggacaaatgggaatggtcctgagcggtcccattcatctccctagggaatcatggttgcatctcgtcatggggagggttttctgtttcatgtacctcctctaaaggaagatttttttttctctgattgatttatctgtggacctgcttatctactgttctacctagccatagagtttttaaataaaaaagtttctggaattgcttaaaaacttgttacatgtgccttccctcacccttacctctgcagctaagaagcctgtccttacaaaaggcgaacagtccagtcgtgggcaaggtttaagtaaaagcagtcactagtagctgctgtcttctaatcctattggttacccaagagaagaagaaaaatcattatatgat

SEQ ID NO: 106439 - DNA, 2816 bp, Homo sapiens
tgaatagctgggattacaggtgcgtgccaccatacctggctaatttttgtatttttggtaaagacagagtttagccatgttgccgaggctggtcttgagttccagaactcaggtactctgcctggcttggcctcgcaaagtgttggggttacaagcgtaagccaccataccccacccaaattaacctctttaaaacattatttctatcctgctctattcccttatgccccactacgccttgaattttcttcataaagattatccccactaggtattgtatcattgttgtctcacactctccaatagaatttaactctttttaccctgttcttttcccactgcctagagcttagtaggtactgattaaaatgtattaagttaatgctgtgacataccagctctgacttttccataatttgagcccattaactattgtgtcttccccaaacttcacaaaattaatcattattttgcacgtgtgtcagtggagaccctgagctgtgtgaaaataagcgatggctttagaaaagtgctaagaattgatttaaccgtacatcatatttgctgttcctatgcatatctttacttgctccgtgaaatcgccagcgttttcccaaaagcagacactctttttttattttttatttttattattattatacttcaagttttagggtacatgtgcacaacgagcaggtttgttacatacgtatacatgtgccatgctggtgtgctgcacccattaactcgtcatttagcattaggtatatctcctaatgccaacccttcccctccccccaccccacaacagcccccggtgtgtgatgttccccttcctgtctccatgtgttctcattgttcagttcccacctatgagcgagaacagttcccacctatgagcaccaccatgtccagtttattttttgtatttttttttttttttttttgtagagacagggtctcaccatgttgcacaggctggtcttgaactgttgggctcaagcattttgggaggcccacctcagcctcccaaaacactgggactataagcatgagccactgtgcccggctttgttggtttttctatcactatgctattatgctataaaatatagtaaaggggatgtattaactgttaattttatcaagtaaacgattcatcttcgagaataactaggagaaacattcatttccattatactatttgctataagacaatttcatagacatttttagaggtttctttaagatatcctgtattagttcttatgctatagaaagctagggcttttcccatcgttggatctcctactggattttcctttttttctgctattcaaaatttatgtttcctcttgggctcactttcctttcctcaaaggtgtactgctgtagtgtgttctctctgtgccatggctccagttggccggcagtcaggtggcctgtccttctgtctgccagaatggtcctgtgaccatgcagatcctgacctgcacttgcaggtcacagggtcagctgcttctggatatggcaagtcctaatttggaaactggattccatcctgcctaccaccagcccagaaggaaggaaatggagtttgtggtggaagaaaaccggctattgttattaacaggaggttatattaagcactgtcatttttagcacattctaaataaatgccttatattgaagagccagagaaggaaacggaaactttgaagcaccttgattaaaaagtatgagcttaattacaattggcacaaattgttcagcatctcccacgtgctgtcactgtgctgagtacttacatgtagtagtgaacaagacagctatggaagaaataattgctcctgctgaaaatactatggcagtgaaacagaagatgggatgaagtatttgagtaggtgatttaatcctctggtccaggggtcagtaaagtttttctgaaaagggccagatagcaaatgttttaggcttgtgagggtcatatggtctctgctgcaactatttgtctttgtcattgtagtaaaaaagcaactgttgtggactgaatgtttctgttgctctgaaattcatatactgaagccttgctccccagtgtgatggtatttggaggtggggcatttgggaagtaattaggtcataagcgtggagctctcataaatgggattattgcctttgtctaaagagtcagaagagagatgatatctgcaagccaggaaggttatattgaaatctttgtaagaaccccacagaacacactggtcccctgattttggacttcctagcctccagaactgtgagaaataaatttctattagttaagccacctagtttgtggtattttgtcatagcggctcaaggtgacttaagacagaatcataaatagtacacaaatggacatggcttctttcagtaaaactttatttataaaaacagatggcagtctgcatttggcccattggccgcattctgctgacccatcaccttggtgctttttctgctttttctctgttgtcctctgtgtgtgttcctttgtcctgatccttgtcaccttgtgggtccaaaatggttccactagcctcatggagcctggccttacattgcagagtccaaagcaggagctgagggaaaatgaaaaacaacttcttcatcaccggaagcccagcaaacttctccttaaaaatcactggtcagggctgggtgcagtggctcacacttgtaatgccagcactttgggaggctgagatgggcagatcacctgaggtgaggagttcgagaccagcctggccaacatggtgaaacctcatctctac

SEQ ID NO: 106440 - DNA, 1072 bp, Homo sapiens
tcccagctatatattctccacaaaacactgagggcttccctgggaaataaatccctggctaaatggaaatgtggttggtttcatggtatatcttcaggtcttggacaacagctctgtgcttgcagtcttctttgtgtgacatttggaggccgagctctcaaatgtcccttgaatttcattaactggtgtgctgttttgagttaactgtggagagaggcctattggagatggtccctgccagttgggcagctctcccacttggctgttttgagaattgttatatcctgtactatggaaacaggatgaacttggccatgagtgtgggccagaagcctctatcccatttatgcggacttgctggctgagttttgagaagtgcatgatttcatttgggctgtggtttgctgctaaccgtgtgagtctgcaaaatgatcccttttaagtagaaccaggacagaataaccctggagctatgtttggtgtggtttgtctgcaagggttaaaagctcactacaggatgttgctgctttataaaattgaggcctccttgaaagttgtgtcatttctatgctttatgaataggattatcttctttatgcagcagtcatttgatgttgaatagaagctgaagatacagttcctctgtaaagatttcatcattgtttgattggtaaaggtggacattttcccccctttccaggtgaggtatacgtgcgttcaaagagggatggggcaggaaggtggttggcggtggtcagaaagccatctgtaactcaggtgattttcctgtaccggtcacctagctgaatctgaatgagagttttttgtaaagttgtggtagaagataaattagcctgatgatggattatgcactatttctcttctgctataaggggtatgaggccggaggttaggagactcacacacagtcatgttgtctgtcagagggaggatgaagccgagagttgagtggccttcaagctccctctggttgctcataccttgtttctttctccttcttatgagttgggaacatgcccaagaaaccttgtaagtgtgaaatacagcatgc

SEQ ID NO: 106441 - DNA, 1734 bp, Homo sapiens
atttttaaatgtattaattagaatcactgacactgcatattctggtgtatgtcagaatgccctaggagatggatgcttaagtaatctgcagagtggattatatccttgcatttgctctaaaacttggatttgctaatactgactgtgctattcacaaaatttaaatatcttttctcggtgtgtgcatttgcaatcctgtttttctgctgtaacaatagtccaagtaacagtgacttttaacgatatgctgaattttgttctcatctagtagtctgtcctccagcaatttagggctgatctggtgactatgttgagttgatcctgactacgcctatcttgctcctgtgttgtccaccacctgtctcatgatcacaggtggggaccccagttcctgccatcatatctgcattgtggccagctggaaggtacaaagtatagagtatgtctcattcccttttaagagtgtgtgctgctcccactcttgtcctattggtcagaatttattcacatgtacatccctagctgcaagggaagctgggacatgtagtcttaaacttgggtggccagcagccactgacctgggggttctattgcttattttgttgaaataaattgacatagtcttctgaccatggggagcttatttgtcctgttgtgtatcatgcccctggtgctcaaatcagtggctggcacatcatgatgcatgggatgcgttgcttaaatgaatgaatgaaatggagttcatctcctctttggaacttcttgagtgcggagttcccaacacgtcccttccaccttcctttcacagctcttctttccattccaggggtttacagacatcctcctctccttcccacacatgtgcctttactggctctgaagagagctgccacgtgcagcccccatctccgcctctccctacaccaggcccagcacccacattccctttaactgttgtgcattttcataagctgaggtccttcccccatccttgtctctcacctccaaacacattccagtttgctcatttattctttaaaagtgtgatctacataatggagcacagcttctcagttttgcaagtaacagatggacagaatacgtcctgcttcgtgtgcttttgatggacatcctgtcttctccacactcttgactacaatttctttctgtgtggcacagaacatggcaaaattacgcacgtgcacacatacagactcacacacccaaccccaccaaaaatacatattaaacaaacttcatggcaggcagaagaaaggaactttcttgatctttctccagatgcaaaaagaaacactacctaaagcagtgtagacagtttaggcataagggcagctggacagtggtacattttataccactgttagtatacttgtgccatgtagggctttatattgaccactgactttactgctgatatctttttttaatcgtattcttattctcggagtcccttacctttttttttttttaatgttgtaatttctgtatatttgcaagatgtcccaaatccaagaagtcatcatatatataaagtatgtatatcttagaattatattaatattagccaacctcacctaatcctgtctgtcctgggcattgttctgagcacttcatatagaatatttaatttaataactgcttggtttaaatgatggtgttcccttcaaaatgcgtgttgaaacttaatccccagtgtaaaagtattaaggtgtg

SEQ ID NO: 106442 - DNA, 1037 bp, Homo sapiens
tttgaggcctggaaacttggaaacattttcacagcttcttgcttattttagaggcaagaaacatgcagtcagagtgatcacagtttcagatttataacaggtgacggcaaaaggagaacattgtgctcatcaaactgctgtgccacttccacctcccagctccagtatatttattaacgtcttttgagtaaagtcttaaaattatctattaagcacaatttttcaccctttctgatagatcactggtgctgccaagaagcttttaagctgtaaatgaaaaggaaaaacaatcctgcatttgatcttggggtttttttttttcccccttcagtgaattatcttagaacagaattttgccatgagtgcttttattggaatttaaaactataataccgacttttccttcagtctgggcttaaggtttcccactgttctaagactgcatttgaagttatctatcttatcttagtgaaagtttaaaaaatactcttcctttgcatttaaatttctttctctgtggttaactaaatccgaatgagtcattttatcaaagctttaacatgtatgtttgttttctgggtagcttatcacccctttttctttttcctttttttttttttttactttaaaagtttttttatatttggttggataaccacatgatacgggtgtataaagttgtttgtatgaccataaactttgaaaatgggttttaagaaggcatttgcaccatcttatcctgcaaattagtaactttctgatctggaaaaggacttttgctatgcctcatacatttccctggagtttgatgtaaattgaaatttattatgaatcaaattcaattttaggtgttcttgaggaatctgtaaatgccagttgagaggggaaattgattttgcgttcagccctctatgatgaatatccccgtgtttgacacgtgtaagtgttccgcttatgttagttatttttcctaataacctttcagaagtgtctgctaatgaaagttgtacctgtttttttcacttaaggtgcggtca

SEQ ID NO: 106443 - DNA, 1055 bp, Homo sapiens
gtggggtccatgtcttggcttccttactgacttgtcttttttttttttttttttttttttttttttttttttgagacagtcttgctctgttgcccaggctggagtacagtggcgacctatctcagctcactgcaacctctgcctcccaggttcaagcaattctcctgcctcagcctcctgagtagcagggattacaggcacctaccaccatgcctggctgatttttgtatttttagtagagacagggttttaccaggttggccaggctggtctcgaattcctgacgtcaggtgatccacctgcctcgctgggtggatgaagtgctgggattacaggcgtgagccaccgtgcccaggcactgacttgtttttaatgtggttgcattacttacttttctgcaccttctttaactttaaatgaaaaataacctttcctagcaaaatactgagtgcgtaattagtagataggtgagatagcactgctggcagaggtcatgcatgaatgaatgaaacttgagaaatgctggacttcagaacaattaatctcatagcagtgaggatactctgaaggaagtgccaagattttttttctccttcactgattcctcctttctgccctggttgtttttgcatctgatttggcatgtgctctgtgtgtcttgtgatgatttcttgttttgttctcttggtagaattacacatttctcaaggggattttattctggtttttattgatttctatggattcagtagatgcttttatttatttatttatttattttttatttttttgacagagtctcgctctgttggccaggctggagtgcagtggcgcgatcttggctcactgcaagctccgcctcctgggttcatgccattctcctgcctcagcctcccaagtagctgggactacaggcgcctgccaccatgcccggctaatttttttgtatttttagtagagatggggtttcaccgtgttagccaggatgatctcgatctcctgacctcatgatccgcccgcctcggcctcccaaagtgctgcgttagatgcttctt

SEQ ID NO: 106444 - DNA, 1082 bp, Homo sapiens
acaaaaattagaccaagccccattcactcatgtgagtgtaccccatggcccttttttcattttgtctatattattgagtcaattttaggttcaacaaatatttattgttcacttcataatgagacctgtgttaggcacatttgcatatcttatttaattctcctaaccgttatttgagatagttaatgatgatgaccatgaattcactttttttaagagatgaagaaactgagactcagagaggtttgtgaacacagctattacacagctattagccagaagagctaagtcttaaactctgacctggacaattctgttacatttatgtttactgtaacatagaaactttgccccaaatctcaaaagtattgcttctctattaaatgtcttttttaaaattgtcccagagaatagaaaatataatttttatatgacttagcaaacttccttcccaaacatgatatgaagaaatgagtgaaatctcctttaaatagacatctcagtctttctaagtattgtatgccagtaggaagaaggctagtattctccctaggatatgcaggccagtgtatacagatttgtctcacatctgggtgcagatctccttgccaggtgcagaatggggactttacgccaggtatgcttgttggtcattataaagttcaagtgaattgtgtataagtctttgtgttttcatgacaacttttttttcctgatgttcaggtaccaaacacagaaaaatccttacgtgaaaaacagatacagattcttgtagtaggaagggaattgcattaggggttggagttctggagtttttggtctaaccacatcctgtcttaggaattttgccatatcagttgttgtgaacctgttttctaaaaatgctgacaaaaatacatgtaataggctggacgtggtggctcacgcctataatcctagcactttgggaggctgaggcaggtggatcacctgaggtcaggggtgttcgagaccagcctggccaacatggcgcaactccgtctctactaaaaaatatcaaaagtagccaggcctttaatcccagctacctgggaggctgaggc

SEQ ID NO: 106445 - DNA, 1019 bp, Homo sapiens
gctactcgggaggctgcggcaggagaattgcttgaacccggaaggtggcggttgcagtgagccaagatggcgctactgcactccagcctgggcaataggaatgaaactccgtcaccaaaaaaaaaaaaaaaaaaaaaaaaaaaaatggaaaaaacataaatggaggtgagctggaagattgagtgaactcatctgagccagaaaggatacatctacaaatttttctgggagagtataatagcaggctgcaaacataaatatgtcatctgtacttaagtaattttgctaaattaataagatcaacaatggctaccatttagagaacacattgcataactaggcactgtcctgagaactctgaatataaaatgaatactgacagtgactctgagaggaggcatggcagcagacaagacggctatttctgtcccattaggtgagaaaaacgaaacacagagacgtgaagtggcttgcccaagctatatgctcattaaacatcactggtgaaatgagctttcctctgctcagccaactttcttgattgattgattcattcattcattttttttctttactattatctctctctttgtatgagactacaaattgttatagtaattgacttattgatacagttactaattatttaaacagcacaaaattaaaaacttggccacaatattattaacacacagctggggattaatattttgtgtcttcctcatacaatcccaaagtcaacttcaccttccctagcaataaataaaatcacactggataattttaaaattttctatcaaatgtgtgatcaagtctgtgctctgacagcaactctacaattggcaggagctgagaaacaaaatacattttttaaagtaataaataaaaatgttaattcctgccatgcctgtgaggtttgaagctgggaacagagaaggatttaatttagggaacagagaaagatttaatttagaaatgacttcataaagacttaggttctaattaagaagactgaaaga

SEQ ID NO: 106446 - DNA, 1510 bp, Homo sapiens
gtgagccgagatcgctccattgcattccagcctgggcaacaagagtaaaactccgttttacaaaaaaaaaagaaggaaactgttgactgctcataaatgcagtcattcactccctcatccttcctaccaagaattattgagcacctgctatggccaggcattgttctaggtgctgggaattcagtagtgcaccaaacacctcaaatttctttcttcatgaagcttaaaacatttttcatgctagtgttatggggggcggtcaagggtgggttatgtcctccagatatggagtgattggttgctatagctacaataaaaggcagaggggttgacggattctgtagtgggaaaagtaatctagggaacaggagattctattagagaaaaggaagggagggatggagagaggtttgaatacctccaaagtggagtctgactttgggtacctggagtattgtatcaagcacagagggatttagcgtaggtgtgtaaagagcctttttgttaattgggagtgagagttaatgtatttacctttgagaatgcagtcatgatactgtgttattttagatgctttgcctgccctggaagaagcactgagttgatgatctaatagcttgttaccactgttaatgtctatgattatctttgtcacagtgggaatatagctgtcagggaaagagaaaggcatttcttcttcactttcagtaatcgagctcaaactgctgacactccaaggaaaagagagaaggcacttaacaaaaaagacaagccaagaaaaaaaaaaaaaagccatgggaccttagcatgtgatggcttttaatgggaatgctcagatggtcttgccaacggcctggttttcgtcaccaagggattagtagagtatgacctgatggcttaaaaaaacaactcaaaaaaaccaaatcaaccaaccaaacaaaaaaaccaggtgtgctggggtatttataaccgaaggaaaatggatttaaatgaacagatggaaaaataaaaataatgcagtttttcttgttgatggtagcgtaatgaggattaaataaaaatgtagccttttatgttttgaggggtgcaatatgaaggagaggctctgatacaggctgtctctttaaggaaagaagcaacaaaaattaattatgtagaggagaatcagggtcttgagcattggtggtggagaaaccacaattgaagtgaggctttgggtagcgtttactatgtgccacatgcctcaatgagggtctagtatattttaccttttatgcaactcacctgcctggaaaacagtattgtcctaatttcacatgggaggaatttgtaacagagaggggttaagcaaccaagtttccatgactgtcaaatgccagctcaggtgctgaaacctaagacattttttccccttcctaagcctttgggtttctgttttgtttttaaagcctttggattctttgttttttttttttttgtttgtttgttttggagaagaagtctcgctctg

SEQ ID NO: 106447 - DNA, 1033 bp, Homo sapiens
aagacagtaagtcattcattgttagcagtgataatgcatgcctatacagattttaggagtgtttcagttctgatctttcatgttagaaaagtaatctcccttcccagttgaactctttttcctagttactagaattggaagtggcaatcacttctattccagcctgtccagtgttttctgctgaaactatttagaaagtgtgatgtcctaatgggacctggctaacttcttgaactgtagcttttaatgttcttggttttgtaataatctcatcctttcaaaatttgcttgaaatttgtgtttctttgacctctggtagactatactttggtgccctttgtagaaagattttctttgactcaatattgtagatagttcaggcaaccttttaaagaagtattcttctttgtatggttctaagaattctttacacatttagttctggattatttcgtgggaagatggctcccaatctgctctctctagtctccttgagggcagaggactcccctaatttcctgtgtatttccagcgcttgtttccgtgtctggttctgagatagtctacacagagtgttttttggggaatgtgcaagggtttcttcttggcaacaattgacttctactgttttacaaagtacagagaggctgtgctctgttgctgatggggttacttgattctgtgaagtgctcttttctgactggtattagcaagtaacgcaaacccaaattttaaaaatgatagaatcggcctggcgtggtggctcacgcctgtaatcccagcactttgggaggccgaggcgggcagatcacgaggtcaggagatcaagaccatcctggccaacatggggaaaccctgtctttactaaaaatacaaaaattagctgggtgtggtggtgcgtgcctgtaatctcagcgacttgggaggctgaggcaggagaatcacttgaaccagggagtcggaggttgcagtgagctgagatcacgccacagcactgcagcctggcgacagatcgacactccacctcagaaaa

SEQ ID NO: 106448 - DNA, 1026 bp, Homo sapiens
ggcagtgcatgtttagcaaacctggggccctgggagccaccactgactgttaggaccactttagtgcctgtgctgtaagccaggattttgaagttcttgggggcaattttgctttaagcagtgttagggaactctttacaggtttgtgagctgggagtgacaagccattattttatccacaccaaagctttgaatgataaaggggttgaaccactgtcattcattaaattcattaactgttggaattcctctaaggatctatctgcaggccccttctcttctcactctgtacacggtctccccaggcaacttcataatggctaaaattaccatctattccaagagcatgctcaaattgatatttctggctgaaatctcccttttgagattaaagcccttatcacctacttcctccttgacgccggagttctcaggacaccttaaaaccaagttcagtatctctgcccatttctgcttccttacctttaaacctgttcctcattcagtcctttctgtccccaggagtggcagaaacataatccatttgccctagcctcaaacctgggatgtctgtcttcctccgtctacaattaatcatcagccagctcctatcagtgtcacttgaatccatattttctcccctactcactgccaccactaaatagtaatctcttgccttctgtggaagctgtagaacatcgcttcaagtttaccctcttgtgacccactgttgtctacacagaaaatctggaggaacctttaaaaatgggaatatgaatgtatcactcctgtgtcagtaactattctgggaccatttttgtggcttccaataggtctcaggatacatcctaggatccagcaatgacttttcttaatttctcgccctttctacttaccgtgccccaggtcaagcccacaattttccctacacctactgctgtctctactcagaaacgctttccctcctcccaacctgcttcacctggttgaattctagctcctgtttcagaagcttagctttaatca

SEQ ID NO: 106449 - DNA, 1012 bp, Homo sapiens
atttgtatatgtttgtttaaagatgagtgtaatgttgagagaggttgggctggtgatggtgttgaaacacaggatctcagactcttagggctggggaaagctattaataccatctgctctcatcactttgatgttctgtatagggctggtttgtagagcctttctattagatgaggtaagcaatagggaccttcagagattcgtggggagacgtttattctagccctgaaaaaatggcacagtatgagctggcaggattggagagaggaggctagactcaagcgaagccagggggagaatttaaggtgaagatttgtcagacactgacacttgtaagatacttcccttgcaaaaccgcatactacatccattatttttccttaagttatagcagtggtccactggaaatgttttgtggtgatattatgggaattctgcagcataaggatgaacagatgagaatatctcaatgagatgtggagttggaggacttaacaaatcagatgagaaaggacaagcttgaagacagatcagtttaggtaaaagtgattgcatgcatgtgagtttgattgaacagtaccaacatgtcctgagcaagatgggaaactttcctaataatcatctgatggaatcaagttgtgataaattgttatcatcatagtattatttcaatttaatggccatacataatggcatctcccagcaattaatctaacattaacctccaccttagttattgaatgtatactgtggtttaggctgaaaacatgatggataagaattactgactgctttggatctgtatacgatatgtcatagccttgaactttattctgttctgcttcagtctttttcagaccttcctgtacgaacccaagtctttattatttgtgacccaatagcatgttagatgtttttaactggaaaatgtgaatggccactttttttttctcttacgcgaagtaaatgctatgtaaattgatttttaatgcttttattgtcccacaggaag

SEQ ID NO: 106450 - DNA, 2478 bp, Homo sapiens
cgaaaatgtgtgagcatctacagaaatgtatgtgaattaggctccaggaataaaattgcataaaagtacaactgtggcttaaatctatttatatgtatgcttggatcctgagcaatatagatacctggctagaaacctggctgttccattataactgaatgtcaaattccccacagttagtcattattaaaaatacccttgtcttaaatttactttggcacgggaatgttcttggtgattaccatactgtgttactctagggagttaaagatttatattatgtttcagttctactgaaataatagcattcgtaggcacacagatatctctatgtgtatactgatatacttgagaaagttctcctttaacaacaggtgattttaatattatctgaaaagaaataaaaatactttgtttcatagcactgtggagtgtcaacagaaatcttatttgttctttactcctaaaataggagtataacacaaagtaatatgttatgctcactaaagaacagaatctcaatttcagagatagaattgccaagttcattatttctggagaaaggaacaaatattaaccccttagtttaacctgaaaatgaaagagcatgtggactaaggggaaaaaaattatatatatatatatatgaaaaattgacttttctgtcttttagttgtatgtctttatctccaacagatatgtgattatcctccagagaggaccatgagaatttatttttaattttcattccgttaattacttgtgtaacatatgtatgtccccataacagccagtgctcactcgcgtgcacgctgtctctctctctctctctctcacacacacacacacgcttactacatattcatacatttattctacagggaagaagagacagttggagacactaatattccagctgtcggcagcagaatcatttcacaaccttcttcccagaacttttggtcattactattcttgcccctcagcctcactactcactgaaaaaatatttaatgtggatctagtcagttccagtttggttagtttaaagagatccaggaagactgagcaatcatttactaatctgtattctaaaaaaccagctcaagaattaattcaattagatatgccagtcaccatatctggagattaaaagcaggcaaacagaagggaaataaggaaaatgaagcagggcaaatgggactattactgatatattaaaatgaaagactatactaagacttctcatatgcgtatattgagatttttcctgctggcaatgatcaagtacaattacataccttttgtatgacatttctgattggaaaggttatgtgacatgcagggaggggtcttagttattggctctttagctatttccctctttatcctggaatagtaccacagtgtgtttttcactcctttaaaacattctttaatgaaattgctttgagtcatccctgtctctgtgctttgcctcttttattccattgacttgtttagggtacataggaaattaggttgaaaatgtgttagtattccacattaatattaacttgaagtctttcccttgtatcactaaatcactacagataaaaacttgtactgtgaatgcatgctgcttgtctataaatatcacctgaaacagcaaataaagccatgtatgtttaactgagaagagttgagaattaatgctaaattaaaatattgtcacacagattaggagaggcatacacacacacagtctctgatgcctttctctttactgtgaacactgaataataattatttgacgaaggtagtgcgttgtaaatatttataaacagaaatgtaaaacagtgagaccacagtgaataaattattttgaaatattttaaaatccagtttttatatgctttttagtaaaaattattcatggtgatcaatatttctttctcacttgccatctgctccacttctttgcctgtgcagttctaggtgaatgatgcactgtgctgtataatgtactccacaaatttattgacttggatgcagcatttttatggagagcaggcaaacatgtaatcactaaacacaagtcttctgctgttgtaattgccagctccttcctaaccacgggaacaattaggtgatcattaaatggcttccaaggggatgccttcctctcctgtcttactgctggtgtcatttagtagcttctgcaggagaaggtggaagaaatctattccacgtagtcctggagtgactggtcaaaaggatttcatcttgtgtcttacaggcaatttgtgaagagcccctgttttcatgcgattccattttaattcagttgcagcatccagttttgcactattgaatcaccccacttgaaagcctcagagaggggcttttgggctgaaacaatgacacttaggtggtttgaccacccctttcttagtctgaaagcagatgtctgtatccacttactaacctgtgactctt

SEQ ID NO: 106451 - DNA, 1177 bp, Homo sapiens
aagccagcggtccccaacctttttggcaccagggactggttttgtggaagacaatttttccatggggggatggttttgggatgaaactgttccacctcagatcatcaggcacgtgcaacctggatcccttgaatgcgcagttcacaatagggttcgctctcctatgagaatgtaatgctgccgctgacctaaccggaggcggagctcaggcagtaatgctgaatcctgctgagtgtcttggttcctaacactaagggatgggtttggaggagcagaaatgattgttggaagcaagtgattggtatctgcatgcaactgtgccgctcaaaggtgctggagaatgactaatttgatggaggaaaatagcagtattagttgtggttttcttttcaaaatttcttatgttcacaacacttgtgttttgtcctctgaaatttaccctctacaccctaatgcttgatcagtgtccctgcctgtgtgagaaaccctcctggaccactaaagcccagtgtcattttgttcttctttgccctttaagagaatggtacattgcattcattttacatctgcttgggctgagctctgtcctgcccctaacgttctgtgctgttctcatcgttgtcttctcctctgcagcttctgttcatgctgttccatgtgcctggaatgcccttcccctcatccttatatatccatcagagctcagcttacgtgccaccttctcaggagtcgctgtattctgtagggtctccttgatatttttatttcacattcaattatcttatgttgtttttcacaagctgcatttacacaagtttgtgttagtttacttgcttcatacctttctcccccactggaatgcaaacccctgaaggctgttctgccttgttcatcttggatctcggtgcttggtatccagtaggagccccgtaaatgtctctttaatgtgcaactgtctggctgtcatgcatctcctggagtggtggcatggcctcttcttcttgaaatgactgaaacggaaccctttgttaggccatctgtatcagggtgataaattccctgtttgtgtagtcagctgccctgccaggaacatggcactctgtaatgtgcataatataatcatttagcttttggggtgatttttctgcatcatttgatcaagtcataaacctaagtt

SEQ ID NO: 106452 - DNA, 1061 bp, Homo sapiens
ttccatggatctacattgctcagtctcaaccagacactagaactgagtggaagctgctttctttagacctgtcattctcaaattgtggtccctgggactaacagcatcagcatcaacccaggggacttgtaagaaacacccatttctacaacccatcatcccaaggcttttaaatgagaaactctggggtgtgtgccactgtctttatcaggccttccaggtgatgcgcatgtggctagagtttgagaagcattatttcagacacagctcgggctctgcactccccagttacagttctttgcccttctttgctgtcttacacccagctccctacactgagttaaattgcctccctggtgccatgaagtatttttttgtctagggactgctaaggattttagggttgggttttaagtacgttgatttctcttctgcgtcaatatatctgacaccttaagctcacttaagtcccttaagcttctctaagcctaagaaatacatggtgagagggatgtgtctctaagaatatgtttaacattgtggaagactgttgacagctgtgttgactctcaagacaagatcaggataatagactgtctaaaaggaatgtgttaattttattgcttgaagtataagcatatcaatttttcttaattatgctagaaatggtggtagtcaggtagtcaggttcacctagttgtgaaatctttcctttgctcctgtagttgcatggcttgagggaacatgtttaacctcttgagtacaactttgctcatctgtgaaatgggaattacataacctatggcaaagtgaaatggggagagttaagtgtggcgtgtataggaaaactgttcctttgagttcctttgctattaaggctcatttttttatatccacagtcacattcatgaagcttttctgaagaacaaacacaccctttgggaagtatagtcaaaagcgggaacgtatttattgagtaatcaataagctatatattttgtcatgtatgaattatgtatgcattatttataatacctcacacatgaatcatacttatagta

SEQ ID NO: 106453 - DNA, 1053 bp, Homo sapiens
ttagctttgtgccccacctaaaaacatatgattctattggaaacgttggtacttttgttaatacatttataatgataactgttttctttgcagattatgaagagacagggtcaaagatcccagtactggtagtctgttctcaccagtgcatgtccttagctgagagatcctgtcctttgtggagcagctgaactcagctgtaagacacagacctgaagtctgtgttgaaattgtccttcagatttgcctaacatcctaactgcccaccagtaccaaccatttaaatagtgctatagcaagaagtttaacgagagtctctggagccatctctctgagtttgaatcttgctttcactacttgcttgatggtgtgatctaaataccaaatagcataacctttctggctgcaatttcttcattcagaaaatgagggtagtattgtcaggagcaaataaggtaatctgtggacgttggtccattgtcagtggcctataaatgttacctgttaataaagaattggtgtgaagggttaaaaaccgtttactaggggaatgatcttggacaggttatttaaccctctgccctcacatgcctcatctataaaatgggggtaatatggaagtttatggcctacagtgaatttgagaattatgtgagatgactctttgaaagcacttagcacaaatgtctggtaacagctagtactccatatcagcctgtcatattgttcttggctgttttcctcattctcaaaacagtttccttgacctcactcttggaggtgctgtatggggcctcagaaatatgttttatttctaatgaggttcttcactgcaaatctcccagcactagtctttttggtttagcatttcggaaacactgtcttcgtcatccatgaccattgtcagtgagctgccacatctcaccatggaagtcctaaaatgaaactgtgtttcacttagaaatagaattctacctatttttctgaagaatacttttttttttttatggtggcaactttgtttgctgtcaatataaatatatcgcttctgta

SEQ ID NO: 106454 - DNA, 1077 bp, Homo sapiens
aatcatcctgtctgcaccctgtgaagtgtttcctagtcccacatcccatccacaccaggcccctgtgctgttgagtgagtgccttgtaaaactgcttttaatttctttttttttttcctctcagcctttatgtcagtgggtaggtatacagaccctcagccctcctaaacaccaaactcccaaattctgtctctgggaatttttcccttttcctacttgtgattgaaatttctcatgagcttgagcatctttttaaatattaaacaaaaccttgtggagcatgatactgagtaatggtgtgaaaaagcccttccatacaaagaaaggaaatcctggccgtgtttaaaccagaccttaactgccagttttgttttgctctctgggttgcatctctgacttttcagaatagtgcgtgctcacctcagcaagtctttcccacatgataacttgagcggtggcatgtctctgaggcagaaaacttcagcaagaggcagctgttcccgttaagtgcttcatggatttttatcccatgactgctgtgttaacagtaaaaatttacagcaatggacttcagagcttgtttcttctttttttgtctaaatgagatctttaaaaccttagccaagttcgtccttctcttatagggaaagaagataggaagaaagagggagaaggaggagggaatttagggttgttatttttatatattccatccagaatgcattcctgatttttgtctttataatttgacattttcgtcttagtgaaaacatcgaataatttaaatgttggtcttcttaaaccaccattttgattatatcctatatttattagttacaaatagcacaaagcctactcagatgggttaaaatacaaaggcagttaaaactgaaaagtctagagataaaatttaaattcagacatggtttgatcagatcttcctctctattttcctccctttctcttgttactgtctttttacttttcagctttggccttcagctgcttccctcctgattgcaggtcattctgctcccttccttcttcattcacattcaagggaggagggcctcttct

SEQ ID NO: 106455 - DNA, 1071 bp, Homo sapiens
tggattcaggtaatatttgtaatataagtttattgagagaggcattaataagcatatttgactagaaacagcacataacatgtatattagttttgtttttaattagatttagacagaattcattatttttaatggcttttcattagtgaataggaaccattatttggatctattgtggtaaaataaattcaaggtacatgcttattttcagcaaagaacctcttaggtatttaaagaaaccactgtttggaacatgaatcatatataggtatgtgaaattccttgcttttagacaaaagtatgatttctatgctcatacaacttttatcttaggtcagttattaacagagaactatactgaagtgagacagtttgcttaaattgtagaaaattcttgttgttgaccagttttatttgtccttatttggacttttcaagtagtattgctggggctgatggtagggcaacattaaggtgtttctctcagatttttatatgatatttgtttgaatagaattaactagcattgatttaaaatttatatgtgtcgaccaagttctttgggctaactctgccttaaagaaactgagtatgaagtgaagtctcagattcaagcccagatttacagtatttgccattattttcatgtgaggaattctatctgccttaaacagaccagttggaattaatctccaattgtgtgatttattctccctactgtggaaatatgtcttcctgatgctagtctactgaattgtaacatctcaaaatgagaaaaatacagtgacttgtgaatggcacactaaggaggtagaagtggattattttaatgcagaaatgagctataggttaagctaatgatgtttttcttaatgacagctttaaaaactgaatttctccaactttatataaggtttttatataagcttaaataatatcacccatgaacttgattattttctttaccgtagtctcttgtttccttcgtcttttgtgtttgcagactccatttatccaaaaagaatatgacagtcatcccagtattacccataaatcagtgcccatctccct

SEQ ID NO: 106456 - DNA, 1052 bp, Homo sapiens
ctaagtaaaattcctattttggtcagccatctaataaatcaacaatcactttatttggtttttcaatggattcttttggcatctggaagaaaatttaagctgtagacaggataattagagccattccttacgtctcgttcgtctccttttttttcttttttctccaaatatgtagatgcaagatgaaaataaagtttggccaaaataaaatttggctaaatatatggcaaatgcatactatccctttgtgaatcatcacagtcatagggaatttgacaaagaggtaaaaaaatacatgagtgaaaagcctatgacagttgtaatcgtgcagtgaagaaaatggtgatgtgaactttttccggatagtagcgcgacacttataaatgacttaaaagtgccccaaggttgctagacctttgccagtcagtgaacatgttcatttggatagtctgtttttaatcttactctttgggatgaggattagggagaatgactgaagcattagagtgaggctgcggtattttccagatagcaaaaatatgcatcatttttaaggagctatatccattgctcttgcagccatgaaacctcccttaccataatggaaaatactttctgtgattgtcccatttttcttgtaccattgtttatatctactgtgagctgttaccagtttggggggaatggggaaagccatggcaaatgattgggtggcagccactcatgtggactcttatttagtggtaggcaggtttatctactactaaactaacaaggctagtagttagacttacctactaataaactaaacaagatttctttgtgtcttccattgtatgaggctaggtatacaggaggcacaaaaatccccacccatctaccagtatttctgtagatgaatgtatatacacacattaagctttctcattgggaagcctgtgttttacttgctaaaaattgtgaagtttttttcttatctaattctcaataaaggattcagtcttaatctttccagtaaaagttgtttcagcaggctactcccgctttgttgt

SEQ ID NO: 106457 - DNA, 1081 bp, Homo sapiens
atttaaagcggcctattacatacagacagtaactctcccataaaacagcttaaatgttcagatctgtcttaatcccctgagagtgctatatatcctatccagcataatcaatagagcaacttggttgtacctagcccacttctcgaaagttgtctaaaatatcttcacaagacagatagcatctctctatttcttcctgaggagccgtaactatctattgtgccagttcccatttgatttcatctaaagttatttccctttctttcatttttgtagaatgaaaaggtaatgcattcatcaagaacatttcaagacaatcttgctgttcctagcattagcttccagcaaaatgatcagaatttaatacttagacggtgcttctgatgtatgttaataagacgtggccttctatgaattttaactattgggagggtttttattttatttttattttatttttttaaactactttttcttatatcccacactgaggacaaatagtaaatgtgtttaccacaaggcatgctactttcatcttctcacattgtattggtttattatattttttctttgcctacattcttccctatttgtctgcatatgccatagtgcctgtgatacaggtggattcaaaatatggttattcaattcacacaagaatcaacgggagggaaactatgtatagatggggaagtcaagagtcattttctagtatgttactgagcccataaaagtaaggcaagtagtaggacactgttgcattgagtttactttacctggctcttagaagtttttagtagagtagcaacttaagagcacacagaggcaagctaaataatgaacaaactaattgcaagctggtaaaaagagaaaaataaaatcttaacaaccttggtcacttccacatgctatttccctgactgagcttgtgacccaagctaagtgttggaggaggatgtagctctgctgctctgctcagacacaggccaggggtaactacccctccccaaggtcaagcaagtatctggagttgaaagatactctttgccctgttgactgctgcctctctgcagccctgaag

SEQ ID NO: 106458 - DNA, 1048 bp, Homo sapiens
tgaccatcaagcagttttaggagacactgattcagagcgactttttctgtcattgtttccatttttttttttaaatctgttaaatggataagtaattctgagatcattctctggaaagtatcatgatttagggccaactggtgctctgagagcattctgcagctagaatgaactaatttattcaggcgggtgtgttcaacatattttttcataggtacatgaggacataattcatatcatggtaatggtgaactttattagaagtaacagaaaaactccatttggttttgaaactcactttgttttcctctcttctcatttgtttcacacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgaggtgagagaaagtcaagatctcaacgtgtagctgtgcttcggtctttatgttaatcagatgctgtgcccttaccctcagtcattttgcaaatcacagctgtacagtacctaacttcctctctctggaaaccctttatccatagtatggcaggtgggtatccatccttgtttctcacctttgtttaactggagaaacacagaagccacaggcatcatggtttgagtagactcactactggttgatgatgttcatcatgtgtttcatttgacacagtttcttttcactgtctgttcccatttttgaaaggtgacattttgtacgaaactgggttgacttcattttcacccttaagaaaatagaaaagttggcaacatgaagaggagtctctctcagaaccttctcttggtagcaaagttttaagttttttttgctctcactggctgttgaaaaagaggctgtggtggtatgagtcactgttaattttgttaggattgatggtgacattttgcttctgctgtgtcagtcttctcagtgatccatcctgctggacagaagaagggtgtgggt

SEQ ID NO: 106459 - DNA, 1190 bp, Homo sapiens
ttaaaatatgcacaagaaagttgcttgcctttgcccaaagtgtgtctgtgatattttatgttaagttgctttatttgagctcttcattaatacccatctctccctacgatttttatactatttgagcatcttacgcttggtttatttcttttcatataactacattgttttccatataactacattgttttcattcttaaaaactagaatgaaagtaagaaaatttaatttatcatggagcaatttatcagcattgggggcattaattatttgtcttgcatgcagtatgtatgagggctacagaagaatcattgttgaagattgtactaggattggtagagtacagctatggttctgagctggggtcagcatctcccccctgcaccctgggacattaggtaatgtctggagacatttcttgttattgccattgttagaagtgttatggtattactttctagttggtagaggccagggatactgctatacattccaatgtaaaggacagcccccactaaaaggaatcatccagccccaaaatgtcactagtgtcactgtggtgagattctggagtggagaaagcagtgtgtttagtggaattaagcatttctttatctaagtagcatcatttaaaatacatttgaataaagaggacttgtttcttgggaagtcattccatcctctttggtttttagagagtaaatgtaccttgccttatgtgtaacagcattgctgttcctggtttctttagtatctacttgagatgcagtcacgaccttgggaattttaacagctccctctgtgctgtggctctgcaggctgaattttaaacatgtgccccacaagaagctggatctgctccctgagggtaaatggcagcaaactcaactttgtaggttttgttgcttcccaggaattctttgaggtcatctgagacaactttgtaggcatccagaaattaaagctctctgaattttcctggctggaatcctagactccgtcttgtagttcctacacttaaaaacatctagtctaatagttaacaaagaaagcccttgtacaaacaaaacaacaaaacaagacgaaagctcttcaataaccagtgttctttacagctcagttaaagttagaaaagaaagttgaagtcagattacaatgccatgccttggagactgaactcaatttggatc

SEQ ID NO: 106460 - DNA, 1444 bp, Homo sapiens
attagttggattctcaaaaggagcatgcagcctagatccctcgcacgtgcagttcacaatagggtttgtgctcctatgagaatgtactgctgctgatttgacaggaggcagagctcaggtggtaatgctccttgcccaccactcacctcctgctgtgcggcccagatcctaacaggccatggactagtactggccctgttggagcccatgtgccatgtatatttcagaaggcaaccagtaaggtctggaactacacccttaaattcattaatattcctataacgagcaaatgaacagccatgctaagtggaaatatcagtactctacatagcttcacatttcttcatatctggttttaccaccaaattagtttttgtaccaaattcataaaaagaacaaaatacctttttgtcttgaaaaagtatccagggccattgtatgggtctcatgcctattgagtgacttcaatgtcttatgtctaaagagcactgctgggtagttacaaccatgacacaagcaggttaaatcatgtgtctccctgtggggtggatgtgtcccagtacttctctcttcctcctcctgtctttgtcttcatattgtgcagcattcttaggcaaagttcaggattgtccagccagaagtttctagttttaggctgaccttgttctgtgatcgattctcctttgaacattctgtttgggcctgcaattgtcttcaatatccatgtcttcaggtatgttaccttgacctcctactgcactcttctcctgtctgctcaaatcctgccttcctcctgagagccttcctaatgatttgccatcaattttatgaagtcgatcggggttcttccctggaatacgtctgtcacattttggttggagagttgtcttgtaatgacccctaggttatggctcaggtaagagaatgtgttccttgtctctggtaagcacgtccagttgtgtcacacacataaaggccttgcacagtgccaccctctccacactgatgcaggcactcaggttcctgccttacttagatgtggaccagcctgtctagggtttgaggcccacatggatcctgagcttcagcagcatgatatgttaaagcctagactacatgtcaggttgggtagcaccgcttaaataatccctccttcactgctggaataagtttatgtatacatatttgtatgcatgtatgaatgacaaggtcttactgtgtcacccagactggagagcagtggtgtgatcacagctcactgcagcctcaacttcctgggctcaaccggttctcttgcctcagcctcccgagtagctggggctacaaccacacaccaccgtgcccagctaatgttttttattttttgtagagacaaggtcttgctatgttgcccacgctggtcttgaactcctgatctcaagcagtcctccctcttcgccctccc

SEQ ID NO: 106461 - DNA, 1081 bp, Homo sapiens
atcaaatgggaaaggaattggttgaaatttagttaatgactttattgaaataaagattccatttcagagcagaatgtttcatcctttgctagtgaaatgtttaatttccatctggctgatcttttatgtgtatgtcctgtgttaattaagaggaacatgtgaggatgccctagtacttagagaatactcagtggagaagttaatgcctggttgtgcaaagcaagcgtgcaagttttgtgaggtaaaacagctttggtccctggcttggtaaatctccatgatgtctggcagtcctcatcgcagtcatccttagacaagaacttggctcagggctgtttgatggtgtgtcagtgacacgtggtgtgctgatagctgtttgaatcataccaaaaactacagtaaagaagatggcacactctgaaaagaaaacctggttaagttggagatactctcagtgtagaaacttggtgaccgtggtggccctcacaaccatatagaaggcttagggtagtggcggttgtggttgaagtcactgatactggtgttggtagtggtaatagtgatgatattgtagatgcaatttaatagacacgacctatatcaggcactttctagatgtttcttcatgtcaaccttgtgagagagggactcttcttatacccatcttaaagatggaaagactgagcttctgcaggcttggctgagacttcctgttagtactccagaatctgggctcgaatatctccaacaccttaaccataattggttttattaggtaagtaattctgctgtttttcttgtcattgttttaggttgttttcagaaccgctgatgcagtaggtagaagtcattttttcagaatcttaactgttgcttattgtaccagttgagtgttcctcatctgaaatgtctgggaccagaaatgtttaatttttaaattttttttatttgggaacatttacttatatataatgaggtttcttggggataggattcaagtctaaacacagaattcatttatgtttcatatgccccttaaatacgtagcctgaaggtaattttttataagttttaaataatt

SEQ ID NO: 106462 - DNA, 1385 bp, Homo sapiens
ctttgtattcattgagaaccaggcaatatgctgaacatttgggagtttcatagtgaacaagacaagcaagctccttgacctcatagaacctgagagaccaacagagtgaatcttaacccaaatgtacatcagaattaagtgggtacttttacatgttccaaagccaaatttgagtaattttcgttcattccttattactggtaaatgaaaagaaaaataaaaaccttcagctgacagtctgcttttccacgttcagataaaaagccgtgcatctttaatgtggatatgatgcctctccattgtgctcaatctcaccgtttcccttctaaagtttactagaatcccacaatgtcagcaggaactggagtcaaataatagatgatttgtaggcttcaggggtgtcaccactctctttccagttggccaatcctctaaatgattcgaagtctccaagttagtctcaaaaatgcctgaaattccattatttgagttaaggtattactgcctcttcaaatggtagtctaaggaaagagcaaaatgtaagcacttgaactacattgaatacattaataaaactcatcaggtaatgccccagcagtagcattacaaagctcaaggcatcccttggaataggatgcataggaggtcaactctgataggacaaaatgtgggcaggtctacatgagccacatcccggggaagcaggaggacccacccacagttatggtatggatcagtgtatgggttgggagaggaagcattaggtatagaaggcacgctggatttatgacagacagtaagtgagcctgccccagtgctagaggaaatgattggaatggacagtggtgtgcaaatagagtgcaagagtgggtcttgatgtttttgaagggatcctcttagaagaaggaatcaacttggtctttggggtcccagaatgaaaccaggacctgcagaagctgaccttactgaagaaactggttacagctggggcctcagcacccaggctaacagcaggagctaaccaggtgctcatctgtttcacataattcagggtagattttctaaaatcaaattcctgaggtccctctgcgacctcctgaatcagatgttgaacagtaagagatattccccatacttctatcaaaaacaattcctcaggccggatgtagtagctcacacttgtaatccagcactttgagaggccaaggtgggtggattgcttgagctcaggagtttgagaccaccctgggctacatggggaaaccccatctctaccaaaaatacaaaaacttagttgggcgtggtggcacgcatctgtggtcccagctacttgggaggctgagaagggaggattgcttgaactcagggggtggaggttgcagtga

SEQ ID NO: 106463 - DNA, 1731 bp, Homo sapiens
tgtcattttgactcatttccttccagtacttggcagagggtagggggagatgaaaacatagtcaatatcaaaatgaatatgtttacagtctgctttatcactttgcatattgtgaatattttctgtattttctaatatctctcagttcttcaaaaatgaaatctaattttcctacttgtaccttgctgcattctacagatttttcacaattaacacactttactttaaattcaagaaaaaaaaccagaacaatgagtctcatttaatgtcatttctaagaccttatttttgtaagctagaacaagtatagaggcagaatataaaaataattttttctcaaaatgcaaattgtttatggtcttttgattatcaaagtaatacatgttcattacaaagtaattcacacaatatgtgagttaaagaaagcgtgtgtttctcttgcaaacaagtaacactcttttgaaatgccaatatgacttcataaacttatttccacttaatagataatgggagtcttttcattgtcagtaagtagctacttactgagtctgtgactcagagggcagcacccaggccagcagcaagtacttagcaggggcttatttctggttttgttgttgttgttgttgtttgtttgtgttttgaggcagggtcttgctctgtctcccaggctggaatacagtggcacatcacagctcactgcagcctcgaactcctgggctcaaggaatgtgtcaccatgcacaggttttttttgttttttttttttggatacagggtcttgctatattgcccaggttgatcttcagcccctgggctcaagcagtccttccaccttggtctcccaaagtgctgggattatatgtgtgagccacagcacctggcctcatctatgttttttaatgctgcatagctgaggcccttgagccagatccctggggttcatatttcattactgccactgtgtgagtacgactctggtcatctgttgaacttgttccctcatcagtaaaatgacttttaatacgaatacctgcgtgataagagtttttgtgggaattaaactgtaatacttagaaacgtatagtttagtgtcacatagtaggtgattgataaatttttgcttttttccatgatgtggatgcaatacattgttggacctttcggctctttctgttggtctgtcttataaacatcacagctacttagatcatatatctgggataaacttaggtttaataggagccaggtgtatatgacatgaagatgaaaggtaggagagatgtctaacatgctatttgactggttgacatttgagaatataagccaacattagtcagaacatctgacattttcaaaagaagctaataacttgtttgaaaaagccaaaaatatatgtttatgtgtatagtataccctttttgttaaaatacaatacattgtctcggccttcatgatgtacttatgggctagaattagtgatcagtcagggttttaaatccagaatgtttcatctcaaagtggaagttctttgtgttacagtgcgcttgtctacctttaccttcgtgaattgagaagtttgggttgctatgctaaaagttaattcatttgatattatgtgatgtagctttatatgtcagctctgaaactgtctataataatagtgactttctctcaccagaatgcaatatatgggttcctaatatggggctaatacatttcttgaaattat

SEQ ID NO: 106464 - DNA, 1124 bp, Homo sapiens
tattcataacctcattactggtctcatgaatttctagaggtctgaaaactcacagccaaggctgctgtacgtgactattccgccagaatcctatgggcgggtaccattgctgtctcattaatttctgtaacctcagtgctgagtgtagtactatgtatgttataggtgacctatttacattttttgtgaaataaaagaatgaacccactattatttgtcttaactaatttcaacatgtgagaagtcttccagcttacgtttgtaagaactagatcataaaatgtctgatcttttagttaaatctagttttggtgctaggacttggcagaacaataccagtatctatgggcattttgttttgacataactgactggcagacataatgcttgtcaccttctcttggctcaggagagggtggaaagttcaacaggttttacccaacaggcatttttcaatttaagtagattacggtgtgaacgatgcaggtagagatcagaactggcagggaactgggatttgaatagggccttcaatttatttgacatatctaatgttcttatgaatggggatggaaccctggtttttggtgataggtagaaagattggctcccagattgatagcgtcttgggtggattagtaaatcgatttgttaagagctggaattatataccttttgggtctaaaatttacctcacaacagcttaagataacaaacctactgccccttgcatttcaaaggtattttgtatagaagctgtaagttgcttttctgtagaactactatttctacaaaaataaaagctattattttactaaataaaaattggtaattgatttcttagtgatatattgttcatctgaagccttttatttttcttgtctgttattttaaaatttgttcttcaattgtcttattgcgtgtttattaaaacaatataattaatacattcaaaacaaaattaagaaaatacatcaccaattaattaaatttgacctcaaaaggctgcagcttacctttacagctatatatattatgactaaattacttgttctaaataatgtaatgaaacagaaaaaaacaataatgctaacaatgcatattatcttatgagttaattatat

SEQ ID NO: 106465 - DNA, 1051 bp, Homo sapiens
tttatcgagcttcctaaaatccacctgccagattcctcatgaaaacagtctaattgaaatattgctttaaggaacttttagaggtagggaggaagaaaaatatgtacataagactaattagtattttttaatgaatgctacatttgcataaattgaaagtttcattctatggacttattgtagagttgtggttaaatcggcattagtcagcttgggcatgtttcatgattattggtaaagggaattacacttttactggagatgtcatcattgatcaatcagttgaccagcaagtgagcactggaggaggcatgaatcttggggtggtgggagagtcatcaatcacaaaacccagtttgggaggtgagatgcactcatggacagttaatgaacagcaaacagtatgaaatgagaaatgctgaattgcagacaagtctgaggatatgtgagtctctataatggaattaattgttcaaaaaactgaacaaaacaaggaattgtcattgaattcatttgggatgaaggctgatttgcctctggaatggggcaggaacttagactgaccccccactgcctgggtaaatctaaagcagatgctttagatttagtcaatatggatttgaataaaaatatccaagacacaatttgttggtgtaaaccaattgcactattgtaagaaattctgaaatttccactggctaaacgggcaactctaatagaacctttatggctgggaaaaggtgaaacaactggattttattgaaatgatttcagttttttaacaaaagtattgaaggaaggatgaacaaatacgtaatcaacaaataggtgtttaggagtaactgtataccagcttatgtgtcaggtgaataagatagaactcatattctaattacaattgtaatacaacaggtgacctgaaggctacataggaagaaaataagatgagtggcttacctagcctagaagcaatgggtttacttccaaagaagagtggtatattctctgaaacggaaagaatatagaggagttggataggagaacgtggggg

SEQ ID NO: 106466 - DNA, 1035 bp, Homo sapiens
tcttgaactcctgacgttaagtgatctgcctgccttggcctcccaaagtgctaggattataagcgtgagccaccacccctagccaagagttatggtttttttttttggttttgtttttgtttttttttttaaagagaagtgttgtatgtctactcttctaacacgtatatacaacttaagttaaaaaaaatttttttaagctagtaagaaatttctgggaagtccttaccatctctggtaagaagtgttttcatgcaacagggggaaaaaatatctttttttctaataaaactgtggaaacaagatgagtaattactacacgaaagcacagaatgttttccaaatattgtgatgggtgtttattctacatttttcttctctcaaggccagtcatgggcttgtacagaaatatgaacttcagttctcaattattggtagatctgaagggagtctatgtacagaactattgtttaccatcccgagaagttaatttcatagatagatcatttaaacaaatatgaccgtgttttaaatttgatttaagaatgcatttggggtgattagcgatgtagcgactcctgcagctggtgagccttaaatacgctttataaagattcctgtccgttgccagcacagctgtaaacacttggcgcctttgctttgtaacagttacagcacttgccttttttcccccagccacagagcagtgctaatcattaagtatgtttaataaaaaatatcttctcagcctccaagtgactctctgttaaatattttaaaaacttatcccacttagtgagacattcttgacattaaatagatttaataagaaattgttagtttctgatggttttcagtgttaagtattttttataggtagttacttttccagccgacaaccagctctaagtctttaatatttaaaatgttgcttttatagctgcgtcctgcatctgtgtataaaatatagcatgagcgttgcctctaaattttgaaagactcctcctaatgaacataagaagaaagcattttcat

SEQ ID NO: 106467 - DNA, 1011 bp, Homo sapiens
ttaaaatagtttaatatacatagaatggtaacagtcaccagtgccagtcattaccttgaataaaatgtgttaggtcttctcttaacaggtcatgacctgaacacaaggttctgagcatccccttcccactaattctgatggtatgccattgaaaatggcactcaagctttatcttttgtaatgcaagctttgcattaattcataaacatatttgaagtgagactagttatctttgcatgggcaaaggtgaggcaaagtgatagggccagacagaacccagtgaccattcagccaggatgtctcaatgacagtgctccagcaggggcatcatgatctagattcatctataggaggtggttgatctctccaagatgtgttctgtcccttctcttccccctgtgaggtggtcgcacaaagcaccattcccctctcttggttgttatgtgagggctgtgactgtcaaactttgggatgctctagttaccttactagggcaccctctccccactatacatcttccacagaaggccagttataacctgttaggcaagaatggaattggaggaacactgaaatggcatgatgttgatgatttgattggtggtatcagttcatttcccccagagcgtatccttgcattttctcatccactccatccattcatgctttgaagttacgtgtgtggggatggaccctccaggatttcttctgtttttctcccttctgtgtgactgtctatctttcattgaccttttctttctttagagaggtcaatagcagtatataatggaggaataacaagtaccttatgtatacacttcctgagcctgtgccaaacctcactaactgatcatagaattttttcccaagtctgatagggcttcttaatccttctcaaagaagggagccaagcagccaccaccaattagtcatcattggcatgcttgctgccttcattttatttcaaagtctttctttcctgcatttagtctgggggacttactgtctctc

SEQ ID NO: 106468 - DNA, 1002 bp, Homo sapiens
tctcctgcctcggcctcccgagtagcgtgattacaggcgcgtgccaccacgccaagctaattttttgtattttttagtaaagatgggctttcaccatgttagccaggatggccttgatttcctgacctcctgatcctcccagctcggcttcccaaagtgctgagattataggtgtgagccactgcacccagccttgtttggaaatttttaaatgagagcagaagtacccatccaatggtaaaaaataagaaggatccataaatccagtgttacgaatggtataggaaaattggtattctcctgcactgttgattagagtaaaaaaatgtgtgtaatcttttcaggggatggtttggcttgaactgcttctagatatctgtcttagaggagggattttttgctcactgaggcatgtttacatatttttttagaggtagtgatttttaacctttctagcttgtggagcccttgaagattccagggaagtccatggttgtgtaccgcatgagaccagggctgaaaatgggtctttcagcacatggttgtagatggaaccatagaaatctgtctgatcaatgaactgttgaagtgatggacactgttcagtgaatacatgtaccacctttggcagtctttcagggggcttgcagccctgctggaagccagattcatagttccataaatttgtttttcccccttgatcagtcatctgaccaatgctgttggttattttaagggatactgaataataataataataaaaaatcccggtggagcaatgcaacgtattttctcctgtgtgggaaataactcattcattcattccatagtcatttaatgagtgcctaccatgtgcttagctttgtaaggaccctcccagtgggagaggtcatgatacaacatccagaagaaccttttgtaaggggatctccaccagaaatgataagatgacctcaggaacagaagagctcttttaaagaacagatgttctagaccagttga

SEQ ID NO: 106469 - DNA, 1050 bp, Homo sapiens
ctgacaaacctcaattctatgaaatttctgccctgtacgcttccaactgtcagagtaaagaaagaggctcagtaactgttccggatgaagatggggttggaagaggtcagtgtaaaaagacaggacaactaaatacaaagtttgatcctagattgagttctggactgagaaccagaaaatgatctgtaatggactttatttgggcacttgccaaaacttgaaaatggtctgtgaattagataatagtattgtgttaatgtgaagtttggtaattctaataattattctgtgattatgtaagagaatgtccttattcttagaaattactcacttgagtatttagtggtaaaggggcctattatctcccatttgctcccagatgattgaggaaaaaaagtgagagtgtgtgtgtgtgtgtgtgtgtgtgtgtgtgtatacagagagagcgcaaaagaggtatagtataaataattggtgatactgggtaaaggagatagggaacagttaatagatccctttattgctggattttccagatctttttttctttttttcctttcttttcttttctttctttttttttttttttttttttgagacaggatcttgctctgtcactcaggctggagtgcagtggagccctcagtagcctcaatagcctcaacctcctgggctcgagcaatcctctcacctcagtctcctgaataggtgggactacactcaccactcctggctaattttttgtagagatgaggtctcactgtgttgcccaggctggcctcaaactcctgttctcaaccagtcctcccacttggacctcccatagtgctggggttacatgcatgagccacattgcacctggccccagatcttttcttcagcttacgtacaccacgtttcttcatagaaggattgctgtagagtgagcatcacttagattaacattactagaaagaacagactttggggaatattgaacggagggctctgggatctagagcccagaatgttgaagggagggctctgggcacagttcattttgaggataaa

SEQ ID NO: 106470 - DNA, 1048 bp, Homo sapiens
gcctcccaaagtgctgggattacaggtgtgagccactgcgcccagcccccttctgttcttaaactgtgattggtttgtgtttggtagaactgggaccacacaaactgctcttaaaacagttcccacatgcctggctaacacctggttttctgtcatcgttcccttagcatgctgcttttcatgcagctggacctctgctcctgtggccctgccgtcagatgcaccctcgcttccttctctgtcatgccaacctgtgctcagacctccaagattctacttcatagggaacctttcttaaaagaaaatttaaaaaaaactttttaatgtttttatgagtactggaaggactagtttatggcatgctctacccaaacactttctatttttttcagctctataaactcttgttaaatataagaccaattagaattttaggcaggcaagacacattggtgtgcaaatcaacaaaatacctcactgtgaaatctaggttttgaatttttaaagtatttcgaggacaccgctactagtttgcatataaagatatttaatgtacacttcatttgttaggtccttttctaaatttggcttgctatcctaaagacacaaattagaggtcagatgataaaaaatagaacataattagaggccgggcgcggtggctcacacctgtaatcccagcactttggaaggccgaggcgggcggatcactagttcaggagatcgagaccatcctggctaacacggtgaaaccccatctctactaaaaatacaaaaaattagccgggcgtggtggcgggcacctgtagtcccagctactcgggaggctgaggcaggagaatggcgtgaacgtgggaggcagagcttgcagtgagccgagatcgcgccattgcacaccagcctgggcgacagagtgagactccgtctcaaaacaaacaaacaaacaaacaaacaaacaaacaaacaaaaacataattttacatagatagcagctgtattaagctgcttcctttgtccttcttatttatttatttagatacaaatctcc

SEQ ID NO: 106471 - DNA, 1045 bp, Homo sapiens
tcttgcattcatttgctaactcatttgttcactctgcatatttcttaagcaccttctctgtgccatgctccatggaaatcatgaggtatcctcagaattgtgtcctgccctcaaagtagttgagggacagtaagttttcagaagggccttaaaattctttcttcaaaagtagcttcattttatctttgggagctaggggaggacagatcaagtcaggcagataaaatctcaagagaataatgcaagaattatatcttatgtatatttttaaaatgataaatatttcagtttgagagtatgaagtttcgacttgtaaattttagaattggactcttctttctccatttttcttctgttctggtataaagcagaacaccactattaaagtataattcattccttttatttatggtgacctaaattaatctttttattctttttaactatcccaaaagagtctttttctttttttgatgaagaataaattttctatcgtgttatggttttaatttttttttttcttttcatggttctgatggcagtgtgaaacaagggcctttaactctggagagagagagagaagggataaattagtaattttacccatctaccaaattcccaccctaaccccagacccccagaaaaaaacaagaactatttttgagtctgagaaaattgagtttgtgttggagaatggtggtagattatttagaacttccttcttagactgctttacaagataatgacggtaaactaatatgattcctaatttattcctttccagttgctgctgtttgaatatcgtccttctggcattttccacatccttggttttatccagatataagttcaattctttcactacattacctagaagtgcaatttcagaatgttttgggttgattaagaagacttttttttaatccacaaacaaaaattaaaatacatatgttccaattaaactattttaacagctaattgatttcataggacttaccattaagtgaaggccagagtcattcttaatgttcaattgcagttttgg

SEQ ID NO: 106472 - DNA, 1001 bp, Homo sapiens
aaatgccctcttatgcttccataatatgaaggcatttatccactcagtagagatttattcagtaacgtctgcaggcttggcattggagtagatgctttaaaaaaaaaaaaaaggaatgatacgctctaccttgcaagtttttcagagagacaggacttgtgtgtgtgaaaagtgcaatagagtttgcaaggcagcatacagtcccattagcatttgtattgcttcatatttctagactaagtgatgttgcagaacaccagtattctgttctatacaatccgttcacatttctaagagcatgagcgttcatttgtcttttcaattgtttcccactttctctgcatacacaatacttgctggtagaaattgcgagggctgtaagttggtaggttctctgtaatcaaggaaaataaatagtttctgacactagatctttgaaatggtgtctgaatatgcacactttggggctttaggaggcatctctttggctgtataaattactggaagcaagctgtgtgggatgaagcaggagagcttgtggaatgtcattgttttagagattgtagggctctgtgggaagtgattctagctttggaacctttacacagccaagattcttggagccagatgtagggagtctggtttctcttcatacatgtacactgtatggaataatatttaagatgttattatgccagaattgttgtagtgagttccttgagtggaactgtgtccccttctctgtgcatttcttgtagagaagttaagtcaaatcaacaggcagtgcctgcggagctcggaaactgttggtgaacgtggtattctggaatccacgaggccagcctttcccagaacatcctttgaggagcagtactcctggaagatgctccacctcgatcaagtcctggaaagtgatgtctagtctagcacagcttcctcttagagactgacagtgtgctttaacataataaaggctctctgataaagactgaagtaaaaag

SEQ ID NO: 106473 - DNA, 1061 bp, Homo sapiens
cacctgaggtcaggagttcgagaccagcctggccaacatggtgaaaccccatctctactaaaaatacgaaacttacctggacatggtggcacctgcctgtaatcccagctacttgggaggctgaggcaggagaatcacttgaacttgggaggcggaggttgtagtgagccaagatcgcaccactacactccagcctgggcaaccgagtgagactttgtctcaaacaaaaacaaacaaacaaaaaaaaaacgtagatttcctaggttaacaagtatactcagttttaattttgaaaggctgttgttcatgtaattctcttaaccaagtacacaggtaatcagttgaccatattctcattaacacagggcatttttgttgttgttgttgtttaggagtcattattttatctcacaagtttcttgtgcttttatgatattctttctctttcctacatgtagtagccaaagtacttcatatacttcaactgtttgagttatgtaacagagtcagtaagaagcagaataaggaatgttaacctctaaacataccaagataattttttaaatgtgtttatttatttatttgagacaggatcttgctctgtctctgaggctagagtgcatttagtgcaatcataagtcactgcagcctcgaactcttgagctgagacaatccttccatctcaacctcctgagcagctaggacaggtgcatgccaccttgccctactaatttttagttttttgtagagacagggttcactatgttgtccaggttggtcttgaactcctggcctcaagcaatcctcccatctcagcctcccagtgtgctgggattacagacataagccaccacacccagccataaaaatgttagtaactattttaaagccccaaatcactatggtaatttacattcttgggctactatttactgacactgttttgctaaactgggattcaactgactgttgcaattatacagaggcagagttaaagctcagattttcaggtcatcagaaaaatagagattttcagagcatcgtcacatgtttctcatctc

SEQ ID NO: 106474 - DNA, 1110 bp, Homo sapiens
aggcacattcttacagtgggaaagaatatcattacaagggttgctcaaaaaataagtttcctatgatgtttttaatttgccggtcaaggtttcagtatattttaagcaactttttcaattacagtaataaccagtattttggggtgtttattcgataagtggattattgtagcaactctcatgacagctgtaagaggtttattgtcagtgttgtctttattgtcagttgttgtcagagtttggggaattgagtctcaaggaggttaagttacttgcccaaagtcaaccagctaaccagagcccagaacccaaacctgaaggtctgcccaactcttaaagtccttgcacttgcctgtgaggttctgctgacttccgttgtcataggacagattgaaaatccatctagtatcaggtaggccttttagtatcctttggaaaaagttaaaattcagcatgattgctgtgctgcctcctttcctgaaatgttacaccctactctgatgtgctttattggccggaaatcttctttccataaactgcatcaagttggtgatgctttatgcaacagaaagagaaataatttaccataaacacagcaaatcattggataaatctatcttgatattttcacataatggtattctctacagtaataaaaatgaactactacttggacaaacatgggtgaatctcagatataacgacgagtgaaagaaggtgagacaagattctggtgtatgtttccattaatgcctatggaatatggggctatcaactggagggtcttaaggaagccttctagagttctggaaatttttgtcttcatctggctgaggttgcatgggtgtatacagatgtgaaaatgcatctgactatatacttaacatttgtgtagcttactggtttatgttacacctcaatgaaaaataaagataacaggcaaatcacaacacacatttcttctgggacctcaatgtctaatgggaagaccattttaaactaaggacttccacgttttagagttgtttcctaatgagacttcttataagtcacccagcttacaagtggatcagtgacctgacagtcttgaggagctaatgcacaggcaat

SEQ ID NO: 106475 - DNA, 1150 bp, Homo sapiens
aagccaggcagtgatctctttctgggtaagggctaaccaaaatgcaaggatgcaaaataaccacattataaatgctttctgacagcaacgtgaaccaaaatctagttagtggtcactaggatgttgaagtcagaatgaaagaagctacagcatccttgccacgtggctctttaggtaagagccacggaaggaggggagattcagatgtgaaatcaaacatcctgagaagtgcttgcccttgtcctcatacagcaaattagcttctgaatacacagttacctgctaactgctggggtgggtgaatcctcttctctgcaattctggaaggccatgtggagtctctggtcctgccctttgtcactttcctctgcagccatggttaacggtatagccattcaccctcagcatgcataaatccttttttcccacaagaggatatcggctggatgtgatgtttatggaactaaaggagcagctggcggtgtcggattcaaggcaagtaggttgtcttgaccatcctatttagcagatggccaggacttgatagagcaaaaattattaggatccaagtcaagggccaaatggcatgggggacagtagaagtaaatggcagcacatatctgaacgcaggcacatgtcgtctgatggggtctctgtgcttccttttcattttacttcaagcaagagtaaacacaggccctcctgtagagcctccaggtaaacatatctctagagattattgatagcttggctactaatttgataattgtgtggatccttatggtgggctattaattgaaaagaaaatgttacgaagtttagatttcatgagcgtttatgtgaatttggccttcagtccgaacctaggtttcatggtttttctgtattgtcagtatctctatatactttggttgtatctaaagacaactgaaaagctttaattcagagccctttttcgagtttgtgtgccatctttttgaagatgactaatgccacgaaagctgctctgaagtggaagtgccaggagcgaagttttgcaatgagagtacgaactctgcagggaaagggggtgtctgtttcttctagtccattttaagctcatttgtgcaattgctgccttctccgtattactgcataactcctttgatct

SEQ ID NO: 106476 - DNA, 1069 bp, Homo sapiens
cttttgaaatttgaactcagggagatattactttcagagccaagcacattgacaagctcagggataaattgcatttgtttgtcattcatttaaattcaagtgttaggtcaacttgttgcccggtgttattgtcctttattggatgtggcatttgtactcagcattatactctaaactttaaacgtttaatcctcatgacaacattatgagactgtatccccatttcacagacaaggacactaaagctgaaagcatccatacctgactcagaattccatattttccccatccctggcctcctgcatcctagatggagaataaaatgtaaacacaggttgctaatacagccctcttcactgttgtcatatttaaaagctgccaaaattgcttagcttatgcccatgaatttttttttaagtggcaaattgattgaaacagtgagtgaaagggattatttcagttagggttatgcctgactggaacaaatccacttattagcatgctctttggattccccaccctgacttttggaaccaagacatagaccagagaatgagctcagtattattagtaagttactttgaccagccaataatctccattttctctccttttctcctcattcatcttctcaaccccagccatattaaccaccagtgaagacgatgggagctgaatggatgttgtagaaggctttgcatttgtgcagttgtttagaatctggggtcacgttcctgagctcagatgaggtgaagtctgagtatcagacatggagaagctgtaatcagaagtgaccaaaaattgaacctgggctaggttgactggttgttttccttttgcatagcctacaaatattattggtgtgtatcagtcatggaagattagaaacactttctttgagccttcacattatcagataatactaaatgcattaaaaagttcctgtcgtagtcttttttgtgctgctgtcacagaatgccacactgggtaatttataatgaacagaaatgtatttggttaacggttctggaggctgagaagtccaagagaatggccctgacatctggca

SEQ ID NO: 106477 - DNA, 1115 bp, Homo sapiens
ccccatctctactacaaaaattaaccaggcttggtggcgggcacctgtaatcttagctactcgggaggctgaggcaggagaatcgcttgaacctgagaggcgaagtttccagggaactgagatcgccccactgcactccagcctgggagacagagggagactctgtccccccttcccccagaaaaaagccaaaaagaaagaaattgccacagacataatgaaatcttctgctggtcagagctagacggctgctctctctcggtcttcccttccctggctcttccaagaaagctatcagtgaaaggacaaataagttatcacctgagaactcgcttctattagtgtcacaaaatgaggctcttgcaagcttttcttgtcgaaacacggcactggcagttgtggctatgacaagatcaaaacttttctagcagaccagctttctcatgtgactagtttgttcacttggctcacatttggggtctccctccacctttttgcccctgccctgggacacccatcatctcctcaccaaatctatggacaaagccctagaatagctagagtcactccaggcctctagcaaaaaaggaagaaataacagtgaatttgcaaatatgcattgactgccctgccaagcatttccagagagtggagaaagctatctgagaaactccacatcattcatctttccgtattccacctgctgggactgaagtttctacaataaagagtaacggagtgtcatctccaggtcagtcctctgaattccttctagaacagtgggtagacttcatcttacacaattgctgttgcatcaccagccacacattcactgtttaaaaagaaaccggccccaggatatggtgctgcctgcactgttcccctgccggggatgcacttggttcagccccttaagaagaccatgtgcctatttctgctgacgttacacatgcaccccgccctctgagccagaaataccacacttaagtatatccccaagaaaaatattgacaaaagacttgtgcatatgagccttattcataatagccacaaactgaaaacagcctaaatgtccatcagtgggaacacagatatagaagttatagactgttcat

SEQ ID NO: 106478 - DNA, 1032 bp, Homo sapiens
ttgacttaacgatccagcatggctagagtataccactaaggaatttgttcttgatcctgtgcatatcattgattcctgcagtctttcccacaaacatgtttttgaacccaagaactgcaagcgatagaatgtggtttcttagccgcaaatgaaattaactcactaaagagaattgcactcatgaaatctgagtattgtttaagtattcaatcttgaggaggtaataatagctatcctcaatgatgatgaccttttgtgccagaaactcttctaagctctttataaatgttgacccatttcatcttcatgaacaacactcttgtgaggtagatgctatttgtacccccattctacagtcttatgaggaaggtgctgtgcatacccccattttatagaggagatcaagccacacagaaggttatttgcccacaatcacacaactggtaaccatgccatggtgtctgattccaaagagcatgctctgaccactaagcctacccacagttcagaaaagaaagagatttgtggacatggagaaatgaaataaaacataccattgattgagttctttctgtgtgctatgtactttactcagcactttatacatatcaacttaatcagtggcaacacaaacatagagagatgggtattcacatagaacatcatggcgtggagagattgggtaacatgcccaaagattcatggttaatgaatgatgaagccaaaaactaagcctgggtttgcctgattccaaaacccatgtttctgaccactatattgtactgcttccttctgagtgtggactgagaacacttcatgggaaggcatgatttaggctgggcagttaactgtgggtaggaactgatgaactggagatagaattgaggcagtgtcagaggaaggggaaccatccaggcagtgagaggtctttaagtcacctcatgaggtttgaatgcatggttggggatgattcttaggagggacatgttagttgtgcaaaattcagcatggactgaattacaaaaagtgtca

SEQ ID NO: 106479 - DNA, 1036 bp, Homo sapiens
cctctctctctcccaagggaggaaaacagctcatattcatgtggccaaactggatccttgctggctggctttgtggaggtcacagctgtgtcagcccttggaaaggaaagcattcgccatccaagtattatcgcttcagaccttcccaccctgaccctgccaacattctttctgaagttagcacagaatgttcatttcagaaaggcgaacagccaattcggaaaagccaagtagtcaggaattccatgtctgcctctgacagaaagaaaacattcctagtctctcgttcttctacttctctacagtctctgtattctctcttttcttccctgtcatccagcatgggtgcctgcactcaatgaaaatttgagcatattcaccatgaaatataacggttagcacaaagtgttgacttgtatgatgtggatttctttgaagcctttcagagtacatacaggcaaacagtaatctttcttctcttgttcccttttgtgagtctagttgggcattcaagtcagccctgccagcctgtgcacttgtacctctggcttgtgtgataatctagattaaaatacagcattgctaatggaaccgcacattggtttgggattccccacttagtcagcatggcttatgtggcccctctaaacatcttctgaaaatatcaggccaaaatcatgtcccccaaacaaaatgggtcaccccaacaaaatggcagcactctcggcccttctgtgggatgtcagaggagccggacaacacatggagatggttgcaggcaacatattcatgatcagtcatagaagatgattagctttcagtccagttaactaggatttgttttcttctagaatagtgcttctcagatgatggttctttgcccataggcaactaacccaacccttcctttccaggactgtttgcatcttgtaggttaaaataaggcactacctatgattttccccagcttgaattttacttaagtgcttgtagggggtgctatcaaaaaggcaataaataagtctgactgcatcta

SEQ ID NO: 106480 - DNA, 1758 bp, Homo sapiens
gtggggcctttgcccgggaactgcccgcttctagccagtatttccctgtctcctgtccatatcatcaggacctttgaattgctcccaacaccccagtatatagcagtcttactaccatccacccccggcaagaactcccataccagcctcacccctactggaaatcacttgcttattatttttttaacctattatttaacagtttaaccccggtatctgataaacataagtttatcattttcaggcatctcagtctttttccatctctacttgctcatgtgaaatgaatatgaatctctctcccaggaaactagaacttctggttctaccctcacacctctcctctcaggctctgggatttatcagaattgggtcacagagctccggaaatgctgaggggagcaaggctgatcaaagccctattacttggaagggaggaaggaaaaagaaggaattttcttttggtgcgaaaagggatatttcccaacccagtgctatccttcttcaaaattatgagcttgggtaataaagggagagcttgtgtcatttatcaacactggaggtagagtgggctactgttagtgtggtacgttacgtggagaggttttctttcaagagtgcccccacccccaacaaaagggaacagtttattggcatatggactttgtaggaacagggggaatgggattctattccacaagtaactgcagtgacatgcactttgatgatatgaaagagcccattttctaggctcatgtttctgaaaaggagctaaaagaagaggagagggagtttaagaatgtgatcatttccttcctgtctgtgtgattttgtttgaggttagtgaggagaagtgagtcaggcaccaggttccctcaagaaatgcttgagattcaagtaatttggggacaatagattgtcaagggcatcattctctgggaacaatgggagaattaagaagctcacaaacctgtgaaatatcttaggttgggctgccgtggaaaacctcacatgaactaattttttttttaacctagttaaaaaaaaatgaagaaaataacccaactagaaagctttctcccaagagaagttgactgagaaaatcaggtctcctggggattttgtgagagttatatgcagaggatgtggattgggggggtgaggaattcctatcacaagtgagtgcaagatctgatagctcagaattgctgagatggtgacagatacaaagctctttcctgaaaaaatgggccaagcatatgatatatcagctgtacagagaaaatgcatggcctttattatccaagaaagctagggaggataatggtttctattgtgttaaattgtcaaagtaggcacgatcttccactgaacgggccttctctgaatttgaccacaaccacagaaccatccttaaatacggcaaattcatgtgtcattctactaggtttgtttgaattatcatagtgctcgttgctgactctttaagacatgggaatattaaaatgttttctgatatttttagagccaaagagagagcaggatctagatgcagtcctatttgtgtgtttaacttattattggagagctacacgtacataaaagtgcagtacccgtaatacgtgcacagcttgatgaattttcacaacctgagcacacctgagtaacaagcacctagatcaagaaactcccgtctaggatctcaggactcccccatcatcccccttcctaatcactctgtgttcccaagggtaacca

SEQ ID NO: 106481 - DNA, 1697 bp, Homo sapiens
cataggcttgttgtaagatacatattttctgtcttcaaggtggtaatggccatgactgtgaatgtgttggatctgtgtttccattccactgaaagaccctaggaccaaccagagattcattaacttggtaaccacccacttacacttcactttaacacccggtcatctttcacatcagaggggtaaccagagcctcagttgactgaatatagctccccgcctcctctgttccctggttatgatcgtgaacttgaggcagccagtggtgggggcctgtgttcatgcacccatattttatcaggatgattggacgtcctggaatagagaatacagaatccagcctttcggtgccaagcacaagaggcagggccccttaagaaagaagtgggggaaaagtcatcttaatattgtattgttgctgaagaaagacttctatatggatgtcatccataaaaaataataaagctctagttgcagtaaatggaaacaatatttaggcttattggattgttcaagggacatccgatttgccactctgccctttgtcggcaaataacttagacagactttaggatttaatgggctgtcatttcagttattctgcagcatatcccgggtacatgggagagcattcagtgattaagtgctgaatactgtctattgtgaagacttttggaacagggaacagagaaaaataactttccttccaacaacatgaaacatatggtttattaatttaaccaaacctgttcaaaccgcagtggaatcaaaaccacttgatctgataatttgatttgatggcttaattaaaatgacactgtataatgtaataaaagcaaaggaaatggagaggacaccgggctgcctgcataccctctaggctcctaagccgatgtcgtgtttttttggtgagtgttttttgcctctgctgatggagggatctcttttttagctatgttttcaattctaaacattgcttcctgttttggttaaaagcacttttaaaggacatgtaccaccgtgcaaggatgcctgagtaagtagcctatttaaaatcagtacattgagaaagagggtcacattttctatccaaattagcaaacaaagaagtaaatccatgactggtttaaaaaagagtttgacattgaaatcatggttttctgctattttgggagaaaatattaatgttgttctattttcagtttaatcatttctactcaccagattaatgagcttgaattacttatcttattaaaagaagctctgatatgaacacttaatgcctttgcaggcagctgccctcctagaaactcttgcagaaagttaccttgttactgccagaaacttttagcataggaaagtattaagaaaaacaaacttttcatgcagcccccatggagagtttttaacccccttctttcaaaaataactttgatttgtcattctttttttaacctggagtgtttaagaaagaagacaaaaaaaacaggtctgtttcaagacccttggaacatcctaggctctcatacttctgaaggtcctgccatattatatccaacatttttaaatgctcagacatttcatgattactctaagtttatgtaaatatatgagttggtgttaagttgcatttgataggttgacataatgttgatattttatagacttttaatgtagcattaaatattttgtatcaa

SEQ ID NO: 106482 - DNA, 1794 bp, Homo sapiens
gatggggtgggggtggggagcctactatttactgtggaaccactgagaaaatatccttgacattgatttaggatcagaggaccttgggtgctctgctagaagactcttcattacttaaggaagcctgggatcataattaaaggtggttcagagtgaaggcagaaattctcagagctggtgaggagcagtaccttcatgcctgtgagaagcaatcggaccccagtgggaacataatcaggcccctgaaaggggaaaggctgttgtcaggaggcctcacaggggatatttgtttagagatccgggtgtggcacctcccgcatggttaaaaggcttcaattttgtgcaaaaggacgtatcaagaggtctatcagacttccctttgttaggtgcagtttacaaggaccattgagaagagatagataagtacaagtattgggcatctgtggtgtgccctcgagagtgctcctggtgttcattttagaccagtagaaaactcacctcgccttgggggccagagagctgccggggaagtgggctgagcagaggcaacggggagtggtggagactatggcaaaaaaaaagaaaaattgagtacacactcccatctaaaggaaatggttgctctcctgctctagctcaccactgccacgtgtggatgcaggcgtgattttaaagcccatatttatatgtaaaatataccatttttttaacactgtgtgggccatagagtgtgtccacgtacttgccattgggcctgaggcccacaactttgggtttatccacagtgttccctcgtaatcctcactgcaaccttgtgaggaagataattgctagaccctagtcatccattttacagatgcggacacaggatttgcatgggtctggctccaaagcccacactttctgttataccagctcttccaaactgatctatagaattctgttttgctgcgtttgcctgtttcctttttggacttttgagggaggtgttgtttgaaagaagggtttccatcacttaaagagcaagcagaactttggaagcacaaggcacagtggtgtctgcctgctcgcttgcctgagttatttgacgggtgtctggtactatcgttgccccagtcgccaagcatcggtggtttttgttccctctgtagactgaatgcttttcttattagcagaaggcatgagttaaagaccagagacaagatcctcaacacatttgaggctcctggcagtgaccccaggaatgaattgtgtggcactgattttgtacatggaatcctcttcaatggaggacgctcaaaacagcatccctcattccgtcagagaaacgcgagcccctgccaagggtaccagtgataaggagcttggtggtccctgcctgggagatgcttgcagctcagtcagggggacacagaggtgggtaggtggtgaggacagagggtgatgggcacacagggtgaggagggaagcagtgagagtgcaggaggacacgggtggcccatcggcctcagaggggaagcagggtgttgaagctggatttttttcttttcctttttttttttttttttgagatagggtcttactcggtcacccaggctggagcacagtggcatgatcaaagctcacggcaaccttcacttcttgggttaaagtgatcttccaccttagcctcctgagtagctgggactataggtgtgcgccaccacacctggctaatttttgtgtttttttctagagccggggtttcaccatgttgtccaggttgctctcgaactcctggcctcgagcgatcca

SEQ ID NO: 106483 - DNA, 1046 bp, Homo sapiens
aaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccaggtaagtggtgcaggtcttcttcgagggttcctgctcctgtgaatagtcgtaccctttttcaaaaaattgggagcagaaggtgaagcttcagaaggtacttaatattcttagaatcatatatgtctgtcatagaaaaggtgcacacatgtgaaatgtgtatgtgtgtgtccctgttttactccaaaagcctactctcttacgctggagtaagtctttctttgatatttgttttcttgcctcggaataactccagggacttcaaccaggcaatgatatacatgaataaaaaaagccatcgatcttaagaagtttatttattaagatttcattccatattcattatataatgtatctacaaatggctagtttggtgccagggactgggcagggtgctgtcccaggggatcctagtccctgcctaaaaagtttaaaggggaaggcagacagatgacaagacagtagctagctggagcgcatgcccagaagttaggtagcaggaacgttagaaagccagcaagctagatggtggttagtcggcaagctagatggttaactggcaagctggaaaactaactaactgaagttttcgattgtgaaatg

SEQ ID NO: 106484 - DNA, 1221 bp, Homo sapiens
tgaggcaggaggatcccttgagcccagaagttcgagaccagcctgggcaacatatcaagaaagtgtctctaccaaaaaaaagagggaaaaagcagtatgatacagtctagtctcagggcaaactgagattctagctctttaccagcaatctcatcataggcagccctttgtgctgatactcagcacatctgaagttctgtatgactgccacttacacactcagatgttacagagaggagtcagattcagcaaacacccggtgagtgctcaccatctcctgctgctgtgtgagggtgctgaggaagagagtggtggtgatgataagtaatgatgctgttgctaggatggtggcgggtgatggtgttgccgaagctggggtggtggtgatgacaataatcacaatagttaacattaaccaggtgccaggcaacattctaagtgttttgtatgcattaactcatttaatcttcatcccaccacaatgccgtatgcaatattattacttccatttacagaggaggagactgaggcacaacgaggttaggttagttgcccaaagttgcaaagctagtaggaggcagagctttgtaactgttcttccatacacagacggaaatcagccctgcctttggggacctagagtaacaaaagagcgattataattgagtatgatgtgtgcagtaagagcaacacaagatgatgatagtggtggtggtacttgtcatttgcttgatgccaggcacacttctaggtgcttacatgcaccttctcattgaattccccaacagtcctatgaagtaggctcttttcatcccatttgatagatgaagaactccaggcccaaactggtttaagttattggttaaaagtcacacagaaaatggccaagccaggatttgaacctataatctctgctctgcccttaagagatagtacaaactggcggcttcgggaagcctcacagagaaggcagcatttgaaccaggactgaaggatcaataagatgaattctggcatcaggaaaggaaaggcactccctgcagtaggaatgggaggggcaaaggcagagaggcgggaccatggctcagcatggtcactgattaggtgagtgtggctggaaccgtgacagggaacagcaggagatgatgctgggttggggatggaaggctctgctcctgaagagccttgctttccccactcaggggtatcctgagggctatg

SEQ ID NO: 106485 - DNA, 1980 bp, Homo sapiens
taattaaataaatactttcaagtgttcttgtgtgacagaagtgcatctttcaaattctgtagccaagtctcagatgctacagttatttaagttttaaggagaaactaaatataggacttaatatatagtaataacttgccaactgctgttcccatctccctgaggtgcctctcctatttattctccaatctgtattgtgaattaagaaaatgtttgttctgagatgagaggaaagcatggggtaaaagacaaaacccgaaatgtgtctaatggcaccaaattcagagacatttgtggcagaagggaggaccaaatgatctccaagttcactttactccaatgatattttaagccattctgtttgccagggcagtgtgtcaaaggtggaagagtgggtatatgaatgacaagggtcatcactgtgtttgtgatatcctaaccttccattaacaccggggtaatagaggctgcgaatatgtaaagatgacttaaaagagtaaagttcccactgggtatttcttacctcagcataaaagctcctcataagctcctttgtgcataagcatcctcttttgaaaatgtcacagatgaggcctgatgacggggtctgtctgtgttagatgggaggggagggcatttgtatgcaactcttggtggccaattgaaaatactgtattctacacctgttctcttttgttttttgtccatttagagggtgtaacaaaataaagtccaagggctttcccagacgtttccgtgaagtgccttcttctggggagagaggagagaaggggagcaggtgaggggcggtcaagcttaagtggggggcgtcttgatggccgggactggcttgccaaatttttgttttgttgccatggggattgaagtcttgtagatggcacagtgctgaaactcacctgctttacctgaattcccaaaagtaagacttgcaaatatcaattcagcttgtgggtagctggtaccaattaaaagtatgtcctgtgtgtgcttgctttgctttattttgcagttttgggggtgttatttgtttccgggtttgtatgtactgggggtgctctatgtttgtgtgtctgtatgtgtgttgcatccattttctttccaaatttttagatatttgcatggttttgagcttttaaaaaaacatataatgcatgcatatagccttatgtgaaaaatacctcttagaaacctaaatttgtagataagttagggatgaagagtaggaaggggagagagaagtgagcaaacatggatgtactatgtgtttttccttaagaatggtgaagttgttttttttttttaaaaaaaggaaatgcatatgagttctggatagtttgaatacttggaaaaattattgtcctggaaagagttatagtaaatgtttggaactcatgattgtacagttttaatcaccacacttgagtctcttgataatatttctgtaaggcctgtcttaggcaaactgtatttaatattaatatcttttaatattaagttgctaattagactaattcactaatccatattatgtcaggagcagtccctttttactttcaatgaaccaatttataggatttatgttagaatttttacatggaatgattcatctccattggttgtgggtaaatcagaatactgagatgaaattttagatatccaactattataatcagataaacctatgaaatctgagaaggtatagtttaggagttgtgacagattaatgagaaagtatatgatctattttcttttacactgtactgtgcaattttggccttgtagggaaagcaataactgctaacactggtaactaaattattctgtgatccctttttgcttattaatgtctttaatttctaatacattttcaaaactaaggatagaaactgaaatagaaatttctctgtatagttttggagtcaaagactaatcttaagagaggaagacgttggacatcac

SEQ ID NO: 106486 - DNA, 1032 bp, Homo sapiens
ataaaagggctttgaaagacagggtgccccctacctctgtcaggcttctgcaggaggctggaatgcaagcccttcaaccaggctctctctcacctttgcctttttcattccgctctcattttctttcctggcttgtatctccacctaaaatgtggccaggaatcaaaagaagagcccccagtgatagctaaattgcaaccctccaaacagctacaagagctgttacagaatccctacacattaacttcatgtggcattactcttctgcccctgtcatctccctgtcccacagcaggaaggaaggagactgtgccgctaagacgcgttgcacagagaattgctaaaagcaggacaacagctgtgagaggtgattatcctcccagaaaggagaggaaaaaaacattgaagatcagacccaagtatttaattttttaataaagctgatttaagttttgagtaagtaatacttgacatgattcaaaataaaaaagtttaaaattatatgcaccactaaattaccatcccatcactcacccaccctgctccctacctcctcacaaataggtagcccctattgctagtttgttgtctattcttccagggattgttacacatatataatatataagcaaataatgaatatccttttatctccttgtacacaatggaatacagcatatgcaatcatgtgccttgctgttctcacttaacacacgatttccctatgcctatataatttcctcatccttttacacagaagcatggtattcctttgtatagaagtgtcatgatttaattaacctatcctctgtggctgtcattttgattgttctccgtcttttgttattataaacaatcgtgtgatgaataagtttatgtgtcactttgcaagtggataagcatgtctgtaggaaaattttcagaggaaaatttattggctgtatcacaaggtacatgctattgtgcatgtatggtgccaagttgccctccataatgggataccaaggtgggcttctctctgcagtctatgag

SEQ ID NO: 106487 - DNA, 1010 bp, Homo sapiens
aagcaccagaagcacttcggtagcatttagggctatgctgtaagaaaagtgcattcttttgaacagagacgctcattcggtgaggcaaaatgcttactctgtgagagggatatgagaaatgggaccaacttagggaccaacagattcacatttcccgtttcactttcattctgtctcacatacccactgagttcgaactgaggagataacttgtgcaaactgagctctttcttgtacccatctgggagcattcagtgaatgtttcatgtaagtccctctatcttgggtatcttgttgatgggggtgggctttagaaagccatctaaaacagtggttttccagttggtttaagtggcaggaaacttggaattcaggatgtcggaacatcattattattaataatattgaaataaatattgacaacttcaatgccttcatagaaactgaaattaattttcctaccagacaagtatagcagtccacaagggtggactctcaggagccattttccctttctcacagtggttcataattggacacagtacataccagaatccctagagggagtcttcacaatacacagagctatatataccccaccctgcacctgctctgttagaatcatcatgaatggggcttaccctgcctgggtattctaaaagctccctaagccaaagagctatgcactgcttgttaataaccaccatttgactgatactttactgataagagagagagagagactgagagacagactgactgactgttcagggccctccaaaattaaggcatacctaaatcagagtacttaaagtgtcagaaagatatatgctgcaaattgtacaatagggggaagtagaagataactaatttgggtcattactaggcctgtcagagtcagtgaaaataatgttacctggcctcagtttcttaaagggcacagacagcacccaggcgttggggaagggatgagaagtaaaagggcagaggtggaaacatgaaatatatgg

SEQ ID NO: 106488 - DNA, 1032 bp, Homo sapiens
gacccttctctggtcacaatagccattcacgctgagcagcttcattaaatattcagcctgtgcttccggcagctcattagggccgcaatgagcagtgacgtggatgcaggaaagctgagggccagccagcatcggaggcagaggctgagtgagctgctgatggcttttctcttcattgcctgtcctatgatgaccagtgtgtgctctctgctttgcttgaaatacaggtaaaaaaaacaaacaagcagatgacacgtaagggcttcaagaccttgtctcagatgttgtctggcaagggcctctgattctgagtgcttgccttcctgaagccctctgacccctttaaagagctgtctgaggcttagggggcctttgcatgaacaatgtggtgctattgtgtacttgggctgtttgatgacgatgttggaaggggatataaggtgtggttttgaacttggtgctggggatttagaatagcaaattattcctctgtaacgtaccaaatttagaaatattgtgagataaccctagcactctgtgtggtaggtttactctctaccatgttttcacgtatttgagtagttaaatactaagcctttccctttgaactatcagtttggatgcggtgatgataaaaaaaatggatatgctgtagcaattttgggcccctccaacaggctgaatgttgtccttgtatcttgttacttttacatgagtttaccctcagtgctgtgtgatgtttaaagctgggaagatctataaaataagaattaaaagaagatgaactcaaataaagtatattctattattgacatgtttttctcttttctacacagaaaatgttttcagactgctcatttctatgtggaagacagcagttcacctcgagtggtccctaatgaaagtatccctattattcctattccgggtaagtaagacactgctcttatttccaatgggctaattgtttttctcttttattctcagttttatgtgataaaacaacaaaatattttatagccttttaaagct

SEQ ID NO: 106489 - DNA, 1058 bp, Homo sapiens
gaaaatagtgttgtatctgtcatttctaagtatatgaaagtcctatagtctacatactagagtgattctgtggttaggttgtgtcccatctcacccattttgcctcttgtttgaaaatgagtttattcttgggctaatcatttagagactctccagctttgtacatagtaacccttttctcaacttgagatcattttcattgccactgatcattattgtagaatttgcttctaaacattttaagtgaagtgatcagataattttggaaattttcttgaactgtgcattctgctaaatattctggagaaacattttggctccgcttactctgttaatgctggttacatcatgagagctatagatttcttgggcatgcaaaatgattgcatattcatgaacatcttcaattctgaaatatttgtaaataacttggcaatttttttcataaggttgcctattaacatgattaggactttaattgttcacacaggaagaatttgtacttacagagcaccacctatttgataagtaacatttctatgctaagcaacttggattatgaacacataagtcaccttcctaaaacaaagtataagagatgctattttccacttaagcatgattcaagtttgaaaatgtcaatagatgcaaaaagccaccctagagctttgctctctcgaaagaaagaaggaatgacatagtcaatgttaactgtcaccagatgaagagaaatcagattgtcaggcctggatctataaaattcttgccaaagtaggacctcatttacacatacagatcttcataccctttgctaagaaaagcatctgtggcagtttagatgtttgtgcgtttgccaaagatctttcactctgaataaagtaaatgtcatgtctgttgtttatctcaaattcagcagagtatttttaaaaggaaatatttgtgggggagggtcgagggagaagggaagaaggaggttggggagctccagttagttgggtgtggctattttatagcagtactcaagtatcatgataaataagcttaaaacatactttggg

SEQ ID NO: 106490 - DNA, 1006 bp, Homo sapiens
cacagctgtcttgagctaaaattttgaacacttaaagatagatggcattgtacccagagccagctggtacaatggcatctatctataattgtgtataaaggattgcttaaaacttataagattggaaatagaacttaattgcttaaagttcaagctggactccattgaacagcaattaaaaaaaaacaacaacaacaacaacaaagaaaacccctggtgtgataaaatttcttggcaaatgggtacccttgataaattcacacttttagttaagagtatgctatggtaatttaactatgtaaattgcgttgaatataaaaataaggggaattctctatgtacctttttttaaaaaccatatttaacctggcttgtaggcattaaagtcataatgagatcctaatgtaaaataaattctgagacttttcttcaggacatctattttgtgtgatacaattattttgctctttgcaaaaatcaagtatttgtcttaaggatgctttgctttatcagtgtaatttgttttatggaagtattctatgtaactttgaatattattttattccccccagatgacatggaagccattcctgtcaaacagtttgtcaaacacatcggtgagctctattctaataaccagcatgggttctctgaggattttgaggtatgtttcaaggctggaagttaacttccagaaacctaagtcttactttatgcagatttttgtaaacttgaactgaattcattccaagcataacaaaacagtaactacggaaagtggagtttttcttttcatctattattttaataggcattcttttccaaataaaatttaggtgaaaggggagttgattgtacctgtcctgaatatgtatttctacaaaagaaccgacttagtgatagaaaagaagcaaactggtagggattgcttttcaggttcttgctacatctaattctaactgggaacagcagtcataacacaaggctccctaattccatgtctttt

SEQ ID NO: 106491 - DNA, 1122 bp, Homo sapiens
catggtatagtgaagatagcaggtttggtgtctgagaaactgggtgctggcttcatcagtagtgagcttcataatcctcagaccaatcacctcatctcggatccccagttttcccatttttgaaaaatggcaccaatgtcacctacattgtaacgtcgttggaaaaataaatgattaacatctttaaaagtgccaagttcattgttaagaaccatgcaaaggttgactgttgttgttttcatgattattaatccttggagagaagacttgggttaacacagccttctgattttaagaactggtgtgtaggaaacaaggtagagagaggcatgtaccaccctgccaactctgggttctgtgccagttcagcagtgacagggtgtcaatgaggagctattaaacagactgcccttttcttcactgaggcgcttaactaaggcacatctctggcagcaagagttgtgtcgaggaggccaagttttcatggcagctcagctgtcttctagctctgtgggtaagttggttcctttctctgtctcatttctactttaaaatggaaatgatgatgatgatgatgctaacctacccatctctttcaacaaaattggttacagggcaaaatgaagtaatggaaggtaagcactttaagatcatctaggagtcatacagctggaaggtgcagttaccttgaatgaacaatgagaaataaaaacaggatgaaaagcccctgtctatgcaaatttagaatcccaaaaggctatcataaaggcagttatattgctgacttgttttaaattaagtctttctcttagtttttttgttagtttttgttgttttgagcagaatgaaaacaaaggtggtagaaagaacctctgatttattctacgaagtcatatgttttatggaaccaacaaaagcatgtcaagtatttaatgctattagatgcttactaaaaaaggtgcctattcaactacaaagaacatggtttaagtcaaacattttgtattcatgaggacagcaaatgtgtgtggtgttaaagtgatttagttcaattgactgttggctggatgactgagcaagaatattgaggcatttaacaacgttgatggtattcaggacaaa

SEQ ID NO: 106492 - DNA, 1055 bp, Homo sapiens
aatattttctcattctgtgcattgtcttttcactttcttaatgtgagttctctaaatttgttcctttttcaagattgttttggctattctttcaacaattgtttctgaattgtactactgtactgcttttgttaaatttattcctaagtattttattccatttgatcctaatgtaaatgaaattgtttacttagttttatttttggattgctcattgctagtttatataaatacatttgtaggttgtatcctacaaccttgctgaatccgtcttttctagtagttttttcttgattccttgaatttctgtatacatgatgtcctctataaacaaaggtagttttatttctaaataaaatgttacaaaaactccaagttacttttgaataggattgtttgttctacttttctgagaaaatgaactggttaaaaaagccagggggagaacaaggaagaaagtcaaacctctccctagtctttggattgactttggcagtatttgttggccagctcaatcaaggctcaccactgctgtgactatgaggatttctctatccagatacacctcctttctaaccagagaaatcaggcaaggatatgtatacatctgtgccttatatatacatacatacatacacacacacacacacacacacacacacgtatacatctgtgccttatatacacacacacacacacacacacacacacaccattctctccaccagagcatcctttacttctctaatgtcaaacatcacttactgccttgctaaaagtattgtggcaaaaaaaggaggagaaaatcaaagcaactaatgtgtgatgtgcccaaaggtcatggtgttttgctagaaaaccatcatctctggttaaatgtgaattgcactttcacaacttcatttgtgattttactttcacaatttcaaattagatgtaattttatttttaaacattcagggagttaggttttggtgttctcttggccactcagattctgggcacattgcctgccttcatctaccctctatattaatgccttttcatagcaaaga

SEQ ID NO: 106493 - DNA, 1283 bp, Homo sapiens
cagattcctgtaatgagattactcttaacaaaagctctggtttcctcaattccttaggttctgttagggtagcagggaatccaagtgaattagcaatggaattgcctgaaaatattaatagatgttttggacttgacagatcagtcacccttttatatttgtattaatggggagggaacaggggcatagggcataatcaaagccctttgaacttggctttaaaatacagaacaagcaaatacctttgaacttggctttaaaatacagaggactacaatttgtaatagttttacatgagtttgcatcctgagagcaggagatgtaggagtggctctgtattttgggatgggtttgaatgctctatttagttgttctgccaaaagttttctcagactaccttgggagatgtcatgttacctgattgccttgtgttgtgctttagaatggtgctagtttctgaattatccattttatttctgtttttttttcttatcttctatagatgatcacagtagggtgaagttaagacctttaccaggaaaagactctaagcacagcgactacattaatgcaaactatgttgatgtaagtcagaactgttattataaacctgtttctagaaattgaagactgcagcagaaactgtttaatatattttaatactgtacagagctttcactaaaaacaaagcccattcaatatggaaggcatttgaattattgactggtcttctgtgataactgctttcatctcactttgtgctgtgtcattttgaagggttacaacaaagcaaaagcctacattgccacccaaggacctttgaagtctacatttgaagatttctggaggatgatttgggaacaaaacactggaatcattgtgatgattacgaaccttgtggaaaaaggaagagtaagagccttttgactcactatcttaataatgcaccttcattcaaaagatacttgtggagtacctgctttagggtaggaacttgacaaggtataaagagttacggaaatgaaaagtgttctctctgctttatcttgcttatgattcagaaggaaagagagctaaggcattatgagagtaaatgtgatgacagagatgaacagggtatcagtggaatgctgcaaaatgaatcaatgtatcctctgtacattcctctgtacagagattttttaaaggagcaaatacttgagacttgaacaatgattacgaggaattacacaggctaaaaagagaaggaaagggtgttctaagtacaggggacagacaacagt

SEQ ID NO: 106494 - DNA, 1297 bp, Homo sapiens
gactctaaagacagaagtatttgacatttaaaatcttcccatcacttcctggatagtttacagcagcaacaagcactctggctcctaaaggtccagcctggacagtggagaaggaatgggaatcacagcccacagagacatgaaagcaaagtactaagatctggacttggggcagaaagtcaggaaatggaggccttgcaggaaaagtacaagtgctttggatagttccaaatccaaaaaaaactgatactaaatgttcattcttagtacaatcttaaacagtcttctcttctaagtgatagtgacacttcatatccagcttggtaatgtctccaatttaatggcatgaaagttggctacaagggggaataacctagcctgggaacagtgattagggtgaatgtgatcagtggtcatgtgtcctgacacccttacattatttttttccagaatgtccacccccccgcttaaagacatcttttttcacttttctcacagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcaggtagggtctaggattcaacatgtgaaatagatggggcaggggacttaggcctcagtgaccttggaccacaatgattgctactgctttcacttagaagctgaatcttccactggaaactgggatggataagacctatgatagtcttaaagaggctctattcctgtaacattaagaaatcatctgctgcttctgtgatttttaaaaaactagatcaatccctagtttttataaaatcttcttattaataatatcagccaggcatggaggccaactcctgtaatcccagcactttgggaggctgaggtgggtggatcacttgagcccaggagtttgagaccagcctgggcaacaaagtgacaccccatttctacaaaaattaaaaataaaaaaattagccagcatggtggcacatgcctgtggtcccagctacatgggaggctgagacagaaggatcccttgaacccagtaggtcaaggctgcagtgggctgtgttcacataactgcactccagcctgggtgatgatagagcaagatcatgactcaaaaaaaaaaagaaaaaattacaaaatccccattgtttataggaaaattgtagcctgatcctaataaataaaaatatgacgtta

SEQ ID NO: 106495 - DNA, 1094 bp, Homo sapiens
gaaagagatacagttgtttcaagagctgtgttagatggtagggggagttaaacatgttgtctggcctgagaaatacataggagaggatggttctaaaacccttcattgaacacgattttttgtttgcttattgagttgaagcaataagcacagtatagaataccgtgatccaggcacagtatagaatacagagctaaacttaacacagtctctaccgtaaaataagttaagactgataaagtgagtattggagcaaatcacctagctgtaagtgcttgaaggaaatcactgggaggtccctgttagcagcagaattaaactaaggtacacttcatgaatgagtggctaacccttaacactccctcagtgactaccatgtattgtacctcttaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaaggtagtgctttgaaaaagtttctttggcataaagcaagaaaatgttttaaatgccttgagtttgggggttatgtcttctttgcattaatgtatacaccgaaatggattactatttgtactccttgtactccttaaatgtgatgaaaaagaaaatacggttttgacctatgtatgaattgttggtattcaagtagatatacagtgttgtattttcttctgagcaatttatgactttatctgaatataaacatcagcccctggccataatgacatagtactttaaagtaactcgtttagtccaaaaaatgtcctattttttctgaactaatctatcttaccttaattattaagaatgatgacttgtagacatattgtcctaaaaatatgcctatttcaaaaactatttcagaagataatttaggaatttaaaaagaattactaaacaatactagagaaaagttaacttttcctaaatggttgttctttttctttgatagggacatgaagaagcttaaaagcggttaaggtttatatggaattgactgaagtgaaggt

SEQ ID NO: 106496 - DNA, 2681 bp, Homo sapiens
atgagttcttacaaaatattaagtaccaacatttcttaaattctgcctttttcgtttcttcaatttttttttatacatactttaaaacttcatttaagaaatgcgaccaggtagttggttcttttacaggcactaaccattttagagctcaagatgaagaaaaaaacaagaatcaaacttgaaaatgaaaattatatccagggaccatgagttttactaaagcatctggagaagaacactgatctcatatactccattaggatggatgccagcccccaaaaaataggattgacaaaatggttcaaccaagctacataaacaggaataataatcaaactactgggctggttacttataaaagccttagaacaatgttagttcagttcaacagaaatgtactgagaactagttaagtactcctttatcttcaagaaacttgattagctcgtaatcaatagcattaagcaatcttttttaatgtagactcacgtaggtcttttatgccagtgaggatcacagaaaaaaattcacagcagcagtgacatcacataacagaagaatccacatagttctagaaatatctattgcacacagtacctatttctacctgatagtagaaataagaaagatacaatcaaggtcactgagagaagtaccactaggaaagcacaagagtgttctctggggctgggcatggtagattacacctgtaatcccagagcagcctgggaaacacaggaagaccccaattctataaacaattttaaaaattagctggttgtgctgatgcacctgtggtcctaactactcaggaggctgaggtgggaggatcacagttaactgagctacaatcatgccactgcactccagcctgggcaagagagcaagaccctgtgtcttaaaaggttctttgtggcacagaaatggtcttgtttatcagtaatctgattgggatttttgccaaagcatcaagcaaatgctatcaattatatctttgaatgaagactaaaatgttttttctttttcagctggtcacacagtgtaatgcaaaatatgtggaatgtttcagtgctcagaaagagtgtaacaaagaaaagaacagaaactcttcagttgtgccatgtaagactttaaaacagtttgttagtgatcttttatactggattgtatgttaggtacagaggcagccactactctgatgctattgatagcacccttcaattgtactgtacgtggccgtatggtagaaggttttgaaaatgtccttttagtaacctcattaatgtatgactttataccagcctcttacctggtactaccaaaagggaaaatgttatgcttattcaactaaggtagtttaatgaaactgggagaggtggttgtcagtgtcagcaagtgctccatctatctgacgtagaatacagcttcatttcaccttggaatgcaagaattgggttacttctaccatattataacataaaaaataataataaagctgttattgctgtggcattaacattcctctaaaacttagaatcctggattaatctgtacaactagaactaccttattcagttactgtggctattgagatcaaggcactgttgattggtggtgacctttgtataaatagctaaggacattgcagaggatgctgtctgtgtgctgtaggcatagacatgggtgatcatttgggagatttatctctaatgaaaaaggccactcttttctaagaccatcatgagcagaaagacatggagaaaggggttggtaaaaggacaaagtatatgttggtataattgtaggaataacaaactagagtcaaaagttatctaaaatcctctgttgtgtccatataaagtattctgttattgatctgctgtaaaaatctctcccacagtaaaactgtattcctacaatgcctgtgtccttctgggtatgtgcagcaaaatttcattttacattctgcctcagctgataacactttagcttgtttaaaaatatagataagtcttagaaagggaagccaggaggatatgttattcatcaagcaaatctcagaaagagctgttggttctgtgtgtataataaggcaaatgtggtgtttttgttttttccatatgatagctgagcgtgctcgagtgggtcttgcaccattgcctggaatgaaaggaacagattacattaatgcttcttatatcatggtgagagtcaacagttaattataaataaagtcaactaaactgaaaggtgttaaagagcagataccacctgtgtgactgatgtcatttttgaaataatttctcaatgtgtaatatgaaaagtatagagatttctgtatcttgaaacttttaacaaaagatacctaatcagtgctggtacaaaaatgcttaaattaagcagaatgcttcttaaggaattaattttattgttaatttcacacatctagtctttgaataaatgttgaaatttcccttaagtgaaaacagcagggttaactagaagtgaactgcacatggagagaaaattgtctgcacagtgctagcagaagtacatctaaaaattagccaaatgtaccgaatgcctttctcaattattttagtgtagtcaaaacagtgctatcttatttcatgaatatattttactaccacaaagttagaataaaacactcatattcactg

SEQ ID NO: 106497 - DNA, 1055 bp, Homo sapiens
actagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcacagtagctatgtggacaatgtgttatttccattttgactctctaaaatagctacatcctaaaatcagggctatctttaacaatagcaagatagcaatattatatacaactcagttatgagaccctttagttattctccattaatgcttcttagtttgtaataccatacctcacagtaggtagaagaatgaaaacttctgcaggtgtgtaattttgaaactagtcctctaaaaattccctattactcctatagcaatctaataaaaactacctacatagttactgttttctttccttctttgccaaatgttttataataaatctcttaattacatacatttttctacttaagattaaattggaaatactgtcttagcaaaagtcttgggactatctaaactcccacacatagataaatctgatttggagagagaaatttaaaatatttaattaaaggtgatacccacattttcaagtttttaaaagagggagatggctttgtatgcttttgtgtagtttagaacagatacacattagtaaaagataccaataatcattagagctcaaggaagttattaggtgcagcctctggagccatactcacgctgcagtgcataatgggaaaattaggagcattaataagaaatttcagtagtgtttgtaaggaaaataagctacttactgagatctgtttcttctattgcatgtttgcttttgagggacagcttctgtcaa

SEQ ID NO: 106498 - DNA, 1064 bp, Homo sapiens
ttgtcatttaacatacaatactggctttacttatctctagaaagaagaaggcatgctacaaataggaaggaattgtaataatgatatttggcctctactttgtcttagctgttaaactgtttttagtatttttgttaaatatttgcaaagggaagcattttctacagaggataattaatttcaagaaaaatatcttgagttttaagaaataaacatctccagaaaaggagaaagtcgattttataaaatgtcgcaactctccaacatttggggtagtgactccttttttgttaggacatttgaaactagcaagcagccattgtttctaaagaattctggcttcacattgactcatgtttctttcactccattttgaaatagctaaaaatcattaaaactgtaaatattttgttgcttgggtaagcatcttctgggaactttgtatctatggtatataatcatagaattttatattttcatataaagctaatttttttctagtttcaactccgtcatagttttttttcctttttgtggtggatatgtgaattcaactttctgtgtattgaagtagcaaaaaccatctttacattccaaaagaatccaacatgtgttatttctttgaggcagtgattgtgaaagttgggttttctttttaattccattgaccatttgtgcaataggaattagacataattagtcactgaaaacattcgtcacattgacccatttggaaaaagtgtgctttttttttttttttaaatttgttcagggggaggggttttgtaacctgaaatttttccctttttcttctgtttaaactatatcaaatcattctattatagtgttatttaatatgtaaattgtattgctatacataaaataaagtatggtttttgatgtattcagtagtgttgagcatttctatgaaaatgtctatatccaataaaataggttactagtctcccttaacagatcacattaatacccaccaaccctctggtctaagttttcatggtagtaaaatgaacattggtagtcgtctttacacaggcagcaaacca

SEQ ID NO: 106499 - DNA, 1218 bp, Homo sapiens
tgatacactagagaaaatagtaattctgttcacaacttagcagcagagtcataaactgaataaagtttgattccttagatgagcaggtaaaactgtcattgtttactctttaaaggagaaagaacgttgataaatcaacccagcaaagaccattctttttggtttgctgcctgtgtaaagacgactaccaatgttcattttactaccatgaaaacttagaccagagggttggtgggtattaatgtgatctgttaagggagactagtaacctattttattggatatagacattttcatagaaatgctcaacactactgaatacatcaaaaaccatactttattttatgtatagcaatacaatttacatattaaataacactataatagaatgatttgatatagtttaaacagaagaaaaagggaaaaatttcaggttacaaaacccctccccctgaacaaatttaaaaaaaaaaaaaaagcacactttttccaaatgggtcaatgtgacgaatgttttcagtgactaattatgtctaattcctattgcacaaatggtcaatggaattaaaaagaaaacccaactttcacaatcactgcctcaaagaaataacacatgttggattcttttggaatgtaaagatggtttttgctacttcaatacacagaaagttgaattcacatatccaccacaaaaaggaaaaaaaactatgacggagttgaaactagaaaaaaattagctttatatgaaaatataaaattctatgattatataccatagatacaaagttcccagaagatgcttacccaagcaacaaaatatttacagttttaatgatttttagctatttcaaaatggagtgaaagaaacatgagtcaatgtgaagccagaattctttagaaacaatggctgcttgctagtttcaaatgtcctaacaaaaaaggagtcactaccccaaatgttggagagttgcgacattttataaaatcgactttctccttttctggagatgtttatttcttaaaactcaagatatttttcttgaaattaattatcctctgtagaaaatgcttccctttgcaaatatttaacaaaaatactaaaaacagtttaacagctaagacaaagtagaggccaaatatcattattacaattccttcctatttgtagcatgccttcttctttctagagataagtaaagccagtattgtatgttaaat

SEQ ID NO: 106500 - DNA, 1104 bp, Homo sapiens
ttaaatgttctagtggcaagtctataagacaaagaaacaaagtatagtcaagtaagcattgcctcccttttcgcccccctttttcctttgcctctgcctgccttggatacctttttttaaaaaaagttttggtttataatcaggaaactttgacatcttatttatgcatttaatgaatatttaatgcctagtacatgccctgcactttgttagatactcagatgcataaaggttgtatgggacgcagtccttaccttctggtagtatataatcaaaggaaaggttcttatatggaagtattagggtataactggctacagaaggctaggatcaaattgcgaagttttttttttttttttttcagtcaggctaaggaattcacacttcgtcctctatgtagtgggtactgatgattttttaagtctagggaaagacatattcaaagtagttctttagaaaaatgaattgatcccctcttaggtatagttggaagtaaaacaagacatactctaggcatgcatcatagagtaagtactcctcaagtatttgttgaatgaataagtgtaataataaggccatagcattgggaatgaaatggaaaggctaggagagatatcctgaaagaacaatttataaacctttgaaaatttaaatggcaggtataagaagagttaaagatagagtatagagcataggtatctgagggaagagaattcccactattgttcattcattatatccagtaggaataagatgagcttagtttcatttggttgagaagtaagggctaggaagaaaggttagccatgcctctacagtaaaagttattaaagctagatagaccacagtcttgagagagataaggtaaaaataagaggacagctgccacagatcttaagaaagctcacacttaggaacaaggagagaaaaattagcgagctaaagaggaagaaaggtagtaatcagaggtgagcatgtcatctaagaaagcaaatatctcttaagctaaggaagaagtttttcagagggctgatcatttatagtcagaatgctgcagaggtaacagtcaagtgtctaaccataggcctgctttaccaggccaca

SEQ ID NO: 106501 - DNA, 1512 bp, Homo sapiens
aggatgacctttactttatgtatgtcaggctgtttctcagaccacatgcatggatatatagacatatagaatccctcaccattttcaactttcagaactgctgtatttaatgcttggagtgaatatttttgtgtttctagtgctatctcattggctgaatttccaaaaatgagattgatagtgatgatctaatatcagttgccctcctatgacacagggctttgggcagtttagttctctttgacctccctagggcagtcacccaagaaaccaaagctagacacaacacagcaatgtttcatgagcttctaaagcctatagacttctacagtcagaccaataatacagcatctcaacttccaagctatttgtattaaaaatggttaaattatattgacattttgtcatcacaaaaatggggaaaaattatagtggatatatatttcctacacaattaagggtccaatatctctaattcctgtactataacacactagttgtatttcagttcctgatctcatcccaggtcaaatcttttgatgttaatcctgaagcatgatttatgtttgataatttcattgtaataatttcagtatggggtaatcatttggtatgggatttggaatattaaacaaaaacatttaatgattatatcaccataaatgatactattagcaataatcatgaagttggccacaagagggcgtgtaaaatcacaataaaattctaaaacctgtaattctgccaggctctggttttactgagaaatttgaaaattaacactagtaagtagccagatttttttctaaaattaacataaaatattctgtagaggaaatgcattctacatatatgtgtgtgtgtgtgtgtgtgtatacacgcatacacactcttaagtgaataaacatttagactattatgaagagccaagttcaattgcttgatatgcttttttacttttggatttttttttccagactcgttactgggcatcagtagaagaatatattcccaaatgggaacagtttcttttaggaagagcaccatatccttttgctgttgaaaatcaaaatgaagcagaaaataccattcaaaatgaggcacagcgataacttcttcacatgctatttcaaaaagcctgtttaataaagctgaatgttaaggtgtatgtaggttattgcaggaactttaggaattaaatatgttcatattcttcgattatctcctaagtgacagtgaagatatgagaatttactggcaagtcacatgttatcacctactactatttcaaggtcatgaatttgctttctaccaaacccatagatgtgttaaacacgaatattaaaaggtggactctttattaattaaattattgtcagtgttgtgagtgtgttgctttaaaaaaaaaaaaatttacaatcattctcctctaagcaggtatcttggttctggttttaagttaagttttttagaatccttactttttagggacaaggtataggatcaacatgg

SEQ ID NO: 106502 - DNA, 1100 bp, Homo sapiens
atacaccaggtcctcaaagtgccctgacatgctgccattagcaacaccaataacctgagaaatggtgctgtttttgcaattaggtgattgcttgctcatctcacagactttttctttattgacttccttacatgtttgtcaatttcagaaactcctgtaactagaaaaaagcttccttttaccacattctccctttttaaattgaaccagaaatgaagttcaactgaacaaatatttattacttagacccagagtggactagaaattacaagtggagataaacaatatgcctacctcagagctttttgtctctggggagtcagctggataaacagaaaaagtagagtgttatagaaagaccaaggtagggcttctaacacggcctggggagtggagaggaacggggtggtgaggtaagggagctgggagtgaaaagagaagaaacctgtgctacagaaactagccaagagacttccagtatcaacatggcgggtaagcaatactaacatatccccctctgcaacctttatacatgagggacatgttcactttcttgcctctgattttctccccaactctttccactgacactactctagtttgaggtctttagcacctttgatcttactaaatccaatgtttgtcttaagcactcactcatctttctaaatcccttggcagcatttgacacaatttatcacactttttttttttttttttttttgaggcagagtttctctctgttgcccaggcttgagtgcagtggtgcaatcatagctcactgcagcctcaaattttcaggctcaaattgcctcagcctcccaagtagctggaaccacagttgtgtgccaccatacctggctaatttttgttgttgttgttgttgagatgggttctccctgtattgcctaggctggtctggaaatcctgggctcaagtgatcctcctgccttagcctcccaaagtattgggattacaggtgtgagccatctcacccagcacttcctccttcttgaaacgattcttttatgttctccagcactgacaactcctcagtctactggctcctttccctattccctgtctcctaaatattggaa

SEQ ID NO: 106503 - DNA, 1018 bp, Homo sapiens
gggatgggggtgagggtcttgcaagtcacagtaagccttttactctgagtggtaaatggtaaagcattggagtgttttgaatggaagagtgacacgatccaatatttctcaacaaagattgactgcacatctactgtgattcaagtactgtgctgagccacatacttaggtgctaagagtacactaataatcatgacagacacaatcctggtcctcgttgacgttatatcctagtgggaaagaaagaaaaaaaaacaagtaaaacaacccacaaaaaaagaatttctactgtgataaggctacaaaaaacaaaaacaaaaactcaggcacttgaataatgagagatggggtgagaggagtgtatggggaagtttactttgtgtaggagcatcaaataaaacttccctgaggaggtgacatttgaggcgagtcttaagagatgcagaggagctagctctagctaaatataaagttggggagaagtatatcaaagggacggaactgcatgttcaagggccccaggaaacaaaaggatgtggcttgttacaaggagagaaagaaaccagtacagctggtccacaaaacatgcagagagagagaggaagataggatgagactgtagctataagctggagctcgaccaggatagtaaagggacctgaatatgaaactgatgacctaaggtagacaaaatgtcagacatcataagagaactatagattttaaaaaacagtaagttttgaagaaaaacagctggcatggggcatttggaagggagtagtgttgaactatttgttgtggatgcattgaatctggccatgttcagaagggaagacgacattatgagaagacaacatcatgggggtgggtcggagttgtcttcaaatgcctactcagccagtaacagctgtggctaaactgacactttgagagcctctgttttcccccacctgaaatgatgacatgtgccttgcaggtgtgggagaattagaaataatgttcataaaactcctcatgt

SEQ ID NO: 106504 - DNA, 1048 bp, Homo sapiens
gaagtgtgtcgcttgagtttttgctgttgtcttgctgtggacttggtcaatttatttacaattgtcgtgtgcttctgccacatctgcattgtcactgtgatggtattttttctttctgtctgtttcttccacaggagtttaaccagtaacctacccaatgtgaacctacccaatgtgaaccttcccaaagtaccaaatctaccagttaacatccctctaggcatcccacaaatgcctactttttcggcaccgtcatggatggctgctatatatgatgcggagtgtgtattcagttcacattagatctcatttaaatttaagtgatcttggcatggatatgtattgtttatttctatacatcctatataacagagatggagatggataattagacatattttgctgatcatacagagacaatattgtttatttctggcatgcatcatgtttgtaagatgtttgctatatatacagcactaacaatttgtcttacgcccactgaatgctggaggactatgtttcacttcctgaattcttttgcaaaaggattctaccctttttggcaggtgacatgactttaggagctagacatccaaaaatagtggaggaaacctctttggtgggctggccagtcatctctggcctgatccaaatctaagaaggaagcacacctacctagaatctggggtgttttctttaaataaaaataaaaaattcctagagaatgtttaaaccataaagcatatttctggtgtcagcaaatggcaggatatagtaacagtatgttcagggctaaatgaaaatttctgaatggatcaagccttagtcacataaatgttatgtaaaaaaatatattatgtactttccaaggtcacagtacaatatggtgctttgagagctaggtaatgagaagttcaataattctcgaaacacaagattcaaacaataaataattaaatttgtggtagccatatcatctgaatatagggctatgctttatactcatccacatgaatgtcagagttgcatgggccacttcttgaaagcc

SEQ ID NO: 106505 - DNA, 1085 bp, Homo sapiens
gatcagaaggtcaagagattgagattagcctggccaacatggtgaaaccccatctgtactaaaaatacaaaaattagctgggcatggtggcacgtgcctgtagtcccagctactcaggaggctgaggcaggagaatggcttgaacctgggaggcagaggtcacagtgagccaagatcgcaccactgcactccagcctggtgacagagcaagactctgactcgaaaagacagaaaaaaaaaaaaaaccaaaaaaaagaggaagaaagagtaagtaggaattgtctagtaaagaggagaaagggaagattggtccaaacaaagggaatggtatatgcaaatgccttgaagctgaaaagtgccagctgcattcaaggaactcaactgttcaggctttcacccttcagatagtattgttattaatgccaggcctaaactaggtgctagagacaaaataaggacctgcaacttcttccttgtccttaccgagctcatatttcagtaagagaggttaaaaacacataaccagcctaagaaataataattccacttcatacagtaggctctgaaggataaaatataggactgagggagaaaaccccagagtattggatataatattgaaaatgagagggagagtcatgtaccatgaatctggaggggtaggcaattccagatcaaggagggtgttgtgaatgtctgtttctctatttgtggaatatttcagaaaagtgctatctcccttactgaaaattcacagtagctatcctgctgtgatcatctcggcaccttgtatggtatacacctgtacattttcagattgagcccagtgtaccaaattctagaccattcccctaacccaacacaggattatacccctggggttgaaattatggcttgttcaggatcattgggcttttatgaaaactcactgctcccatttgcattgcatctttttatggcttctttaatttcaatttatttgtatcgtgtgtgcatgtgtgtgtgtgtgtgcacacatgcatatgtgtgaggtccccaactatcctcagttcaatgatgcactagaaagactcaaagatatcaga

SEQ ID NO: 106506 - DNA, 1048 bp, Homo sapiens
tatttgcctaaagcaccacgtagatgggtaaaagatggcaattgaagtgtgaaacattctgattccaaatcctatctttttaatatgagatactggctagaaatagtctaggataaaaagagccctagaatcctaacaacatgtcaggtgtacttctttacccagagttatttctctctgaattgagagaggtcctcctttcttcccctgtacacccatcaaatatagtcactatgggcaaagtggatgcttaagtataacttcttaaagaatatgaaggagagggatgggcttttagtgggtaaatttaacactagactgtatcaactttactatgtcgtttaaactgaaaggaaaaagattttagctcggaagaacacttccgaaggaacagaaggagacagtaccatcatttggataattttggtaattactttggtttcacttttactgagaaaaagagcattccaacaatcttcctaattaaagaggggactttaaacagactatctgaaaaaacattttattatttaccgatatattatgttacattactgtgaattgaaatataacatggcgaaataatttatgaccaaaacaaaaatctccccaccagaatgtaacaatgtatgtttcagtagctcagaaatgacagtttggaaagcagttctttgctttttcttcttcttttgtcagaatggtaaagtgaatacctagaagttggcatggcaaagctataccatatgtttctaaactatgtagtaacggtgatgggtggctaccttgtgtgaactagctacttatagtgagggaatgtaaaagcaggcactgttagcaattcatgtaatatttagattgacatgaccattttttaaatgatgtaggaattattctaatagtttaaaatgagcattgtgtctacatacataggtatagtgtacatgtgtgtctgtgcatgatgggggaaaagggtaatccttaaaactgtctattacacagcaattcctatttcattcaagaggacaaatgtcttgtaagttcaagctac

SEQ ID NO: 106507 - DNA, 1059 bp, Homo sapiens
acatatttagatatgtatctattttcttattcatttattgagacagggtcttgccctgtcacccgggctgcagtgaaatggtataatcatggttcactgcggcctcaaactcctgagctcaagcagttctcctgcctcagcctccagagtaggtgggactatagatgtgcagcaccatacctggctaattttttctgtttttagtaaagacagggtttcactctattgtccaggatggtctagaactcctgggctcaagtgatcctcctgccttggcatccccaagtgctaggattataggtatgagccaccatgcctggcctacatttattttcactatttcctgattataatttcttaaaatgaagttgatgcatcaatgggaagtcagcataacgaggcttagtcctttaaaaaggtaaaatagaaagaacagaatcattttatggccaccatatcttttgaaaacattcctattccttctggtagatacttgcagaacaagctgaagaaagctatattcagttttttagtggaacattgtaaagccacaccttgtaaaaaattaaaaagcctgatattgagatccaagtacttcttctgcagtgtgcaactagaccaggaaggcagggaccagttctagttcccccacttatgtccacagaaattagaaaattacctgacatatagcaataagtttgaaaatatttaatgaatgattgtgtgaatgaataaacttttattaactcattggggtaatagaactctcagaccctaacagttcgtttgtacatttcagaaactgtgattcctaatttgtttagtgactttattcatggaaacggcaccactttgaggggcagatacaaattttaatcttagttttgtgatttactatgtggccttcatgttctgagttatctgtgaaatgaagttacactactcagtttttcagaaacactgccatctcaaataaattatcatcgaaaacttgttctctttcctctgcctttgattatgtcaatctattaatttttgaaagccagaagccttaacagt

SEQ ID NO: 106508 - DNA, 1139 bp, Homo sapiens
tttcattcaaattcaacttcaaaattaatttaaaataattttaaaataactctaaaactatgtcgagccttgtagttctaccagaataaatatgcttcttgggtatatccatactgacagctgcatttcttcaagaaatgacatgacagaagagtgtcctcctaaaattcaaacttggaagaccaaccggtctcaagctacttgtttgaaaggatgagttatataaaatggcatgttctttatctttaaaaaaaaaaaaaagtattacaaagccccaaggagacaataaaatgtaaaaggatctgttaccttgattttatttactgctttttttttttttgaaagccaacactgagctatatattgatatacaagacaaaccatttcttggcatatttcaacttgtctgaaagtcagttactttggttacagctcaaaggacaagttctcagtaaagaataaataatgtattcacattaatcatttccccagtgtataaagtatgtatcaactaggatgagagagagactgaccttgggaagaaaagtacatacttagaacaagggtctcagcagatttctgtcctttgatgagctcaggatagctcaggtaagccacatggaaccactgctcagaaatccataggacagggccctcacgccccagctcagccactggttgtctctgaggagacagaagcttcgtatttaacccttcttggcctttggtctccctccacaatggaggagtgggtggaaataaggcagtggttctccaaactggtagattctgattaatcccctagaggggagctcagagcatacagagattcttgggctcaaacccagatctactggatcagaacctctggatatgtggcttgagaacctgcatattaaacaagttcattagctctttctcatacagttctctgagttctcaccacatactcttgtttaataaccaccagagtgatgatttctgatttccaaggtccaagccaagtgtactgtggcagaataatgattccttcagtgcctctcaactccagaaatggaaactgaataagtcagtaattacctctaagcactagttttttttaaaatgtattttctgtctgctcatttaatttccttatc

SEQ ID NO: 106509 - DNA, 1079 bp, Homo sapiens
aatgaatgaatgagtgaacattgccatcaaagaatcttaaaccattagcagatctgtctaaaggtttggaatcatgacagcttggtggttaagaacttggactcaatattcaggttgcctgggtttgaatcctgatgccatcatgaattatctgtgaaatctcagacaagctattcaaccattctctatgttagtttgacatctgcaaataggatgatgtaccattccttacagggatgttgtaggaacaattaggtgtgggttataaagtccttagcatcattcctgggatatagtaagcatttaataaatattactattattatttattttatagaaagataaatataatatcataaggctttcttttatttgtttttctaaatgttttccttgtttccagtgctatgggatcttaaaattttccaaaaggcaaaccaaatagttatataaacaaatcaacttgtttctagaactcacattttcttttaccattttctattctgatttgtttctgtaggacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtaagtatttttcatctatgctttactgttcatatctttgtttgccagtcaaaataataagaaaaacatctcagaagtcatcttgaaaattgttgcctacaaaactaggccaatcaaaaggtgagatacttcacctcaggtacaggatgatcacttggccctcaggtttcttattgtcagaatccatcatttgtaatgttgccgattaaggagtttttcttaagaaccccgcaggtattggcagctgctgcttaggtgacagtccagttgaaactctaagccagaagcaaatataaaatctgaactttggccggacgcaatggctcacgcctataatcccagcaatttaggaggccaaggtgggagg

SEQ ID NO: 106510 - DNA, 1093 bp, Homo sapiens
tgcactcctgcctgggtgatggagtgagaccctgtctcaaaataataataacaataataataataatagtaatttgagcctatttgttatgcagccaatagatcatacccatttctcttctaagagattatctgggggtattgcacactggaattacagaaagtgattttaaaaatatgggctgtagaatcatcaggtaccagtttaaatcctgattctaccactattagctctggacagtgagcaagttacttaataccactagacctaatttccttatctataaaatgaggactgtaatagtggatatataataagcctgttgagaagattcaatgagataattcaattaaataatagctaatttttacttagtatttacttacataccaggcactattctaagtgctttatacattttagctcattcactcctcacaactttgtatggtagatattattcctagtttgcagataaataatatgagggctggagcggttgaagaatcttccaatgagttgcacaaataaatgatagacctgagacttgaaacctaggaagtctggtttcagagtctgggctgtgaaccgttatctgatgctaatcttagcatgatgcctagtagaaaatattcatgcagtgcatgtaagctaatcattattattataaagttactgttaacttatgttatttgactcaaggcaaatggtttaaagtgatagaggactttctctgaatttgttttccgttatgttgagttgaaggtcttcaaacatatttcattatccaaaagaatagaggctgatcctttgagaaactgtgatactatttggtaggcaaagacatgttaagttttttttaaagcagtgtatctgcatgatgagaatgagccttataaaatgttattggcagcattctataaagttggaagagtgattgccattgatgaagagcacccaccaaattgtgtgacatacgaaatagccaatggagacacccaggttatacaaagattctggattcatcctctctctggaatgatcgaacttaccacacagccagactgtgagtctgtgaagcaatataacctca

SEQ ID NO: 106511 - DNA, 1151 bp, Homo sapiens
tctgtaaaataaagattgcaataattattttatgaattaagaggaggattagcacaccattgcaaataataatcactatcatttattgagtgcttacaatgtagaatgtgccagaacttttcccgttcttttcttttcttttttttttaaaacaaacaaacaaacaaactctcttcatcttccccagcagagtacataaaccgagtaaatttagtacataaacagagtacataaactgagtaaatttaggtgagagttgttctttgagatgatgtcttatctcaaatgagatgtctcatctcaaatgatgtccatcagaggagataaatcttcacaatcagtggaaatttgctttaaaggaggaaattgggaaggtaaaactactcagaaaatgaactatcctagtaatatcaaaggtttagcctatagactttgaggacattttaaaaaatccattaatgtggaagtctttttcatgctgtgtggattagcacagaaaatttgagtgtatttgagaactacatgagtttttctccccccaaattatggaaatttataatatttatagtaaattttttctaaaggtaagtgataaattcacaaacacttctagagggggttagcaataggcaaaaatatttctttatcagaaattatttagaagagaatacatgataattaaatcacactgggttgcaagtcacaaagcaaaatatattttatttccaatagtttttgatgaggtatttggcagaattgcagaatttcataattactctattttaaacttcagctaaagatgctcagtatagcttttagtttttattgaaaggttaattttacacttacagaagaataagcttcctattatacttattcaggtgttaaatgtgaaaatgacaccatctttgcccaggactgtctaatagagatggcagttttaccagtaatctattttatgtggtcttgtatcagttgtgacgctattctcttagtacgaattatttcatgcgagcaataggttggactctatattctggatttgccacagtaaaacacattctttttcatgagtatggtttctctgtttttggtattatgaggtgtgttcattgcctgcttaataacacattattaggcagggcatggtg

SEQ ID NO: 106512 - DNA, 1010 bp, Homo sapiens
gcagaaggaaacacctaccacatttcaaatgaatggccagtggaaaaaagcatatacatttacaaaatgcaagcaaataagagagcattatggaatcccagacactcaagaacaaggcacttttcgttggtaacaccttcagtgtatcattttgatggctccccgaagacttccttaacatttgatgacgtaggatttttgtaataaaaaattacacaatactaattttattccatttatcttcccccttgcctctaaattagatctaaatgcaaagaaggtagaaacgatgtgctcattgtccacgcaattcaatcctgtgaatgtctggggtcatgattttaggtccagagtcaagatcttagtcagggttctttttcagccatttattacatattaagtaggacacatttgttagtatagatcaaggaacgttaaatttagaagagacagcagaggtcctacttgtatcttctgtcatctaagagaggaacacatcctttcttcagcatctctttcaggtttgacttgaatacttcaagggatggatggaaccagttgtgtgctagagttgaatcatactggcttgcaagatccaattgttaaatctgcaggaatttgataacctgattattaataatattcttaaaaataaattaataaacttagttataaaagttatgttaaaagttagtaaatgctaaaaactcagtacttcttaattatgttactacattttactattatatttgccttgaggttattcacatctgttgggactgaatggtgaaattccataaatagaatggtgaaattccatagatagaatggcatgctactgcatttctctttccaagttagcaataattattgaaaatttaaaattgaaaatggtgagagcatttataccatagaaatcaacaaacattacatattaaaacttgattcatagtttttaaaaaaaattatcttgtcttaagaaattgatagagaaaatgttaataatacag

SEQ ID NO: 106513 - DNA, 1027 bp, Homo sapiens
accacatcacctggatagtgccgacgcacacaaatcttttctcatatttattaaaaaggtgagattacctagggatgtaaaccttttgcacctagtagaaaaactaactctttgggctacttgatgccaatttacatagcaagggaatggttgtcttttacctaatcggtttgtggtcctgtagacatatcaatgctcctataaaattgtattatctgtgttcttccttcacgtaaacaggcagtgggccttgtttttcttaattcataatagactctcaggaaatgtttgcagaaccacttgagagattaatttctgggttgctcccagtgtcctggtcttctaccctaacgtcatcttaaaattttatctttttgtgacaccaagagaaaggggggaaaaggtttgagtcatatgatatgatgttagataattttgttatgtgatgaaatatcatttagtttaggcatagagtggccaaataaacttgagaatggaggcaattatctgggttattcacgccgaaaaacaatttggcttgaagtagctatataattgtggaaaagtgattttaagaaaagctttaattatctagaaaaatatctttaattcttcaagtgaaagtcaggtatttggagaaaaccacaatcacagttttaacaaatatttttggggcagttgtttacttcatagttgcacaacttgcaacatcctccacaagatggcatgcaagtttgtaacatactgtagctggtagtcatgccattgctaaatcattttgctgcaagcaataaagtccaaacaattgcacaatgaattattattttctgtgttacacactgcaaatgtatacattctggcaacgttttctataggtaaagatgattgttttacagaggtatgtatgtctctgagtgtaaatatttgaaggatatacgaaaagaaatcaagaatttaagtcttttcacgcaagatgaagatctggcatcagttagcatgtttaagtcaacactttgttgaaggccca

SEQ ID NO: 106514 - DNA, 1094 bp, Homo sapiens
gattataaattctttatgcaagacaatctttttttttttttttttagacagagtttcactcttgttgcccaggctggagtgcaatggtgcaatcttggctcaccacaaccttcgcctcctgggttcaagtgattctcctgcctcagcctcctgagtagctgggattataggcatgtgccaccacacctggctaattttgtattttttttagtagagatggggtttctccatgttggtcaggctggtctcgaactcctgacctcaggtgatctgcccgcctcggccttccaaagtgctgggattaaaggtgtgagccaccatgcctggcctacgcaaaacaatcttaacaaactatttacttcaaacactcttcactttatcaatacatctttttctattgaaaatgattcctaaagaacaaaacagtagagaaaacagatcaacaaaacatttgagaaccatattcctctcatattaaggagagatatataaagtaatgtgcactattttactttgcatcttataattaacgtcccataccagcgaattttaacagcctggaacctctctccacaataagcatacaccactaacattttgcatgtaatttcacaggttcatggtcctcctaaagcctcttcatagactccgttttcagaagtgtaaccatttccagaaattggctcattttcccatgtacatcctagaaatgccaacttctaacaattttcaacttattttgtaagccaatcaatgttaccagttaaaaactacctagaatattaatgagcacaaacatatgcagcttaaaagcattttattaagcatttttggatgttgcttcctaccacttaagaataaaaaatgcattttaataaaaacaaatctatactgaagtcattttcctttgtgagaggaaatatgaatgaaatacattcatacttaaaaacagagtattttactgccaaaactttaaatatctcaagagcataccacattttaaacacattatggtcatgtagctatttcaatattcctgggagtggtgggcaattagcctgtctatggcttaggatctgtttccatgcttgctt

SEQ ID NO: 106515 - DNA, 1105 bp, Homo sapiens
ttttttttttaagacagtcttgctctgtcacccaggctggagtgcagtggcacaatcttggctcactgcaatcctcaccttgcaggctcaagtgattctcctgcctcagcctccctagtagctggaattacaggtgcatgccaccacacccagctaattttagtatttttagtagagacggggttttaccatgtaggccaggctggtcttgaattcctgacctcaggtgatccacctgccttggcctcccaaagtgctgggattataggcatgagccaccagaccctgcctggatttttttttttttaagtgaagtctatcacataaattttaaagtttgattcaactagtagccatcttagctttaattgtattggctaataaaggataaacatgttttcatgtgttcatcgaatataaaatataggcaaacttgactaaggttttatgtttccttctcaattacagatgatgaaaaactctcagaggtagaagaagctcaggaagcaagcatggaaacagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgcatatgtttgtgctcattaatattctaggtagtttttaactggtaacattgattggcttacaaaataagttgaaaattgttagaagttggcatttctaggatgtacatgggaaaatgagccaatttctggaaatggttacacttctgaaaacggagtctatgaagaggctttaggaggaccatgaacctgtgaaattacatgcaaaatgttagtggtgtatgcttattgtggagagaggttccaggctgttaaaattcgctggtatgggacgttaattataagatgcaaagtaaaatagtgcacattac

SEQ ID NO: 106516 - DNA, 1040 bp, Homo sapiens
taccaatagaggttaatttataaatgcgttttaaaattaaaaatggattattgattttgttacaactatcttttaaaaaaccttctcatatagaatgtagcatagctggagcacatgaaaaaattgctgagtgcaaaaagcaaattcttcaagcaaaacgaatacgaaaaaatcgccaaggtaagggttttgagggatttaatgtgcaaatacattattactgactacagttttcatgcagtttttaatgttgtgaggtaaaatctgcagcctgaatcaacctggattaaaaaaaatccaaattttaattccttaaaactatattattctttaaaatagagaaggaagtctgtgttgagaagaatgtttttgctggattacattgattatccaagtatttcttttctgtttttctctttttttttcttatcccagtatttcttaagtattaaatttttaccatcttggacccttttgcctaaataatgttatggttaatcagcagaggcaatttacataaatatactagatttatggtttgggttttttgtttgtttgtttaatagagctactttccaaaaaatgaaatggaaaagaatttaaactctgagttttcattaagtacaaagcaagcaaacatttctagactgcctagaatatctaataagaaggttaaagttgagttttgttataatctcttgtttttaagttagagtatacccttatgtagttcctaaatactatttcaagataatttttaatgttagaggcactgctcttcttataatgtaaattgaagaaaagtaaaaataaaaaatataatgtgtaatcacaactgttacattgatatgaaaaactagaagaaaatagaaaatgttaatggttattttgaagttgtgggtttttatggcttaggttcttttctctgtttttgtgttgttttgttttgttttacatagggcatgtattattttgtaattcaaaaaatttgtatccaaaagaatcatactttgaattaatatgctcagttctaaaacaat

SEQ ID NO: 106517 - DNA, 1145 bp, Homo sapiens
cagtggggtgagctagtatctcactgtggttttgatttgcatttccctgattagtgatgttgagaattttttcatatacctgttggccatttgtatgtcttcttttgagaagtgtctattcaggtcatttcaatggctgttaaatttcaacatgagttttggaggggacattcaaaccacagcatcaaactttaatctctcttagatctattaatattttttcctctcaatcagggcactcactccccaggttgccttagatgttgttttcctattactttaatgtatttacatttgaaatccccagtcctcaatacagttggagatccaggcatgtagcaaaaaaaatggtatttcttggagacttgagaagaacacagataagactagcaaaggaactgttgaataccatcagtgccaccagattcacccactagatgcttctttttaataaacttaaaacatttgtagtaagaaaattctattagtatttatttcctgcattttaatctcttcaaggactatgttttatttgtctcagtctcttcagataataatgttggtggttaaaaaaccgaaagcattagtttgtatttttaaaatataaaattaaaacacttgatgaatatgtagcttgagcagtctgtcaaagccatgactctgagaaccaaacccaattctaaaaatgtttatctgatattatcacaatatattttaaaactggagccatctgccttccaaagtttatctccgctgcacctgcgctcaaaaatacttctgcctacacacaggaactattgtttaaagattttgctgttgattcagcatggaggctctccaggaattattcacactttaaaatttattttaaaaaataattactgcgtactataaaaaacaaaacagaaaaccccccaaattctacaaagacatgcaggaaaattatcttttcccacctctatctgtagtccctcttaccagaaataaccgctattacaagtttcttgtggatctgtccaaggatagtctctgaatacacacatgcatgtgtgatacacatgcacacacgcaaagcctcctttttccacacatatggcaacatattgtatatgcttttctacacctgttttgttttcattttactt

SEQ ID NO: 106518 - DNA, 1044 bp, Homo sapiens
gaattatttataaaaggaatagatagggatgaggtatccggagggtgatcaggaagtgtacctgggagatttacgggggtaaggaggagccagtatagtgatgagaccgtctagggtagatcaggacgataaaagatgtatgtgtgtgtgttaggaagggtggttgtcagctgggatgaatttagaggggcaaaggctgggtttgtggacagtctaagggagatggtctatggactgagagcggaaataaggtgacactttgggggaaggggcatgattggcaactggagggagaacctacaaggtatctggttagggaggaaggaggtcctttgatatctgggaaggggatatctagggctcttgggtgtttttcaggagatggtgaccggtaactgtaaatgcctgtggagaggccacttcttaagagttgaagaccaccagggtctccacattaaagggcctggccatgggaagaacagtgataggcccaaatttccagactgataaagagtagtggaggtgggaggctactaaagacccaggaacttcatgtggaatttcagctttgcttcattccagtttcatttatttagtggatatttatccttcctggactaggctttgggattacaacccagaactaacaagcaagaacttttccctctccaaaattttggtctgaagggaaagaaacattgactaatgagttttaagagtgacaaatattaccacaaggaagtacaaggttgggaactgtaggaacatgtaacaaagattatttatccaatcaatggaaatgagaaagcctcctcgaagttaatcccatttttgaagaataaatagatattggactggtgttctgggttggtagccacttgtataaagaccccaagatgttggaagaactcaaagctgacaagtattgctagaatttagaaagttatgagccagagatctctaagggcaataggaatccattaaaagttttaacactggtgtggtgttaatcagattggcattaaaacacacacacatgccggg

SEQ ID NO: 106519 - DNA, 1002 bp, Homo sapiens
tttaagaaaaagattttcaaaaatgagttaggattgagtggtccccaaatatagatatttagaggaaagtggaaaatgatggtttatttggcagaggggaggacatggatgctgctgggcaggaagaaatgatagccacccaccagcattatatttctctctgtgggcaagattccatttaacattttctcttcacttataatctgaattaaaaaactaaaatactgcacatgtactttatagtccatcacccctaaaagtgcttcagcactcctttcgttttgagaccttcacaggtaacccagggacttcatgggtggaagttacacttataactttagttgtctaattctgctgtctttaaaatgccttcacagttgggtacctgtgttgatttttgtcaataggaaagggtctggcaggactgaatcatattttactttaaatgctgaagtaagagagggcattatgagtcaaaagaaagtgtgagatacgtaaataaaatactgtataatgcttatggccataaaaataaacttgcttctactatttctatagtcttaacctttcctgtcatttattcgtggtgatcatttatgctttctgcccttgggttgggaaatggttatgaacacagcctttaggctttgaatatggccttgattctcatttcctgagctctctggttgtgttcaacttggtccagtctccttctttgagtctagaggagatgaccattaaatgggataataaatgcaaaaaagttttgcttactcctaggctcctagtaagtactcagaaagtggtagccattttgaagacagttacattctcatctttagaaggagatatcatacatctttttcttttcttttctttttgtttttttttgagacagaggctcattgttgccaaggctggagtgcagtggcatgatcttggctcactgcaactcctgcctcccagggttcaagctattctcgtgcctcagcctccctagta

SEQ ID NO: 106520 - DNA, 1008 bp, Homo sapiens
caggcacagtggctcatgcctgtaatcccagcactttgggaggccaaggtaggtgaatcatttgagaccaggagttcaacctagccgggccaacatggtgcaaccccatttctactaaaaatacaaaaaattagcagggcatggtagcatgcacctgtagtcccagctacttgagaggctgagccaggagaatcgcttcaacctgggaggtgaagtttgcagtgagctgggatcacgccactatactccagagcgagactgggtctcaaacaaaaaaaggaaaagaaaatgtgatatccagtgtatatatgcaaataatgtaagactgttcagctttaaaaaagaaggaaatcctttcatttttgacaacatgggtgaacctggaggatattaagtgaaataagccagacacagaaagacaaatactgcaggaatctcacttacatgtggaatctaaaaacattgaaccacagaagcagagagtagaataatggttgccagaggctgggagttgggggagtggtgagggaaatggggagatgttgatcaaagagtacaagtttcagttaggatgaatgagttctaggaatctgttacacagtaatggtgactatagttaataatactgtatacttgaaaattgctgagagtagatcttaaatgttctcaccccccaaaagatgaggtgacagatatgctcattagcttgatttaattattttataatatatacataaaagatcatatttacactgtacaattttgtcactcatgccttaaagctggaggaaaataaataatcacatgttggtattggttcattagctgtgacaaagatactatacttacataagaggttaacaatagggaaaaccaggtgtcaggtttacaggaactctctgtataatctttgcaacttttctgtaaattcaaagtcatcccaaaattgaaagtttatttttaaaaaagactatggcaaggacaatagtctatagttcaagtttaatt

SEQ ID NO: 106521 - DNA, 1031 bp, Homo sapiens
aatcccagttactcgggaggctgaggcaggagaatcgcttgaacctgggaggcagaggttgcagtgagtcgagatcgtgccagtgcactccagcctggcgacagagcgagactccgtatcaaaaataaaaattaaaaaaaacagatctcccttgtgctacccctttatagccacattcattcctattatcctcacagtccctaactcctggcagctgctaatcggttctccaactctaaatttgtcattttgggaatgttacataaatatgatcttttaaaattggcttttttcacttagcattttaaaaagaattttatttttaaaagaatatgataaaatttttaaacgaatatttatttttttaaagttgttacccagagtttgattcactaattttaagaccatatatttctagcttgggtgttccatactctgtgttgctatatttgaacagcagctaaagtcgaatatgccgacgtaatagctgattatagcattaaccttattgcctgctgttaaggatgataccttgatgttaaagggaaaattaccctgggaaaagtccatcctatcaacaaagtagatattacaattgatgaagagcaggaataagaagtcccaatgtttataccaaataaagtaactgaccatatttgtactccatttcatcttgaaatcttcaaaggagagagactttttggaacatgatatttaaatgaacagcagttgaaatatttacattaattaactaatgcaaagcttatgtcacagaattgtggaatgtcaccatacgaaatcaagtgtctgcatcatgttaagcttctttgaatgtcttaagtaggaaatggagttctatggataggcaagggctagaaatagcctcagaaaaatcaaatcttcagatgctggtatactattttctgacaaaatacggagaatattctaggatctataggagggcatgttagtgtttggctgcaaataatgataccatggctctagggaatgccacatggtcaaacctatag

SEQ ID NO: 106522 - DNA, 1043 bp, Homo sapiens
aggcaaactatgtgctcaggcagagaatgtaaatataggtgactattggcgatctctatcacaaatagtatttacaaaggcttagtagaagtggaagcattttccctggatcttttagagaagagtgaaatttgttgtgtgctgctcagcctgtatttaggaggtaatatttaaagaggtgggtagaataattaaaaactgtacgagcattattaatgaaaactacatttatcccactagccactgcccttactgtcagtcatttggtaagtgacctttgggaagccatttatctgttacagacctgcatttcctcacttacaagtattctttgtagggctgtggtgaagattaaacaagacagtgcatgtacagagtttagcagagggtctgatccaagttaagcactcagcgaaaattgttcttattggtagtgttgataagtatggcctcagagtaaaacgcgtgctagctgttcatttatttaacatctatcctaagggaccatgctagactagcaaagaatgacttgactgaggacacatatatgaattttagaattttgtaaccccaggccagtcataggagattaacgttcccctggtagactattggggaacaaactctctctgttccccaggctttcctcctcccagtcaactttaaagacacctctaccacacacacacacacacacacacacacacacacacacccgccaactcctgtcaacaggagtactggactttaatttgcctcttatcgctccttcacacacacacacacacacacacacacccacacacacacacacacaccccaactcctgtcaaccggagtactggactttaatttgcctcttatccctccttctcccttccttagcattgatgtctataggtgagtttgcctggtgagagtgaaggtaaatgccagagcagctctttattccactggcctaattgcgggttcttagcaaggcaatagcatcccactccaggcacatattaacctgagtggctgggtagccgtcaggacctgtg

SEQ ID NO: 106523 - DNA, 1052 bp, Homo sapiens
tccaaagaaaaggtaactggctgttctgatatcgcaaacacagttgaataaatataatgcttccagttataatagagtttgagttttaccaaaggatgatagtttattttaaggcatctgtgtaagatctcaaatgttaaatgtaatcctgaatatgatcttagaaaaataaaatgacaatgagtttaggagtatgatattattaggtatttgtttctcaacacaaaaactactaaataacatcccctccaaatttgttaaaattgcaggaagactttagttatagaatcctccttctttcccagtctatacccacttttttctggaagttatccaaaagtgtgctcttgtttctttccagcaccattcccccagctcctgttttcttgtctttccatgtaatgtagacccagctgcttagggcagggaagatcatcagcaagactgtaaaacaggcaagcgttcttcaggaacactttctgggcccattgcctttgcccaggctgacagacagctctgtggtaatgagtagtctctgatcattacaaaaatagcagccatcattaatggagtgtctttttttttttctttttttgagacagagtctcactctgttacccaggctggagtgtagtggcatgatcgtggctcactgcaacctccacctcctaggttcaagtgatttttgtgcctcagcctcctgagtagttgggactacaggtgtgcaccactacacctggctaatttttgtattttagtagagatggagttttgctatgttggccagactggtctcgaacccctgacctcaagtgatccacccgccttgacctcccaaagtggtgggatttcaggcatgagccaccaacgcctggcacattaatgttgtttctcactgcatgtccaccattgtacatttactgttttgggaggatagtggtgaagtttcacataatatgaagcaggaaattcctggaggaattttgatttaaaaaaacaaaaagggctgagtacagtggctcacacctgtaatcccagtactttgggaggct

SEQ ID NO: 106524 - DNA, 1033 bp, Homo sapiens
ctaagatcacaaagcatgtaagaggccctgtaacccagatctgtctaattactccacagctcacatgcttaaccattctgctgttccgagccctttccagaatgtacatggcttttcatgagcttgagcaggtcaccctaacctttgtttttcttatccttgtctagaaatactgacctttaccaaaagccattttttttaagtaaaaatatcagagccttttcttgctgtgccttacaacagtcggtgtgttgtatttagttgttcttttataacattttttctttgagggggaggggaagtatctacagtttgcattagaagtaatgggctttttaaaaaaagattaaatgaaagctaaggttgcagcagatagcaaacacaatcatctgggatttgtgccattaaaaaaaattcctttagaaagggagaagtgaaatttcactatttaaatagcatttcagtgcaagattgcttttaatcacattgttgttgaaagtttttattgcagtatttctaataaatgtgcccctctgattattaaagtattttttgattgaagttctaagaaaaagaagcctgttagtagacttagcagttggagttactgtacttttgagaaaaaggcagagggttacatttatattcatcttgtacagcagggattataataaatgagcagaagaaggagaacgatttttgcatttcacccactcataacgtaaaactagattaagtattcttgttcttctttgtaataaagaccctgctagcatgaaatgtttttttctcttatatgtaagcatatggcaaggaaaaagcactagttcattatcaattagattcacaatcttaaaacagaaactatttccctcccaggttatacagatgttttccataatcctgaactccagtcatgcaacagaaaaaaaggtaatgcttttaaccagtggtccccaggctttatatttcaaacaagaaagtttcagaaataatttggggactccagacatacggttgttggcaatttata

SEQ ID NO: 106525 - DNA, 1044 bp, Homo sapiens
caagtgctctgagagagggattctgctgggaaatgtgtaaggaatgccctctttgaatcagcagtggagatggctgctggtggaattgacaagaggtttagaggtggatgggggtttgggagagtaactgcatgaagtagagggaggcaccatgtggtggccctggagtgacaccccacttacttggagggaaggagaggtgggcagggttcccaggaccaacaacctttcccagtgctgccacagtgtcgtctatcttttggggacaggggttgtgacaggaaagattatttttggtacattttcttttttgttgaaatttttagaaagccagttgttgcattattgttttccacagttaacaaaacacagttttcaaattcagaatctttcacagtgactgttgtagtctatttacgtgccaaaagagggatggtattttctttcagtgatattggtgaaaatgtgtcggcagtcttctgtgaattcatgtattgctgatatccatctgtgacttttatgaacaaatgaatagttcctaccaactccagcaggcagttccgttaaaaccactgctaccaggacaagaaaacatgctaccgtggcagcaagtcttgtaaaatcagtcagtgttggtggtaaaactattctgaattggtgagcagcttattattcggagtagttaagaagccctgtacttttttgctagccaagctgcagttttaggagttaacaattaaccaggatttccatttgagcaatgatggtgaatgattgtgctgccattttggcatttccagttttttcagtctgattgctctcacagcatagtttgctttcttggaaactacatagtaataccatgatttcttgatgttgttttaatgttttaaaatactccagtgtgcctcatatttctcttcagttacttagtatttttaagaataaggtgtgaaaccccgtctgtactaaaaatacaaaaaataagccaggcgtggtggcgtgcgctcccacttgggaggctgaggcaggagaatggcgtga

SEQ ID NO: 106526 - DNA, 1029 bp, Homo sapiens
tttttccttagttgtattataagcaaatatctttaaaataaagttatgtcatttgtaggagcaacattttaatttctagatataaaatgtacttatttttcctcttactgatatctgtgcttttatgaatgtctgtgcctttggggctgctttagaaaggaattaaactagcaatggtattattcatgcatttaacaaaatttactggtgcctaatatatgctaggcattgccctccactgaggtaggaaaacagtgtctatgatttcatgcaccttatattctgacttaatacaatacattgtattaaggaggagagagaaaaatgaaattgtgtgaaatcagattgtttcaggtagtgataaatgctaggaataatgtgagagaaaatgactggggcagaccactttaggtaaggctagttaaagaaagcctgtctctggagttgatgtttaaactcagtgatgaaagagagccagcccatttgaagatgtagaggacaagtgcttcacatagaggaaatagcaagtgcagaggtccttagatggaagtggtcttggcagaaaggccagtgaggaggcctaaggacagtgtgcaaggaggaaaggggtccaagttgaaactggagaaagtgggtccaggaccagatgacactgggccctgcaagccatgagaagaatcaggattggacggcgcaggcaatgggaagtcgctggagggttttggccaggaagtgttatgatcacgtggttgctgtatggaacacggggcaaatgtggaaccagggagaccagttagtgagctgttttatactagttaaggtgagagctggatcaggagagaaagcttagattaggattgtagcagcaggggcagagaagtgtgaacagaattaaaatctgcatcggaaatataaagccagcagggcttgctgatggactgggaaaggaagggaggaggaatgactcatggggtttttggctcaagcagctggatgaatttacttgagcttatggatcaggaggttgtt

SEQ ID NO: 106527 - DNA, 1052 bp, Homo sapiens
aaagctgttttgtcagatacttcaattccacagcaaagtttcaaacagaacactgcgtcaagaggaagaacaacttcaaaatacaaacagtaaccctgggaagtcattcagtaacttaaattgagtgtataaaaatttaattatggactgactgccagaaaagatgattttttttagttgtgttattaaggtagccagcagagctaagctgattcttgggtggatgtgtggaggctggtctcaatattaccttacctgtctcagaccttctgtcttcatgcgggaagtgaggtgtcaattgagttcttcagttttcaggggattcagatttcatgccttgtgtaataatgagcttgaccggaaggttttaattgaggttgaaattgagctccccagttgtaggactttaaatatgaaaagatcttaaacctttaatcaaattgctgttgattctctataattgatttttctgaaaactcttgtcagacagttttaggttcactgtttctgctttcgtttttgcatgtcacttctgatgttttattagttgacagccctggcatgcaggtggagcagatactgtttctctcttcagaaaaaataaatgtgtgttgcagactcattgaaaacattggcattcctgggtaattaatcactcattccttattaaaagaatgtataatgaaggaatctgtaaggctgtgttcaaaatgtgaggtttttcttatttccatgttctggtcttcaggtattctgccctcccccacccagaataaggtgatataaaaaggatataaaaccagtggaaaatggcaataaggattgtgactggctcagtgtagcacttttcagcagatagttttgtcatttcgttgtaccttgcagagttgctcttgtttgttggactgtgggaagatgatgctccctgttgggattcctacacagaaatttctattttaaaagacaaaacagaaacaaccaaacaaaaacaaggcagctcctctaaattgagttttaccaggttccttttattctctctctttttatgtttt

SEQ ID NO: 106528 - DNA, 1081 bp, Homo sapiens
ctcggttatccagtgaggagggcgaaggcgatgacaaagaagagtctgttgaaaaactggactgtcattattcaggtcatcatcctcagccagcatctgtaagttccacgtccacccccgcgttgaccctccccacacagcatggacagggcactgcaggggggcgcgccagggatcttggcatgcccgtatgtgtgggacgcggtcaaggtgtgagagaagttcaaaacagggtgccccagaggcagcacacactctgtacgggggacatctcgtgcttttttccctttctcttccatgacgctcagggctaggcattgtcactctcatgcttcacagcctccggtactcagaggcagttctgtctttcctgattagctcctttcctgaaggatctagaaccctgactgggcatgccagtgtgggagtcagcaagcacgcggctatgttttctcttgcagttttgcacatttgggagccggcagataggaagaggctattacgtgtttgactccaggtggaatcgacttcgctgcgccctcaacctcatggtggagaagcatctgaatgcacagctatggaagtgagtgcctgttgttcttgggagaggagctgactttacacagtgctgcattgtcttttatttcctgtgagactgatgttatgaagatatgcttatctaaacaaaactggcctttggccctgagaagaaggtgccttgtcattcattcattcatttacccctttaccccacaactacatattgttgtgggtgctggcattcaaagcagaaggactcccacatgtatggagctcacagtctagttgggattgggtaaggggagaaaaaaactagtctacagaagaataaggagatgatagcttgtcctaagtgacagaatggaaacaataacaatcagcaagacttagtgagagccaactatacaccaaacaacttaaatatacttaacattcacaattctctgtcaggtgaccatgattataccctccccccacccctggttttttttttgttttgtttttttaatagatgacaaaactgagatacagtgtcatgcag

SEQ ID NO: 106529 - DNA, 1025 bp, Homo sapiens
ctgccacctcggtttaaattctgccaaagaagtttttgaaattttgttactgtcacatttaagattcagagctaaaataaaaggagaccctccctggtttgaatttagatggtttccgcatcccctaataaataccttgcccacacattcttaacagaatccattgttacaacaccatgctgaatatcccttgatactgtggggctttattcccttgttcaggccaatagttatgacctagcagttgctgttaattagctgcacccttccttttctctcattcattcctgacttctctcgacatttattcagtgccttctgtgtttcctgcactgtgctgaacactaggaccacaacggtaattaagctggggatgactctctctgcagaggatttggtgattagcaatccgacacttaaaggatgagcagaagctggggtattgggtcatggcattttctcagaatataaggaagtacagtggctggaagcagggaacgggggcgttgggggtgggaggtggagctagaggctggggcaatagcagcggggagttgcacacatacagttctgtaagaactgtaccaggaaggcattaaagaatttgaaggagagaggtgacaggattggctttgtagttcagagtgattgctttgatgtggatggtttctctttgtcacaagcaaagagggtggtgccatctgaaagtctctgtgaatggctgtggtcagtgtcattcactgtcctctaatttttttcaggaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttc

SEQ ID NO: 106530 - DNA, 1006 bp, Homo sapiens
tggagcagctgcttccagacatttgttaccagttttaaagagaggctgcagatctggacttgcatgtgaaatttagttgagatatatgtgtgtgtgtatatatatatgtatacacacacgtatacacacacacttttttttctcttcttaaatctggtatagcctatgtatctgtgggccatctttggctcatgacctgccattttgccacctttgatttttaccatgtagtggcactatgtcttactagaacaacacagacagcctaactttgggctttttccttaaaatcagttaaaatcagtttccacttaagtttgtgtttgagagagattttctctgtgcagaggaatactttttattatgctacacaaatcctggggcaagagcaggggtgcttgcttagagatcaaaggatcattgaaccccaagaagtattgcacatttttatgtctttgttcatttatcgtatagctttcataagaatctcaaagggactcgtgaccccaaaatgctttaaagaatgctgctgttacaaaagtagggacctctacttgctgttccttgtggagctgccattaaaacaaaaataactgggctagttgaagttttctaaacaaggggatgaagagtgggacatgctgggaagcctaggagatgatggggttgggtaggcacccccaagagtctgttcatggcctgtgccaccaaagatgtaaaagcccactgtgaatgccagagtttcctcctccccagcatgggcactgccttgagtgcgaactgtcacacctgtgtgtgctagcccttgaccttgttcccttctcagttaacaacctggaataccttcaaggacacaaaagcactggaataccttcaaggacacaaaatcagtaaataaaaccaaaaggcaaacataagagccttttctctaagttagaaacccaggcctgcaactcttctagccagttggctagaagtgaatctttgcaatgattgtgcccagtag

SEQ ID NO: 106531 - DNA, 1244 bp, Homo sapiens
aacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtggttcactgccaagccaatagttctagaacctgcctcctttacagttttaagggatgcctctgttctgtgaa

SEQ ID NO: 106532 - DNA, 1041 bp, Homo sapiens
gtggcaccaagggttacagatctttttgtcagccagcaacttacacgatgtgtccgttttgttattcactcatgaaatacaatttaaaatatttaaaatattttgtattccaaaaatataatacaaagaagtacctctgagaacattgaaaaaaatgtataatttgaaaaatgtaacttataagggcagctgtcttcctgcaagagttctgttgccaaggaatttcttaatgtcgctcattctgtccagggggtttggggcgattgggctttgaaaaaatattcttaaaagtttgtttagcagaaaataatcacttttacattttgtgcaaaacattttacattttcagataatttaaatgagcactacatactgtcagtgtgaatgtagggccttgaaagcattttgcttttttttttttttttttttttttgagcttggttataaaagcaatctcctgtgttaaaaacgtgtgaatagtttgataatttgtacacataatcaagagcatctcagctggactttgtgttggctgctgtatagaacatgaacaaatgtcaagggatagaaaattactttggatatttaaaagagaagaaatatatagtctatttgttttgtaacaagtttctgtaaataaaataatttatactatttataagaaaaggttgtgctttgctttataagaaattagcttgtggaacaaacatgttactaaacgggcaataaaattaggacttctcaataaataaggttggctgcatgaaatattgtacgtttctgcctcgttgtgatactaaaccctttcagtctactctgacttttcatcacttttggcatggaacacccttgtgaagccccttcaatttagccttcctcttatataagctaaatacttctaaggcctggggatgtttccatctgggggcacaaagctttgctttggataaattagtaactgtgtaaacagtgaacattactgtattctggccttgcatgtttgtgaaagaaacgagggagttgatggattgagaaacacat

SEQ ID NO: 106533 - DNA, 1105 bp, Homo sapiens
ggttgtcatggattctttattctttttttctcccttaaaaagttacattttagatgaaatccccttttttaaaatgggcaaagcaataattctacatcatttctccccttcccttccacttgtttagactaagatatgttagagagggaaagggtcgttgttttagtaaatactattgctgttgacatgttaatactattgctgttgacatgtttactgatgggctgtgttccataattttgttttaggtcttttgtttgaaacagtttactgtttttatcagttttggtccctaatttttcctaacctacagtttttctctgagtacatatggtttcattgtttgatctactttctatctatctgaatatgaacttctaggatcatgtttattctagtagatgatgacttaaagcctgcagtataggagggacaacgtcaactactgcatgtgcaataacaagcttgaagggaagctaaatgtttgttacaaatttaagacagtattttaatgccgtttgcatttttctaagaattttctataaagctaattctgttattttttgtctctaaattagggaactgtccaggtttattgctgccgggagactacactgcaaaatagataaagtgaatgaaatagtagaaaccaacaggtactctcatttctcagaataaggggcattcctaaattttaaaagtaggtcaactattgtcatggaataatgtgactggtaaataattcattttttcttgaatttatttatagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttccatttatttttttcttaaacacataggccttctagaatcgggtccacttatgttaaaataatgtcacttgaattattcattaatgaaaatctggtttatagggtaaggttgcagctgggttc

SEQ ID NO: 106534 - DNA, 1011 bp, Homo sapiens
aaaaaatgatttttactttattttacttaaggcataagaagttctccgtggttaaaatattagtacgtgaactttgtcatctatgaacaagttcctttagaagctgagctctgatagtgatgtcaaatagccacctgttacttgaagacgatgtttgcatacctggcccctcctttatcactgctgttgctgccattgttgatgacatgatgtggaagggcagtgagaaatttgatacttgttcatctatctgttggactcaactagtagtgttgctttagtttttaatctttttatctgaaacggagagtctattataatttgtcattttattcattgcagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcagtaagtttgaataatgccatgttaattgaagttttaaagttgccttttaaaatatgtgaacttgtacaattttttacttgtttacattggttccctcaatcttaacggggaggggagaggtttttttcctcagtattatcaaaacattcgtatcctgttgcctctgccttcctcatgtcatgtctgccccttgcattaacagatgggaagatgagttgtagtgaggctaagtgatttgttaaaggtcattagaccagttgttatcaaaagttgtcttctgttacttctttgtagaccacactgcagctacggtaatgactcttagatctgatatttacagttggtcatattccctctgataattccttccagtttttaggttgctgctgcaattctggtcagattggttgttaaatgtgggacttttagtacttgcatcagtgattaaacaaataaatacttaatgagccattcattactatatgtttggtattgtttta

SEQ ID NO: 106535 - DNA, 1979 bp, Homo sapiens
ttcacctgttattttcactctaataaacgtagaattatctatttctcctaggatccctggttccttttagtgggggatagtatttaaaaaccaagatcttagtgctaggtgtatccattgctgtattcccagtcccttataaatttgtgaaatataactaataattacataaaccaggcagacacatactgaaaactaccaagtgtgaacaaattattttattcatattcaaagcaaaggaaacattccacagtgctttgagagaaaattatatatttacaaatttagtcatattctaatagcgactaagatacaatttccaaaacccttcagatgatgttattttgatgtagtgtattgtgattatgagagaaaacattgaatatatagaacagagaaaaatacttaacaattgtgaatatatttttcttaaattgttttcctgaatctaagtatatgcttgggcatttcttatgtattttttaaactttatacaggtagagaaagtagaataataaacccttgtgtacttatcacccagcttcaacaattaacagttaatggccatcttgttgtacttctactcctacctcttccctcaacctttgaagaaaatcccagacagctgatagctttttttggaaacttgtagccttttctcacctattgccttggctttcttgacaggagggagctctgacagcctttcgcaagacatatgacaaaactgtggccctgggtcaccgattggatattgtattctatctccttaggattggcttattttatatggataatgatctcatcacacgaaacacagaaaaggccaaaaggtactttctaagggtgggattatattttctctaaattatgatgctacaaatgagaagctgatataagaaactgcctgttttgtttacagctagtaagtttggtcaaataattgatgtacttatttagtaaaataatttaaatatctcctttcggttcaagttgttaaaagttgttttctcatttcaaataacagacaagtttttaaaacgtggccttgtctgtttccagactatgatcttactgtttttatttcatagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtaatgaccaaactttaatactcaaatttaaagacttgttttttttgtttaaatacacaaatcattaaaatgtacattttttttgtatatatgttttttaaaatacctaggtcattaaaggagcagagattcttgaagtgttgcacagtcttccagcagttcggcagtatctgttttcactctatgaatgccgttactctgttttcttccaatcattaggtaaggatagggttgatatttttgattatctgtcttcatcttactcctgatcctatgtgcaaataacctaagacgatttttcacctatctgagaaatgtagtgtgtaggtagctgcatgtctttgatcagtattcctaatgtgcccagttttgtttagaagaagggtcatcagattgtggcctgctgtatggcccaggaggtaagaatgatttttacatttttaaagtgttgtttaaaaaaggaggatgtgacggagagctatgtagcttgcaaagcctaaaaatacttaccctctggccctttgctgagggtatttgccagacccctggttaagagtcttaatggggtataaggcaaaagtgagcaaatggttattaagtattgagcttcatggggacagaagtgagggaattctgaatgtgatttggggtggagattaattgaacct

SEQ ID NO: 106536 - DNA, 2030 bp, Homo sapiens
tcatttgtcttacctactaaataggctaatagtactacctcgcagcatgaagatgattttaataagatgaatgagagtaacgactcgacaaactatggtgattgtttttattaatgctgttattacattttcagttttcaaaaaattttaagctcccatcagttacaaacggaaagtaaaatagctaaaaagggagtgagaaagagattcaagaaattgggcttttgagttgggctgcacccactctgggactccgcagggggccttgagggtggaaaagcccccgtgaccacacaggggcgcaggcgcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacagtgaggcccgcacgagcgccgagtcagcggcctaggcctgggccgtccccgcgttccggagcctgcggggactttttttgatggagctccagacccctctgacggggtctcagagaccaggcctggcttctccggcccttagggttttgctttggtttggggataccctgggggacctcgacttgcctcagcggggtctgcatctctctgtgccgccttcccctgtaagggcagcttgggggagaatcgtgaggcattaatatttacccctgtgctaggcacagagtaaaggccccgtgactttctgtcagtggggactgctcccgggcgcggggtattcctgtgggagagttcagcttgcctgtggaagggaaatttgggttcggttctttctggcccttctgtagtgaatgtgtatgtttgaacatatgtatgtgagtatgtgtgtataaaaagtctttccctgtttgaagacttttggaacagaatccggcaagagcaaaccgaggattgccctccctccagccctagtagaggttggcattgccaggattggccgtcacgcaaacctcccaccagcatacgtttatgttttgccaagccgattattaagcgccatcgcatgccttcctgttagtggggaagagactggtggatgacttgtggcggggcggggggtgaaatacgtgggcagactttgacttgagggcacaagtgtccccactcacacatccctctttttgcatgttagacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagtgagtagagatggttttccctctctgtagttagtataggctaaaattggagactattccaggtaatcgtttctcattaaaaaaattaacttcgttttagaaaaagtataaaggtaatcatgcttgcttgtactggtgaatcaatgtaaagatgaaaaagtcgtctccatgaaatgccttgtcatttccccaaacagcagctagggctgtattcttccccatttcaccccatgccgataaaaacgtaagtgtacatctagagaattttatttactgcttttacaaaattgggatcattttcagcagttttctcacttggttgggaagcactggttctggtgtctttagtactttacacgagtaatacttagcagaaactaagaaacagtatagtaaatgctgaagttctgttatctttctttactctgtacctgcccagggatagg

SEQ ID NO: 106537 - DNA, 1057 bp, Homo sapiens
ttggcagccaggtggcattgaggatggtattcagggcgctttccttctgtcatatagttgtgggatctctaccaagtgtgaaggtgaatgaggtaagggagatcagaaccatgcttcctggtttttcatacatccaaggaagaagtcctggtgtgggttgtttgacaccttctttccactttcaccttttattttttattccttcctttctacccccaaccagtcgagcaaatgagcaattttgtgtttctaatacaggatctggaagtagtgctttctaatcctcatttcctgtaggatgttcctgcactataacaagattatgttttcttccttctgcagcagctttctgcttcttgggtactactagctattgttcaattcaggtgaggcctgtgatgacatatatgtagcatgtgctctgcgctccctgcaagctgagcagatacaaccaatgcatcactgtatactcttgctgagaatgtggatgcagcctcacagatctttgcaacactccaaccagccaggaccagttgatcagaactgatcttattggtctgataaccaatcttatttgtgaactgattcatatctgtctttccactcttggttctcttgccgtagaacaaaaacagtttaggaagcataattacgaacatttaggaaccaatatgtataagtaattcggagactccaattcacctgcccctcccccatcccaggttgtggaggctcgaggaagctgacttcttaggctaaaggacaaaaaaatctctttacctccttggccattttcatgttctctgccaattactataggcagtcttcattttgcagaggtgaggtaagacttcatcttattcttcatgtaatcccaccttctaacaaaaaataaataaatatttaaattccaaggagaagtgttctttgtgtatttctagcagaaaacagatgcttaagcctaagaaggaagatccgtccatgacaaaggaaagtggaaaactgaaccagttatctgaatacttcatgccaggacagttgctattagcaactgttt

SEQ ID NO: 106538 - DNA, 1028 bp, Homo sapiens
tagtgcaaagccgtgctttctctccctattcctgaggttccctagctgcctggccagaagcctgggagtgtggcatgctcaggtacagcccctggttggtctctatgatatatgccttcctggatatgttatgagaaacaaggggagctaggctttctttccacactcatgagataaaggaaagcaccccagaccctttgctgttccaaatgtggtctgtggaccagtatcttctagaagcttgtcagagattcagaatctcagacttagtggattcagattttcattttaagaagatccctgggcgacttgcatgcttctgaagcttgagaagaggttgccttagagtctggagacctgctttgattcttgcctccatcactgactcctaccctcacccatgaccttgggcaaggtgctcatcttttttctgttttcagttccttatctgccaaacgaaggtccatctgctgtctttccagatttccggaagcaccagtgcattttatgctcttaaaaagtataaagagctctataaatgcaagttaataatacaagcagtaatgattatctgaaaacttaattcttacctaagacctttattccatagcttctattttattagaagttgactttttcttataatttcaacttttattttagattcagggggtacatgtgcaggttacctgggtgtagtacgtgatgctgaggtttggggtatgattcctcctgtcacccaggtactgagcatagtacccaatagttagattttcaaaccttgcttccttccctccttcccctctagtagcccccatgtctcttgttgccatctttacatccgttgagtacccagtgtttacctcccacttacaagtgagaacatgtggtaattcgttttttgttcccaccttaattcacttgggaaaatggcctccagctgtatcgatgctgccacaaaggacatgatctcatacttttttatggctgcatcatattccatggtgtacatgccccacattttcttt

SEQ ID NO: 106539 - DNA, 1048 bp, Homo sapiens
acaagggcaagacggaggagcccatgctgaaccagcacagccagctgcaagtgagttctaaccggctgtcagccgacgtagaccccctgtcactgcagatggacatgctcagcctgtccagccagacacccagcctcaaccgggaccccatctggaggagccgggaagagccctaccattatgggaacaagatggagcagaaccagacccagagccctctgcagctcctcagccagtgcaacatcagaacttcctacagtccaggagggcaaggggctggggcccagcccgaaatgtggggcaagcacttcagcaaccccaaaaggagctcgtcactggccatgacaggacatgctggcagcttcatcaaggaatgccgagaagactattacccggggaggctgagatctcaggagagctacagtgatatgtctagtcagagtttcagtgagacccgaggcagcatccaagtccccaaatatgaggaggaagaggaagaggaagggggcttgtccactcagcagtgtcggacccgtcatcccatcagttccctgaaatacacagaggacatgacgcccacagagcagacccctcggggctccatggaatccctggccctgtctaatgcaacaggtaggttctgttcaccttgaaaacagatagaaagggggtagtctctgggtgactggatgctggtccccaggaattttttttttttttgaaatggagtctcgctctgtcccccaggctggagtgcagtggcacgatctccgctcactgcaagctccacctcccgggttcacgccattctcctgcctcagcctcacgagtagttgggactacaggtgcccgccaccatgcctggctaatttttttgtatttttagtacacacgtgtttcaccgtgttagccgggatgttctcgatctcctgacctcgtgatccacctgcctcggcctcccaaagtggtaggattacaggcgtgagccaccgtgcccagcctggtcctccggattttaatgttgtttctgccacgtgccctcttctaa

SEQ ID NO: 106540 - DNA, 1018 bp, Homo sapiens
gtttgctgtgattttatagcacataactgccatgaataaagagaatcacttgtgtttacctttgcaaaatgtaatatcctgtttacatagtactctcttctttccctgctgtggcagggattatggctatttacaaatggttggttccttcttcttccaggcacaaagggggaatgtactttctcagtccgtttaaagttaggcatgtccatgagacttgctttcaccaatgaaacctgaacagaagtcacatgtatcatatccaggaaaaaagcttttcactgccagtgttcagctccaaccatccttttctctgctgccatcctcatggaggcatatctccatatggagcccccatcacctgggtctctgcctacctataggaggatacagtgtgagacagaaataaaatcatggtatagataagggtttaagatacagaatatatacggttcaacaagaagacaactcagttaaaagatgactgaaggacttcaatcaacatctctccaaagacaatatacggtcggctgataagcacatgaaaagatgtccaacatcattagtcattaatataatgcaaatcaaaaccacaatgagatactgcttcagacctactaagatggttataattttaaaaactggaaaataaatgttggtaaggatgtggagaaactggaatttctgtgcattgctggtgacaatgtaaaatggtgcagccactttggagcactgtttggcagtttctctaaaagctaaacagaattaccatatcatccagtaattccactcctaggtatatatgcaacataattgaaagcagagattcaaacataattgtacgccaacattcactgaagcattatccacagtagtgaaaaggtaaaaacaacccaaattccgtcaacagataaaaatggataaacaaaatgtggtatatacatgcagtgaaataatagccacaagcaaagtcctgacacatgctacaacagaaattagccttggaaacatattaggt

SEQ ID NO: 106541 - DNA, 1128 bp, Homo sapiens
tattaagtacccatatgtgcaagctgttagtataggtgtgatttcaatatggcagttttccaggtccaatcaaaaactggagctttccaacaccagtctttatatgttgctttaggtggcctggagccatacaaaggtagatgtagaaagtgtctcatggaagacccatgcagacatcaggctttgtgctggcctccgataacttctgtcttttgagtaactatccttctgggctcataagtgtttgagagtctaagcttcgatgataactagctctgtgttcaaattttagctgtgctgctttccaacattggccaagttaattcacctccccaaactttcatctcatcttctgaaaaacaaggatgtcagtacttaactacagcatagttgtgaaaattaaatgaaacaatgttttaaacatttggggtttttaaagtggctgctcttagttttcttttccatagtcaaaaattggaaataactcaaaagtctatccacaggtacatggataaacatattgtattatatctatatagtatactactacttcacaataaaagtgaatgaactgttgatctatgcaaagtgaatcagagtctgagaatcattattccaaatgaaagaagccaggcaaaatagtacacactatgtgatttcatttatataaaactctagaaaatgcaaactaatctgtagtgacagaaagcagatcaatggttacttggggatggggaaatgagagggaggaacgacaaaaggattgacaagagttctgggggtgataggtacatttgctatcttgattatgttgatgctttcatgggtacatacatatgttggaacttaccaaattgtatacttgcatgtgatttattatatgttgatacctcgataaagtgatggaataaatgaatgaatgaagttactctttagcaaacaggaaggcaagcttcctcccatgccaatggtggaggcttcctaaggtttcatcaattgcctcagggagtagctaagtcttttgccaagcttttgtcagaaagaactgctcagtattaatcatgcacaatgaaaaggagatttggggtagaaactcatcaacatccagatggatggcacaagaaaatg

SEQ ID NO: 106542 - DNA, 1036 bp, Homo sapiens
cacatgagaatgaaggtggactcctacttagtgccatatacaaaaattaactcaaaatggaccatagacctaaatgtaagagccaaagccataaatctcttaaattaaaatgtaagaatacatctttatgaccgtgagttatgcaatggcttcttagaaatgattaaaaaaacaaaagcaacagcaacaacaacaaaattagacttcataaaaattaaaaacttttgtgctcaacagatgtcatcaagaaagtgaaaagacagtccacaaaatggaagaaaaaatgttcctatcacatatctgataaaggacttgtatccagaaaatatgtgaagaaagcttataactcaacaattagaacacaacccaatgaaaaaaaatggactaaggatttgtatagacatgtctctattctaagaagatacataataagcacataaaaagatattcaacatcattagacgttagggaaatgcaaatcaaaaccacaattaaatactgttttatacccactatagtagctacaataaaagaagacagacaataacaaatgtgacaagaatatggagaaaatggaacactcattcatcagtggtgggaatgtacaaaggtacagatattttgtgaaaacaatttgggagttcctcaaaatgttaaatctaaagttgccacatgacctagcaatttcatttctaggaatatacccaaaagaattaaaaactttggccaggcgtggtggctcatgcctgtaatcctagcactttgggaggccgaggcaggcggatcacgaggtcaggagatcaagaccatcctggctaatatggtgaaacccggtctctactaaaaatacaaaaaattagctaggcatggtggcaggcacctgtagtcccagctactcgggaggctgaggcatgagaatggcacgaacccaggaggtggagcttgcagtgagccgagatcgtgccactgcactccagtctgggcgacagagcaagactccatctcaaaaaaaaaaaaaaaaattaaaaacatatat

SEQ ID NO: 106543 - DNA, 1498 bp, Homo sapiens
accctccttatgactaagcactgcacatgttttccactagagcaccatggaccatttctaaaagtacattaattaaaaggagcagattttcaagtacaatatgagcctgcctttccctggtgggtgtagggggtaaactttagcgcatgtttggctatgaagtctataaagatcaaattggctgaaccaagcactcagatatgagtgttgacttggaagatgaaacctaacactccagggggcacagaatccagagatgtcgctggttggaactggaggcatgaagaaaatcagggctggcctcgtttgacaaagcattgccagagtcatgctcactcagaacagcagagtgaacctacaggaggaagcaatagtcgggggttctctgatagctcccttcttcctggtgctagtgtttgagctgctgtatgtgtttgagctgctgtatgtaagtgtttgagtgctgtatcctggggcactgaaggcagcacaggagccctttctttatctctttggacatggagcaagagccacttccggttggtatgttttccaacccagcacccagcctgcctcgagtgataggtggctgacttgagttgcctcgattcctctcacactgggagtgctattgtcttcaagtcaccctcctctcctcgactccttaaaatcaaaccttgtaaatattttccagccccatccagggttaagggtagccagggcagaaattcttagcatttcatttcaactgggcaagatgccaatttttccagctcttttcttggcatccattcatcagttatgagtccttagagatgcctgctcatgaaagttccaagacttaactaagaaacagcctattttctatggtcacaaaatctggtaaggttttaaggtaactgttaatatagaaggcaatgtatgttttgggtgtctatgtgtctgtgtatagtctatggttaatgttgatgtggatgtatgataactgtcacagactgagcgcctactgagtgtttgctacgaaagatgctttatgtaaacttgtcttgttaattcttacagcaatcatgcagctagatattattggttctatttagtaattgagaaatcaggactcctggaagttaagtaactcgttcaagcttacacagagagtaaagagtaatgctgggattcgaacccaggataattagagtccaaatcctgtccaccattctaggcttctttatacttttcattataatgtcccctggggatgtgtttgtttctcttatatagctcctttatgaatccctcatttgagaaacacctcattatttagccattgaattaaaatctcgttggttgatctttggtaaagttggaaacacacaagagaatatgtcagacttgaaacagaacataggggtgtcttcaccttctgcttttaatgtggcttttggaatgaaagtgtgagattgcttggaaagtcagaagacaccctgagatgagaagtaaa

SEQ ID NO: 106544 - DNA, 1046 bp, Homo sapiens
tattttcctttatgtaataggaaaagattgtcagagttttaaaagtagtaaatactagtgaaaataacttaataaatcaaaggtatttaaatcacagccttaaattacagctttgggtaaggaatttaaaaagaatttcccttaagagttaaattctcaactcattttcagcttcatttcaggtctgttactagcacaggtagtatgttatcatggtctgttattagcacaggtagtatgttatcatggtttctatagagtcttctattatttgatttggtttccaaagaatgttcattaggatcaaagatttgccacattttgcagtatggaatgggatggggagggaagtaatggtttttttgttttgttttttttggttttggttttgttttgtttaaatatatgatatcaaatgaaaggacaaggtttttccagctgggtttgtcttaatggcttcacctcttactcctttgatgtgaatggtgattgatctgtggttcaagtcaccaccttcttgacagctagaaaggctgaccttttttggtttaagaggtggactttaatcattagcctgcaacttactgcatatgtgggtgtcccggcatccacaggttggttacacattaattaactctctgatcttttctcattggaaacttattggggaaaggagtcaatttccctttgagttgactggcaagtttttgtttttttgcctaattatttgccatttgccccttattaaatgctttccttgaaatgaataaggagcattgaagaggagtctagatgaaaccatttgctgccaagacagatcattagcaagaagttagtgagaatgactcacaaaaattaactaacgttgagtgaattatttctaatatgcacttacattttcatctggtgagatagtgggctgcctttttaaaactgaaatgtgttcaacttactcctgcaaaaattttcagtgagtgaagtttcagttacataagttttatagcggatggttgggttttaacgttttgtggattgaggtgcccagc

SEQ ID NO: 106545 - DNA, 1066 bp, Homo sapiens
gtctcaaactcctgaccttgtgattcgcctccatcagcctcacaaagtgctgggattacaggtgtgagccaccgcgcccagccttgattcttaaagtaacccaggatctccagagcatccttttcataatctcctcacttattttcattcattccctccttccttgcttccttccttctccttttccttcctagcctccttctcactctctgtctcctgtcccttccccctaatatttcactggagtttatataactgaattaattagacctatttctcaaggagttggttttccagaaaattcactttgcagttggcatgacagaagagctggcatattaatcaaatgctacaatttgttctttgtatctgaatgaggctgaggttggacttactgcttatctgttgtccgtttttaccattctgtcctttgcagccaaggagcctggattggattctttgtgattggactgggtggtggttgtaagtgttgatagattgggcatagacctgctgaatggggacaaaccctatctccttagttactgttacagagtccccaggatataaagtgtctgtatgaaaataaataagagcttttcttttcctttgtttggctgatgatatctataccatttaatagaataaaatgataaaaatctttgtcctttcttaaataacatgttaattgctgttttatgtatttgttcattttgtgtttctgaaatatattcagtttatagacatttctgtccctcgatgcattttaaattctcaagcatcctcaaattatgtatattgaatataatcttgtatatgtggagggggatacactttgtagctaatggggagatcaaagttactagctttctccatttagtcagcttgttgcagaatacaaaggctgctcaaggatttgagttcatatcttaaaagctcatcagaaatattctaagctatagatttttttctctctcagcaacatttcggatatggaggttctcctcggttgcccttgcaagtgttgctgaatttaaatgccacaggaaaaaagaaagatctgttc

SEQ ID NO: 106546 - DNA, 1041 bp, Homo sapiens
ctcaaaacttggaagcagactcttccccagagcctctagataagaagccagtctgccagtgcttggtttgtcctgtgagacactaagcagagagtccagccaagccccttggacttctgacccacagaactttgaggcaataaatgggtattgccttaagcaactaaatttgtgataatgtgttatatagcaattaaaatctaatagagatggcaattgtaattcatctcccacggcagatttgatcattctggagtgcctacccatagagctgtgttgagaaggattctgactgcatgcaggctctgtgatggttcagccacatctggagcaacttcatgtttgccacaacatatgcatgttattgttagtctgggctgtttctactgagctgggattgtgaggttaggtggagttagattaagttgttaggctggggtcagaaacggaccataggatcatcaaagaaaaccagtcagcaatataagcataaatcaggccatgaaattttgcttgttttgatcactgctttatcatcaatgcctagaacagttcctggcatatagtaggtacaatggtacaatagaagttcttgctttgaagacctagataacaagggattggagttagaagatgacctagcagttaattgagtgtgcttttgtactacaggaccctgtggtcaaattccatttcaaccacgtaacagtttcctcatctcagatagagacaagaatggtttctttgcagtgtggttgtgagaattaattaaggtaccatgcatgagatgccaagcccagtgcctggcatgtggtcagcaattcacccagtgttagctgttttaaggtggttatatcagtcagggttcttagctgcaagcaacagtacagtcacgaagtcagactgatttaagcagtaagataattattcaaaggatatcgtgaagctcagtgaatctctaggaaggctggggaaccaggctctgagtgaagactgatataaaaaaatcactctactgagtcagacagccagaatcatgcc

SEQ ID NO: 106547 - DNA, 1049 bp, Homo sapiens
atttttactacctaagccaaataatcttccgttggatggttatgccacagccaatagacatttgtattgcttccactcttttactattaggaagaaatgccactgtgaccatggatgtacaagtttttgtgtgtacatctattttcacttctcttgggtatttttttaggagtggaattgctgggttgtatggtaactttatgcttaacgtttgagaaactgcccaactgttttccaaagcagctacaccgtttcacattcccattatgtatgaatgagggttccattttctccatatccccatcagtcctagttattatctttttaattatagccattctagtgtatggaaagtggtctctcttgtggtttccattggcattcccctagtggctataatgatattgaacgtttattaatgtgtttattggccttttgtatatcttctttggagaaatgtcttttgccaattttaaaaaaatagcgttgcttgtctttttattattgagttttacatgttctccgtatattctggatacaaacatttttgacataggtacttggaattttattaggccttgacagcttctgggttaatgagaatatccttattgaagtctgagggaagaccaaaggataggctaagctacaaattgaccatatggacagcaacttggttgtgtcatttaaagatttctctgaacttgattctttatttttctgcaacttttaattgtgaaaaagtgtcaaaattacttaaatgaaacaacagcacaagaatacccttatacccttccccttcattcactgatcattaacattttgctctatttgctttcttgttctctctctgtccgtgtgtgtatactctttttcagagctcaatcatttataagtaatttgcagacattttgattcattagcctgaagaattttaggatgtataagctatgaaccaggatattctcctatgtaacaacaataccattttcacacccaagaaatattacattaattcaataatatctaatatagagtctatattcaaa

SEQ ID NO: 106548 - DNA, 1066 bp, Homo sapiens
tatcaactgaagacagtgagctaaatcagcattttagacattggagctcagatcctactcttcaggggcagaaaccatggccttttggttcagtgactctctgtagaaaagcagtacccacaagtagatgtttaaattgacaaatggatcctgatggggaagcagtgctgggggaaaggggcagatggtgtagagtatcagtctgtggtctcacttcttcttataactttacatctgctgccccaactctttgaaaaagaaaagcgcatcctcaggaattgtctcccagaaaatgagccacttgccttttagttgaggtctttggggtggatcaagggaggcctgaattggcttcctgggtctctcaattaccagcattttgaccttgagcaagtcacttaatctcttgttatctgtaaaatgggaagggtatattagatgtgaattaggctgatgtaagaaagcaaaagatgttacacagaacctggtgtacagtgggtatgactattgttgaagatggaggtaaagttggggaaaggaatgcaaacattgtgttcttcctacctaaaactctgaaatcctgcacgttgtcttgggataaccatttgattgcgtattagtggaggttgttcagagaaacaagaccaataggatatgtatacacacataaatgtgtagagaaagatatttattttaaggaattggctcatgtgattatggaggctggcaagtccgaaatctgcagaattagctagcaggctggagaaccagggaagagttgtagtttgagacaaagtggtctgctggcagaattccctcttcttaggaggaggtcagtctttctctttttaaggtcttcaatggattggatgaggccgatacacattatggaaaatagtatgctttactcaaagtccatcgatataaatgttaactcatcaaaaaaaaaataccttcacagagccatgtagcataatatttgaccaaatatctgggtaccgtggtctaggcaagttgacacataaaattaaccatcacagactgtgttgctgtcactgggtgacca

SEQ ID NO: 106549 - DNA, 1021 bp, Homo sapiens
accataaaaataacattgcaagccaaaactttgcaaaaaatcttaataagcagtaggaaaaaattaaatttttactgtgacctttaaaattttttttaaaccattaaaactttattactgttggttatacatgcatagggaaataagaaaaatagtaaaatgaatatttagtatactgcaatttaaaattagtaacactgaaaatcaaaatgttttatttctttgtaaaaaaatgtatcaagagtggttgaatagtgcttatctttctctttgtcatattatctgtgatacagagcaggcatgttttctataacttagcaaattgtcatacttctttttaagttgggattagcttccaacattttatgttttgtagtttgaatatcttgacgtttctctgagagtttaccagagggaatgacactgaccaaaaactctacgttaaagaaactcccagagaaatttcaagatattgaaatgtgacttcttgtcacaatcactttcctatttacatcggtaagtttgccttattacattcttctggctgcatagccaaaccctgttgactagtaatgtaatgtagatataacatctattatgttctatttaaatagaatagttattaaatagtcttaagaatagttatgttctatttagaagataaatagaattccataattctattttctatttgaatctcactctcagcatgatcactttttggtttttgcctgcactttaaattttggtggccaattcacttacttttaaaaaatgtcacataggtatatatcactgggaggcaaggaggcagcacagctacatgctttgctgtcagagagtgaaccaaataacagatatgcagtgaccaatcattgacagactttgaaaaaaggaaatgtgactgctcactgatcacaatacacatttgttatttttatttttatttttttgcgatagagtcttgctctttcccaggctggagtgcagttgcacgatcttggctcactgcaaactccgc

SEQ ID NO: 106550 - DNA, 2001 bp, Homo sapiens
agcgcaaatctagcagaggagggatgagaaacaggctcttctccatggttaataatgtcatatctatctttgggtagcatctgattacaaccgtgtctattatttaaaaggttctttaaaaaaacatgaccacaggggaaaatggagtggctgttctcttcctgccgtctgcagattatgttttaatcatgccgcatctaaagatgcagcgttttctcatgaaatttgtcaaaactaataaggcgattttctaacctatggtaaccccacttaagtaatttatgtaattacttaggacaacccaggcctgctctaggtttttaggccatgttattctttttctttattcccttcaagacctacttgggatgaaccaatacccctaggttaagcacttccactcgaatcttgtaaatgtatgtgcagctgcattttcaagggatgaaaacattgctgtttagacgttaggttcatttatatagaaggagattttaatgagaacagcttagagggcatgatacttttagggtctggggagagagttaaatgagagagaagcaagacctccttgaagctgccatagtcctagaaatctagactactaagctgtgaaggtatttagccaagcctggggtggtggaggggcaggggggcagagggttgttgggggagcttgcagggaagaaagcattcttgtcagactgtactctgtggaagcctggggccctacatgttccctgaatgggtaatgactcatggtggcataccaaaactcaaagcaagggtcagcaaactgtagcccgtttttgtaaataaagtttcattggaacacagccatgtgatttgtttcattatcatatgtggcagctattgcgttacagtggcaggactgagtagttgtaacagagaccatatgacctccagagttaaaaagatttactatctgaccctgaaaagaaagagtttgctaacccttgaactaaaaggctggattttcaacttataggccacaatttcccaagggcatccattgatgggcatcagtgtaatgaatctcctgaagttatatgcagaatattttatatgtgcacatgcccacataggattttctggcgagagagtgcatggattataataggttttccaacgtgtctatgatcctaagatgaagatccttaacttgaaaggatatgcaaattttaccccagtttacactcttgacttctgctttcccttgtattctttttttatcctaaactctttaggatcctgctaagtaattggtctgaaaaataaattatatctgaagtctaacaggaaagtattttattccataagaacagttttatcttaaccagggcctttcatgctagaaccttaaggtgtatgttatagggacagcatgagaaactagatcacggatggggtgggagagggggctgcatggccaggaaactgctggctggaggggtgtggaagtttgcatcctgcctaaggagacagtaagggcagttatcttcctggacaaataaggacataaaaccataacagtagcttctttttaacaatgtgtaaggcaatatgctgagcatgttatatgaaatatctgacttcatgctcaacatcccagcaaatggatgtctgtaatattagaacagtggccagcacaaagtatgcacaatgtaattgttagtgattatcctttatcatcctcagcctcaccattcccatttatcatttgaggaaattgaggctcagacttgttcaagatttcccagcacctaaataacaaaggaggaactggaagttgggtctgtcagtttcagagaaactggaagccaagtctgttcaattccaaagttttcaccttttaaaaaaccctattctgaccaactccacataccccagtatgtgagtcctctttcaaaaggcacccagaaaggctcctgtgatagtggtgttaagagacacatcttctcccacatttccaccttatctcac

SEQ ID NO: 106551 - DNA, 1103 bp, Homo sapiens
gttaactgatgtatcccaaggacctagaacagagcctggcagatagtgggttctcagtaatccttactgaattaatgagtgaagcatcatgtcttctcaagtgagagtgattttaatctcttattctcatttaacctggtgcactatcctgctttaggaggcactctataaggttttaattacatgatgaggctggggcaaattcctcctaaataaattgtgacttaacagcaccttcatgtgaacctcgcataattctttagtaatttctcttcttgagcctcctggatccatctggaaatcattccaacaaacatccatcctatataatagatcactattttcctttttaatatgattctggctccccagagcctgcagtcagcgtcaagttggatttcttatctctgttgcttcattaagagtgtacatatttggttgccaatgctacggtcctccacagtgcagtttgttgcaacaaaagaaagtgtttgccaaatgatttgtcagcatatgttataaagccacacaggcactctttatataactggaaaatactgatcccaattagtgacagatgaaagaccaagagggaaaggctgtgttgctttattcaaaggaacttaaggggttcatgcaaaggtgtaggggtggggtggagaggaagagggaaagagaggcagagaatagaaaaggagcagattgtgggtgatggaataacattttggaaccaaggaaacggggatttagcatcataggtgccagttatctgtcttcttgactcctagcattcttcaaggtaataacctttccaggccaactggtcttatgcattagctctttggaagacaaacattcttgggctttctgaaatgccagtgattggagctgacctccccaggagcaggagctcagcctttgtgtcatgctgagcccccaggtgggttggtgagctgtgatgcatgcacagttggggaaggaggccctaactcctgagcttggcagccatttgtgaactcagcagcttgtaatccttcctgcctttggaagtgactcacctacacatcgggagagcatgttaggcgagcctggcctcttctccg

SEQ ID NO: 106552 - DNA, 1038 bp, Homo sapiens
gccctaactctggatttcgaattcaggaagcctgaggaggtgccaggtaactgtgccaaacacacacacacacacacgcacacacacacacacacacatacagttctcatctcagacctgacacttcaaagcatggactttgaagtatctctctccatctgtgaaatgatgataatgatagtaccaaccacacagagctgttgagatggtggcataattcaaaccttgtgcttagcacagagcccagcgtagatgcggcttcagtttccattagctgatgttgccattttcatcgtcgccacctctgtcctagaaaccttgggctgttcttgactccttgttttgtctatttcttcctaattatccaatctactggccaaatccagatgatttcaaattttcttcagtttttctatagcctacccctccttttttgtattctcacctctctggctcatgccactatccatcttgcctagacaacaatcagcctcttcactgatcttgttgcttctccccttcctgacttttctccgaggtgcagccagagtgatttttttttattgtgttttatttttttgagacagagtctcactctgtttcccaggctggagtgcagtggcatgatctcggctcactgcaacctccgcctcccgggtttaagtgattcttctgcctcagcctccaaagtagctgggactacaggcacgcaccaccacgcccggctaatttttgtatttttagtagagacggggtttttgccatattggccaggctagtcttgaaatcctgacctcgtgatccaccagcctcggcctgccaaagtgctgggattacaggcgtgagccaccgcgcccagcccagagtgatctttcaaatgtacattgggtgctactccctggcttaaaatgctttattgcatttagggtaaaacgaacttcttcccacggtggccctgcctgctgtgatcctataggcgtcacctcatgccactttcttccctgctccctgtgtttgagccacagtgatctctgggca

SEQ ID NO: 106553 - DNA, 1027 bp, Homo sapiens
gttgtgatgtgatgcttggcatagtatgtggcacacggtaatcaggagttcagtgttggtctattaggacatctttggcacatttagcccttagaacagttgcagaggttgcatgtatcagtcatctgtctgaacattgtatgctttctaagtttaaaaaactgtcatgcccaaagttgaacttgggtacaccttacagttttttttctttctgtttaccagtaaaatctttctcaaacccaaagttcctgctattctcctattttatcaataggacaataataataataccaacagcagcagcaaatacttaaaatcatgcattgtactaagtattttactcatttcatgatcacattaaccctatgaagttcaaacttttatccccatttggtagattaagaaaaggaggtaaaacgagtttagttaacttgccgaaggttatacagctaataaattatggagtcagaattgaaacccagactgtctggttctggacccctgactcttaaccactaggtgaagaatttcccaagtagcaatctttttatcctttccacagttgaatctagcctgcccctttaagaagacagagacagtaatagttgagcatattcaaagcaaggtttcactctggccttggaaggaaatgaatcatgcttattccttgaatgctttttttttttttttttttttaaggcagagtttcactcttgttgcccaggctggagtgcaatggtgcaatctcggctcaccacaacctccacctcccggattcaagcaattctcctgcctcagcctcccaagtagctgggattacaggcatgcaccaccacgcctgcctaattttgtatatttagtagagacggggtttctccgtgttggtcaggctggtcttgaactcctgacctcaggtgatctgcccaccttagcctcccaaagtgctgggattacaggcatgagccaccatgcccagctttttttttttttttccttttcttttcctttttttttttttttttttttt

SEQ ID NO: 106554 - DNA, 1062 bp, Homo sapiens
tcacccctgtaatcccagcactttgggagatggaggtagcagatcatgaggtcaggagtttgagactagcctggccaacatggtgaaacctcctctactaaaaatataaaaattagctgggtgtggtggcaggtgcctgttataccagctactctggagtctgaggcagaagaattggttgaacctgggaggcggaggttgcagtgagccgagatagtgctacagcactccaccctgggtgacaaagcaagactccgtcttgaaaaaaaataaaataaatgtattacaataaaaatttaataagcttaaacaatagtaaatacaaataacaaaggtgatgtgtatagacaaggttgaaattgctacagtgattggtggtgggctacaagcagaagagatagcctcatggttgaatgcaaatggccaggatttgagaaatggtagttgatagatcttggtctagactggtcaaggaaaagacttcatcttcagactagaatggagggagccttgagtgcctactaggcccacacatcctcattgccaaagaacatctgcctctcgggagctgtgtgaccttatatacatcagtgtctccatttgccgatctagccaaatgggtatgggtaatagcaagatctacttcatagagctgtcataaggaataggtgattaacatgtgaagagcatttagcatactgcctgacacaaaccaagtgctcgctgagtgttagctgctagccaatttcaatcacagccaaggggaagctctgatccctccccatgttccatcccatcccaatttgatctcgcagtcctgtcttctctctgcccatgctgctcacctttccaaacagagagttctgctagaaaagtacccccttctgagagtgaggaaaagctttcttcagtggagagtatttgagtagctgcattgtcctgctgaaacatgccggccagctttcaagccagaaacacattgcccttaaccaagtttacaaaaccacaggttacctctttatgttttggcaaactgcatcaaatcaaaccctgaaagccaaa

SEQ ID NO: 106555 - DNA, 1072 bp, Homo sapiens
tgggaccacaggcacacgccactacacctggctaatttttgtattttttgtagagatggggttttgccatgttggccaggctggtcttgaactcctggcctcaagtgatctgccttccttggcctctcaaactgctgggattacaggtgtgagccaccatggctggcctcacccaggaataacttttagataattatttagtcacaaatcaaagcctcagtaaaagaaacatgtcaactgagcatgatggagagtgctccctttgataagtgatgtagctcagtgtgcttctcttctgaaagtaagagagatgcattctgggtcatttttttcctggtctcttgtggttctgagccgtttctcgatttctattctcaaagtccctattgaaggcctctgagcacgagatagaacatagaaagtaggggtcattggagaatttgaacacaagaagtggtattggataggaaaggaggcataattgcggatggagaagggagggcagagtgagaggttggggaaggtaaaaagacaaagaatgaaggaacagttctatacctggctgaatttctgtggcaactctaagcacagtgtacaacaagcctggcacaatgaactttttttgttacgttgaaccatggtagaagttcataaaagtagtagtagtagtagtaatagtaacagaaatggcagctaacttattattgggtgctgactatcaccctttaacatgctgtgttttaattggtttatctcatttaatcctcataacttgaagaggatgaaatttattatcctcattttcctattgagaaaacagaggcttaaggaaagagttagaaactcaaagttaaaagaagtaatcattaagttggaaaaggggatttgtaatatatacccttttctttttatgtgagatatctttaggtgctcgtttgagaccatctccatgagaaaattctcatccagatgagacagagatgtcatgaatgtgaaagtggaagatatcgtgaggtgggcttccactatttgggaaatattacattacagtgagtcaaagagagatcagaat

SEQ ID NO: 106556 - DNA, 1045 bp, Homo sapiens
cggctaatttttgtatttttagtagagatggggtttcaccatgttggccaggttggtcttgaactcctgacctcaggtgagccacccacctcggcctcccaaagtgctgggattataggcgtaagccactgcgcccggccttctctgacaatcttaacagcttccctgactacaaaggataagcctggagaggattattaatgccaaacatctgttttgctttttatggtcaggcttgtgctgagtctgtctgacacaatatttaatagtcacagaaaccctacaagggagatcagcttgtggttatcatttacagatggggagactaagatagtgatattgagaaatttgctgtgtgaccatgagcaagatactggacttctctgggccttaccttgtttatctgtaaaacaaagacattgagattaaatagcttccaccatccccattttctctaggcttgggacaaaataaaatcaaaaacactaaagccagacttaccatggcagtgggattgtctgggggtggaggtgttgatgttattgacaaggaagcaggcccatgcttttgtcattggtttaaaattccttgagccgagcctatggcatgttggaaacccagcactggcttggtttaacatccataaatgttaagacgctgagcctcatccaattttagcagtaacctgcttcagttccctaggaatgttaaaatgggaactgcgttagtggctctgaaagcctggccactgagcgtatgcttctgctcttccatgaaatgcagaggcgaattgtgaatgtactgaattataccaaggagattaatttcattttgttcttcccaataaaactcaccaaaatgacctgacttgtcccttattcttaaaaaatttccaaaaaggaaacaaaagaacttttggtggtcagtcttgttagatggaagttttattctcccaggcatgaaccaactgtcagaagacttattctgagcaggtttctaatctttttatattctctcatacatccccagcctggccctggatgct

SEQ ID NO: 106557 - DNA, 1030 bp, Homo sapiens
tgtgtgaaaatatctgtaggataaattcctagaggtagaattatggaatcaaatcatatatgcattttagttaggtaaatattgctaaatagaaaaaaattggttttcaaaaatgtatagacttatcaatttggattacaatacatggctggctaattttaaatggctaagcacttaacttcaacaaaccttttggaatctcatttaaaaattttttttattgtggtgaaatttacataactggaacaccatttttattcattattttcatttgtcaacttcacgttcttgcaaaaccactaaattggatttcatccgcttgtacttaagatagaaactattaaataattttatcctggcagagtctctatggaaataagacctagcatccttatcatagatagggaccaacatgctgtcaatgtgtaactcttgataatgcaatcagctactgagttttggtgttagcagactgtgaatttgtgttcaatgtgagtttgtgttctgccacaaggtcgggtggaatgaggcagaaggctgggtgttaaggatttcggtactggtctgttttgccccctcattttttcaacccatctttgggtcttgatttacacatctgtaaaagtcaaggggttaagtggattagggaataaaactcttccccctcacttttcccatcacaacctccagaaatgtttctttaaattaaaccttgaacccagtttggaaatgacaggataaatgtgcctggaagcatctgtttctctccactcccaccacaacactgctgtagtccaaacctccactacttcttgcctaaacaactgccctcacctcctaaatagttctctctacttctgcctttctcttcctctaatccatcccctgcaaagcagtcagatacaaagaaatggttcttatgaaacattgagcagatacaaaaatgttgataaaatatgtataaggcataaacaatggtgatataatggacacccctgagcctaccacctggctttaggaaaaagaacct

SEQ ID NO: 106558 - DNA, 1041 bp, Homo sapiens
taaataaaaaaattggaactgtattatagatgaatgccttcacaaatttagtaagtaaaagccatgtctacatttagatattttctcttaggttttcttccccttactgcccattctctggccacactggcaaccttgctgtgccccagacagaagggcatttgctacctcgtgggtagcatccctacctcagggcatttgcccttatgggtacctgccacagatatccatgaagtttgctccctcactgcccccgaggcctgtaaaataacactccattcactcactccctttccccttcctctcttttctgttttgtcatagcacttatcactacccgacatattatacttctggtagattgtttttcgttctgccttaaaattaattaatttagcctacacaagaatttaaacctcgtaagcatgtttacttccatgtctctttggttcaattctctagcacccagaaaaatcctgctgtttagcaaaaatcctgaatattttgaatgaatgaatacatgaatggatgacatgaaactgggaagtcataaaggaagatgaactattttgacatgaataacttgaaaattgtcaaaagtcaaaaaacattgagaaaattatttggagcgcctatgttatggagagacccaatttttaaaaaatatgaaaaacaactctaataaaaataaacattaaacagctcattagaaaattgggcaaagtatcctagcagacagatgtgtgagaaattatcatttgttgtcttaatgaagatgtaaccatttctaatgtttccatttatttgtgagtccaatctaaatatccattagataataggtgtagaatgatgaactctgtgttctgtgaatgatagcatctcttttcctagaaattatttatttgtttttaagatggggtcttgctatgttgcccaggctggtcttgaactcctgggctcaagcagtcctcccacctcagcttctcaaagtgctgggattacaggccacctcgcctggccttttcctagaaattattaaaa

SEQ ID NO: 106559 - DNA, 1141 bp, Homo sapiens
gtgaacgggagtgatgattcttgtctcatggactaaacttagaagaaatagagtggagggcctccttgtgtagaactttaggttcgaaaggaatgagacttctgatggaataatagattcatattgcacgttacacactcactttaggtgaaatggagtttgatagaattggaccctacaacctcacaatcgttttgcctgagtgaattatgcatatgatgtttataaaaacagtttgtaaactgtaacagaaaggtaactttcaaactctgcccctggggtcagtacataaaaaagggcctttcttagaccctgcgtcccaccaactggacaatggagattcatgtctgtgatgaaaaccacacatcatcaaggcaatacttaatcagtttccctctagcctgcttaataagtatgagtttttttgactcccgttgtgccacattaaacatttccatttacatggtcacaagtccctaagtagaagctccctcttctgaagcatgagagacatggatatttatataaaatttgaacctgagatcacactctggaaactcctgagattagatctggcctataggtgtattttgttagcattgcacaggctttaaattttaaattagtggccaacatttaagatattgtgtaaaaattcagatttgggctttctctggaaagatgacactatctggcaaaagtagcctaatatttcttcttttcctttaagatgagacgtgttcaacttttttacagtttccaccattccctattgtcttacacctggcctgccttgctcatttacattactcatcggccactgcagacatcagattttgtgactactgatttgaaagaaaccagtgagtgagtgtacatgactggaaggatgaaatgaatggtggggtggcataaagtcactacctggcaggggcagctgtgctaagcaagtcgtctcagcagctaagccctccctttctgggagatacagtaaaggaggagcagacattattgagggcctgctgtgtgcttgatttctttcaggaatcacttcatttcatactcaaaacagtttcctgaggcgtgtcttttatcttccactttttaagtatggggactcagggaggttaggtagcatgca

SEQ ID NO: 106560 - DNA, 1042 bp, Homo sapiens
gtttgatccatgcaacatattaaagaaggaggctttttctaacataaacccaggtttccggcttctgttgaaaaatccaaagaccaggtaacattagggctactttcctgcatttccgacagtatctggcaggagctgagtagttgccccttagatgggcgtgacctcagttcaccatcctctccagcaatctagttgagttcagggaactcttcaaatatttaggttacctgtcagggactggaagtgattgaagcttgcaaatcctgaatgagcaatctcatctcccccaaagagaaagtaagcttctctatcagctaccattttaaagcttgacaatgccaggaaagtgttttacatcttttccaccttatcattcatgacagccctagaaggtaagtgcagttatttacatccattttaacaggtaaggaaactgagtctcagaggagttaagtaatttgcctgtggttacacagccaactgcttaatggtattttgtccctatctgacttcagaagtctgtgttctgggccgggacttctgaaacttgcatacaaattactgagggctcttgttcaaaattcagattctgattctacagatttgaggtggggcctgagattttacatttctaccaagctttaagatgatgctgtgaagctggttgagggaccacactttgaatagcaaagctctagactggtgtcagtaaaatacagcctgctggcccaatgtgacccttttcctgttttgtatggctcatgagttacatttttagatggttggggaaaaaatcaaaagaagaatgtaatatttcacaacatatgaaaattacatgaaattcagattttggtacccagaaaaaagtgttatctgaacaaagtcatactcatttacttacatcttatctgtggctcagatatttaggttacctgtcagggactggaagtgattggagcttgcaaatcctgaatgagcaggttttcgtgctgcagtggcagacttaagtagctgcagccgagattgtatagcccagaaa

SEQ ID NO: 106561 - DNA, 1932 bp, Homo sapiens
aattgtgtcaaatttttattactagtgtcttcaaaatctcaaccagataaagaatagagctgacctcacctcatattcattcatccctttatttgatatcccaaaggactctccctaggactatgcaaacctttggatgctcgataaatgtttgcttaattggagaaattctaaaatatctagaattgacttcaaggtagactttgttaacaacaccaaaatggtggatagagacatcttcctttcttagccaggcctggacttgagcaaattttacgtttaacctcttcttctttcccctgcccttctctaaaccttcagcctcctctgcaggaacattggagacccgtcattacctctgtatgatctgaatttaagatcaaggtggcccttctcctggttgcatttgaagtcttctctataattgtgataattattttatcagtgagaggagatgtctgggggcagtggggcaggggtgggcgggtggggggacgcagaagctcatcagactctcaggaaatgagactggttggctgtgagacagctttggccactaggttctatttcgaagctttttttttttttttttttttttttttttttttttttttgccgttaagtatgaccatgtcgctgagttctggccagtacatgtgggtggaaatgacatgcaccacttccaggcctgacccatctcatgctcctccttccccttccctagccacaatgggaggccacctgctagacatggaagagccaccggatggaagaagcctgggtctctgaaatactgcttggagtagactactctgcctgcaaactaggagcactgattttggactttttgggaggtgaaagagaaatttttattacgtgaagccattgagtttggggaggagactggttatctgctacagcatctagaatgttaccttaaccagcacagtaaggaggcggggcactgcaaaagaacgttgaatgagatactctctgtgctgtgtgcgaaagcttgggcaggctgtgcaggaagttgggctgggttcagatcctgccttgccatttcctgcctgtgctattcttccaaaggctctgagccagcaattttaaaagtcttaaaagttgagacacccatcattgcctgatcactctcttctgaagaggttctgggagaatcagacctagaaagtaggtcaagggttctttgatttcagctctgttttaatatttttaccttggctacgagtttagagcaaaataaaaaaatgccctgcgggaacagcttttccagttctccttttgctgcctcttttttccttccttccatatcttaggatgaatgtggatacaggcagcctgaattcatggccagctctgccattttgatgtgtgtgacctcagccaagtgtcccggcctttctaggtctccatttccacatgtgtaaattgaagagaatatgaccttaccttgcccggttatgtgaattaaagatgtaatattaaaagatgagcacacaggaagccctcgggggatataacagaagcaggacagggctcccacttctattagtactattacttctaacctttactccctgattcgtgcttctcttcaacccttcattcagtaaccatttattgggtacctactatgtcccagggagtgaacaagaaggcaaagtttctgccctcttaaagtttgtcttctggcagagaggtaaatgtattttaagtgaacagaaataacataattgcaaattgtaatagataaaggaaataaacagtttgctgagatagagaacaagggctgaggggaaggtgagacatatgttgaatgtgacattcagggaaggtctccctgaggcggttacatttctatgagccctgaagactgagagacaatcagacagcagaagagctaaagggggcacc

SEQ ID NO: 106562 - DNA, 1693 bp, Homo sapiens
gcaggaggattacttgagtccaggattttgagaccagctgggcaacatagtgagactcccatttctgcaaaaaaaaaaaaaaaaaaaaaaaccatttttaattagctgggcttgatggtttgcacctgtagacccagctacttgggaggctgagatgggaggattgcttgcccaggaggtcaaggctgaagcaagccatgatcatgccattgcactccagcctcggtgacagagtgagactgtgactcagaaaaaataaaaataaaatctagagaaaataataagtgttaattttaaattctatatgtaaaaatttatcagttgcctattcttaacttgcagcatttgaggcagaaggtttatattttctggtttgtttatttcaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcacggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttcca

SEQ ID NO: 106563 - DNA, 1031 bp, Homo sapiens
atttcacactcaaaatgccgactcacgggtcagctgctgctgtctcctcttcccttcccaatttggtggtcatcatagctttagaaaagagcagtttgccaacctgtgcagttgggctgaagatgcaaactgaatgaatgacagctggagcacctccccctcctcctcccttcgaaacctccagaaggggtttgaggcaaccccacctgcagtgggggctgagaagatgccagtggaagcaccagatcccagaggcaccctgtagggttgcctgtctcctgtgcgctcagggcctgccacttgaaatgaataaataagctaatgaagtgggagctttctgcagcatagtcacacggtcagcgcttggtgtggaggtcaggggcctattgtgggctgcccccaggaactgctcgaacctctcctctcaatccctgtctttgcagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagcgtaagtagaagactgagcactcaaatctgaaagcccttggatctcaaccccgtcttaaacatgtcctgcctaacccgctctccttagtaactctacttccaggagaaaccctggagttagcaacttgaaatgggctaacagggatcaaagggacttctttctgtttaccaaagtggctttgtgcttagaacatgggctctgaagccagacagtctggatctgaaccctggttctgccacttcccaggtgaacaaccttgggcaagttgcataacctttgtgtctcagttttctcatctgcaaaactggtagttgtgaagatgaaatgagtttacacagattgagcatccctaatccagaaatccaaaatccaaaatgctataaaatccaaaca

SEQ ID NO: 106564 - DNA, 1218 bp, Homo sapiens
ccagagagaccgagtgcaacccatacaccagaccggagtcggaacgcgactgccaaggcccacggtgtcccctctacacttggagggcagaggaatggcaagaagtaagtagagccacaaaggggtacctgccaggcatttcacgtgtgcgccccttgctatcctcacatctgttccctataaagccagagaagtcaccgagcacggttacaatgctggctctttcccaaaaggttcactgtcagactcgcgcattcgctccaacaagggtgggagaacttcttgtttttaagcaattcctacgtctgtctgtattcctgagtgttccaagtctggccgcctcaaaaaaaaaaaaaaaaactttaacaggctgtgggccgaatgcattcagatatctttcacagaaggagggggagatagaaggaatattttaaatacgtgtctccagatttggtcattctgtatctgtttaaatagccgcagggcagactttaggtagaacctactctgtatttttcctctttctatgactttggctgtcaggtagaagataggcattcatgtgaaaccttgattaattagtgaaagatttctaacatttaaaaaaaaaaaaaaaggatggtatctgaagaaactgctccgttgatggtccgtgcagaagtggacaggccttgctttttccctggcttcaagttaatgtttggttaaggaaaacattgtgtccatggggaaaagtttggccagggaggttttataggaggtaacctctgtttccagaacagaagattaaactgtagaaaagggggggaaagaattagaaagcaaaacaatatccactgatgttggcataaaaaacaaaatgcatgctgcttgaggtgcagagataatgaaaaataaggcaggaaattccccaccatgaagagtttttcagaacataaagaaagggtatggtttggagaacagttagactgtacccctggcactgtgctgggtactttttgttcattgcttcccttaatctttttaaccaccagacaaggtgagcattattattattatcatcatcccattttgcaggtgaaaaaactgaggttcacagaatctgtgtcatttgtccaagtgtcacatacctagcacctagcaagtggaagaagcaagacttcatgctaagcttgttctcttaaaccattaagaaatactagaactgcattctttacc

SEQ ID NO: 106565 - DNA, 1057 bp, Homo sapiens
aatcctggaagaaagtatataaaactatttctaggttttcaagtatatattatgattccctaaacatcaaaagttcaatggagattctttctctctatggaaataagcatcaagttccccttttaagttggtgagttctgcatactagcattgcacagtggggagtagagagagatgaaacatagctcccagctcaggagttcagagtgaaaaacgtctactttgaaacctgcacgaatagactgtggtggtgggatgatggctgtggggggagcacattaatagaggccattcagatgttttcatctgcaaacgaactaaaaggtgtactgaacagaacaagaaaacttggatttacacacacatacacataccaccaccatcactgcctccggggtcacacagaggtctttctgctgctgttttattcatggggtgcctgcacaaatctctcagaattccaagcaagcctggctggctctctatgcaaactgttgcctcccttgagatagcacaggaagaaaagttgaacacagaaaactaactccgatggagtggacctcattttgagcaaagattactgtgaatgcattattcagaaaggcaggcttgtaccttgctgtgagcacttaagtcatgtagaaacttttgaatgtggtatttcaaagctggctttgcatcatgaaaatcagaagccagaatgacatatcgtataattgaactttcctgtgtcttaatttgtcttttgaaaaattatcaaacattgtaggaagtgattttttaaatgttggatacttatggctcttagtaccgtgccttcgttgaaccataagtaattttttcaattacaatagcttcaaaaagaggtttcatttatttagtagcctgaatagtcttatacattctaaaagtctttaaatatgttttcatttttctttaggttattaaaacattatgagattctgcatatagttgagtcctataccaaactcaaatttgtttacaatattctttctgtatttgtatttggatatattgttccagaaacgtgctcttt

SEQ ID NO: 106566 - DNA, 1102 bp, Homo sapiens
agtgatattgggtacagttactactattctcccatcttacagagaacaaatctgagctgagagatgaagtcacttgcccctagtggcaccttggtaaaatgacaggtagggtaggattccagcccaggcctgtctgactctcaaacctttgcaacattttaaagcaaaatgaagacaagcaccctccccaccaccccagctgccatttcctgtgttggcagcacccaagcaccccttggaatttgctctttgctggtgctttggaacaagaggttgttacactcttgcttaggggtgagaaagaatcagagtgtgtggttagctgtggtttttgaacaacaccataacctagccccaggcccccattgcgacgggagccaaatagcattctgtgctagggacagaagattcttcagcctgcattttctccttccctgctgtgtgaccttgggcacaacatctctccttttctctagtcttgaatttgtaaaataaatagatggacagaataatctttgagatgccctgcagattgagcattcaagagatttttccttggtgaattgccagggggccaaaatttacaacctgcagccttcccttcttgaccgtgtaaagagcattcacccatcaatggaaatagtaatctactatgtggcatctggcaggcctcaacgagttaataaaccctgaaaaatgtccaagagaaaagtagggtagcttcagtcaaggggaaatgtggccctttatttatgggattgtatgtttgctttttatagtgtctttcttcacaggcactaaaggtgttgtgagaaaaggcattaaagtcagagctattaacattgcgtagctactctcttcgtgggagactgaggaatcaggcaactctaaaagtcttaagagacatttcctgaggtccttgctttctgttgttgccatgggtaagtagaggtgagcaactggttgtcttaaccaggccatttttccagtgtagcttaaggattaaagtggttggggtgtgtgtgtggggaggggggcggtgtgtgtgtgtcttgccctgtcaaccaggctggagtgcagtagcacagtcatagctcactaa

SEQ ID NO: 106567 - DNA, 1036 bp, Homo sapiens
cgtagaagagtaggtgagaattagattaaattaaattagagcttaattaaattaattaaaaggaggtttagggaagtctccattaagaaagtgacatttgagcaaacataggggaaaatacaaaaggaagccatgtaagtatctgggagaagagtattacaggttaaggcctgaaagcgggagtacaccaggcatctcttagtgataccaaagagactaatgtggctagaacagaggatgtgaatgataggataggaaattacagatgaaactgagggagacgaacatggaggcagactgttgggcaagtagaggaaggagggttagcctattggacggagtttttgttttcactttgagataggaagggactggcagtgaaaacgtgggtggaggcactaagcaggaacatgaatttgtttttaaaggttgactctggcttctggatttagcagagggtacaggaggaacacacatggaagtggtaagaccattgtagtaactcagatgagagaaagcattgctcagatgacagtggtcacaagggaagtggtaaggagtggtaggatttggaagaatttttgagatagtgccaaaggattagctgagagttgactatggggtgcaagagtcagaaaggggtcacaatgactcccgttttatggactggacaagtgaaaggatggagttgccaccgattaaaatggggaagcctacaggaagaacagatttgtggaggaagagcaggacttctgttttgaacatgttaagtttgagatgtgtaggcgtcatcacttcatatctctgttaaacagaattgaatatagatgtttgcagtggttaagcatcctgccaaaaataacaaagaaagatatttccagtcagaccaggtctgactgtcctaacaccgtattcatagccactacacccttctgcctcaatcttttgatttccatctgaatacatctcagagtagtgtaggaatcatttgaatttgcagaaaaccatcaaatgtaattttagcctttttcaatgc

SEQ ID NO: 106568 - DNA, 1045 bp, Homo sapiens
ttttctatagatgggggcttcctaacccttttagctggagcccctgacttcattgagcggatgttcagcaggccctttacaactcccatcaacaaagaatctctgtgtgccctgacctcaccaagtcaatttgaatcaattcagttttgagaacttgctgaaggactttctgagaaccttagtataattcaatagttctcaattgggaggtgattttagcctgcggtggacatttggcaatgtctggagacagttttggttgttacaatggggatgcaggtgctatgggcatctagtgggtagaggccaggaatgctgcttaatagtctacaatgcacagcacaaccccaacaacaaagaattggcttaccccaaatctggaaatagtgccaccattgagacatttggagcctcattcaaaagcgaaagctgaaagtcacagttgcaagtcccgcagctatctgaaagctcttctctctggagagttgaatttcccataaaatgtaggtgagattccagggagccatcaaggtcagtcaaatcgaagaaaggttttcaaggatgagctgaaaatatgagatctcaaacttgtctcaccagactgtgaatctgcaaatcaacaagcaccatcactcattttgtggggcggggttgagggttaaaagaggtggcagatattgtaaatgtgtgcagatgtgcccaactgaccaacagacattctgcatggcaactttgacaagagtaataaactaaaaacagcataaatgtgggtgggcatttctaagaaaacaagggttatatcctcatcatgttcataatgttagcattgtctgatagcactgatagttcatatatagagattcctttttaagtttatgtttcaaacagagcttcccatatcagtgatagaatatgaatatatgaataggtcagcagtatctagggattggtcagacttgagcatcagagttgagtatataggtttctcttttgagaactcttctggaagtaggattaattctagtgagcattttacctgataatt

SEQ ID NO: 106569 - DNA, 1563 bp, Homo sapiens
gactgaccttgatggctccctggaatctcacctacattttatgggaaattcaactctccagagagaagagctttcagatagctgcgggacttgcaactgtgactttcagctttcgcttttgaatgaggctccaaatgtctcaatggtggcactatttccagatttggggtaagccaattctttgttgttggggttgtgctgtgcattgtagactattaagcagcattcctggcctctacccactagatgcccatagcacctgcatccccattgtaacaaccaaaactgtctccagacattgccaaatgtccaccgcaggctaaaatcacctcccaattgagaactattgaattatactaaggttctcagaaagtccttcagcaagttctcaaaactgaattgattcaaattgacttggtgaggtcagggcacacagagattctttgttgatgggagttgtaaagggcctgctgaacatccgctcaatgaagtcaggggctccagctaaaagggttaggaagcccccatctatagaaaacgtgccgtgtacaacgtgaaatcaattcccatgcacaacaatgaagatcccaattacaatgaacaaacacgttcttctgaacagaacttcctccctgacattatgtccatgaccctgcaccctgcggggggctcggatatgttacgtctgattcaaagacaaccaaaaagaaggaaataatgatttcaccaagaaaggacacataccaaggcaggaataggtaagtgggctaggtggggcttttattaatctcaaggaaaacaaacagcacacatttttgggaaaatgctttcattttcaaaggaatctggatgtggactggatagcagtcgattaagaaaaggcagagtctgcatatggccagatatttactggaatttactaggaagagatgcaataaaagtctagattcccctgggaaaagggaagcaaaaaaaatgcaccattctcagaggcctttcagtttagctgcatgggtgggatggggaggagggaggaggagagaaggcttaggaaagagaaaatcatgggaaaaggccaataaaaaagtaggaaagattctgtttctgctgagctctgccacaccccactcccttttttatcacattacagtgcaaatctcagattaaaaacagcttcctagaatgtgtcagaatttttaaagttgtgaaataaatccagatctactctttacttccttgtgaaggaaaaaacacactctgaatacatttgtttctttaagaaattttataaagtaacttattttgaaaattttccaacttatagaaagattgcaagaacatcataaagatctcccttatcccctcatcctgagtccccaattgccaacatttcaccacatttgctccccccatctctctctctatatgctattattattttgtctttccctgaaaaatttgagagtaatttagagacataacatcccatcatctctaaaactcttttttcctcaaatcaaggacactcttttatgtaaataccgtacaactctctaagtcagg

SEQ ID NO: 106570 - DNA, 1127 bp, Homo sapiens
ggcctgctttggaagtcacattaggcatttatggaacccctgtagagggcctgaggcacaccagaagagaagacacatttctgccctccaggtgtgtctataggatgtgtacatgaaacagccccacagtggggaagttcttgggttttcctgattgctttttgtccttcgtggatgacttgagaatgcttttcagcacatttgtcttaacctttcaaccagctgcttctgtgtccctaagatggagattgaggtggggattaacttgtcgactgatgtgtttagtgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagaggtgagagtgaactatccgtctataaatacagaggaattgtgttaaccaaactgtatttatcattcagattttattttcaaggagaagaactagctctagtagaagcttctggggtggggattaactaggaaacctgtcttcttaaattctggactattttaaagtgttcctattaccactaagagacagtttgggtacacaggtgaggaaaattaggtgagaatacagataaatactggtttaagttatttgttcacctctgatgattaaaaaatagatgcttttaaagtgattgaaaatatgtgttaaatcggtccatggaagtcttgccctcttcttcatagttttggggtgtttgtgttatgccctgttcccatggcataatgtctcccaacattccaagtcactaatgaagccagattgagtaggtgttataattcctatgaaagatgatgtatttttattgcagaagtgagtagttagctgtgttttctcaaatatggaattatttagctgctaccttttcagggttgcctgtgacgactgataggggacaactgagtattggaagctgagaaaaccgtgtcctgttctcagctctggctcttaaaagttttgtgaccttggcaaataatgtagtatctttgccaaatatttatatcctcatctgtaaataagga

SEQ ID NO: 106571 - DNA, 1079 bp, Homo sapiens
atccatctgtccatccgtcagttcatcttctctaagatccatctgcctactcaccagatatttgtgaaagcttgctagagaaagagcagtgaagaatgaataataaagcccctaccttcatggagattattccaatggatgatccagtcaatgaacaaataaggaagtatgtaatatagcaagaggtactgataagtcctagaaagaggtcaagaggagaagtggaatagagaaagatgggatgtgcttttagagagggtggtcaaaaaaggcctgacattgagcaggacctgaatgaagtgagggaatgacacacatgggaatttaagtggtacagcaaaaggtgcagtaggtatgaagtccctcagatggaagtgttcttggcttgttcaggaagcatcagtaaggccagcatagctggagtgcagtgagtggcgaatggtagatgggtcaaaggggtagtcagtggccacatcataaagggtctagtagatcaatgtaaggattttgggtattattcaaatgagttggaaaatcactggaaggaaggataggatttgacttttgttgtaaagggttatattttgtgattttgaatactgagctgacagatttctcactgaaatggatatgggatgggaaaaaaagaggagacaagggtgattccaaggtttttggcctgagcaatttgggaaagtggtgggccatttacagaaatgcacattcaggaattgtcaacccctccaccaaatgactgaccctttctctttctgaacattcaacctagtgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcagtgagtattccctgaagtttgc

SEQ ID NO: 106572 - DNA, 1780 bp, Homo sapiens
gtgttgtcttcggctatggtgttagggtaatactggcctcatagaataagttaggatgtgttctcctattctttgatttttttttttctgaaagcatttgaaagggattggtattaatgtttatttaaatgtttggtaaaattcatgagtgaactggtacaaactttttgaggaagactttgattaatgattcagtcattttacttcttatatgtccgttcatattttttatttcttcttgagtcagtttttgtgatttgtctgtttctaggcaatctgcgtaagttggcatgttttatctagattctctaatatattggcatcacttttattgctgtaaggtcagtagacatgttccctccttcatttctgatattcagtaattggagtcttttctcattttttcttagtcgtgctagctaaaggtttatcaattttgttgatcttttcaaaaaatcaatttctggttctgttgatttttttctattattcttctactctgtatttcatttatctccattctaatctttattatttccttccttttcttgttttttttttttttttttggttttagtttgctgttaattttgtagttccttaggaagtaaagttaggttgtggatttgagatctttcttcattttttttttttctttattagtgtaggtgtttgcaactatagatttcctgtgaacattgctttcattgcatctcacaaattttcttatattctgctttcattttaatttatctcaaagtattttctaatatcccttatgatttctgttttgacctatgggttaagaatatgtagttcagttttcacatatttgtgaattttctagtttttcttctattaccgatttcttgcctcactccattgtgcttgtgggatctcattcttttaaaacatattgagacttgttttgcagcctaacgtatggtctctctttaaaaaagatccctgcacgtttgagaggaatatgtagtgtggtaggtgggtaatcagaaatgccaaaattgagtggcttctttttttattaagcattcacctagtttctgcaaggttttgtttaaattccacagttccaaaaagttgattccagtttttgccagcttaacagttgcttcagtggagggaccaattcttggagctccctagtctgccatttctgtggcatcacttcctctacttactgtttttagtctgctttttataatctaacattttgccttttagtggctacattattttcctaactacctgtatgctgtgatattgaacttttggttgttgcatactttggtggtgtccagtttttttgtctcttataaaaatattgatgcaaactccagttatttcttcaggataatttcctagaagtcaaataaagtcacagagctctattaagtacctattttagccacagcactctgctaggtagtgtgaaagatgtaaaaatgatggagatgcagtctgctccttctaggagttcacagttaatgagttgaacccctataaatatcatttcaatgggaggcagaaataattccaagggtcatcataataatgaatcagtataatttgtacagagcaggattgcccacttcgacctagtttatttgagcgccagccctctggcctactgtgatggaagtatttctctcttgcagaatgttatggggaaagtaagggaaagagaagatttgctgaattgtatataccttttgtcctccttcttccagtgcagtgtcacttgtggacagggataccagct

SEQ ID NO: 106573 - DNA, 1072 bp, Homo sapiens
ctgtaaagaaccaggctgcacagcaacagttgagtggtggataagcattaccgcctgagctccacctcctgtcagatcagcagcagcattggattctcaggagtgcaaaccgtattgtgaactgtgagatctaggttgtgaactccttatgagaatctaatgtctaatgatctgaggtggaacagtttcatcccaaaaccacccccacccaccccatctgtggaagatgtcttccatgaaactggtcctgggtgcccaaaagtctggggaccactgaactaagcatttgttccccaccccactcttccctcagtccctggcaaccaccagtctgcattgtgtttatggatttacgtattctggacatttcatagaaatggaatcatgcaatttgtggccttttgtgcctaacttctttcacataccgcagtgttttctagattcatctatattgtagcatgtatcagtacttggccaaagaatattccattgtatggctataccaaaatttgtttatccatttatccctcaatggccatttcggttgtttctacctttggctattgtgaatagtgctgctatgaatatttatttcaggcatttatttcagtacctggcttcacttcttttggatgtgtatctaggattggagttgctgaatcataccgtaattctgagtttaactttttttttttttttttttttttttgagacagagtctcactctgtcgcccaggctggtgtgcagtggcgccatctcggctcatggcaacctctgcctcctgggttcaagcgattctcctgcctcagcctcctgagtagctgggattacaggtgcgtgccaccatgcccagctaattttttgtatttttagtagagacggggtttcaccgtgttagccaagatggtctctatctcctgacctcgtgatctgccctctttggtctcccaaaatgctgggattacaggcctaagacaccgtgcccggctctgggtttaactttttaactaccaaatgatgttctacagcaaccgcataattttgcatttttattatcatataatacaaggg

SEQ ID NO: 106574 - DNA, 1051 bp, Homo sapiens
catcaccttccctcctctttgagccctagctaagtcactgaaaggaaatcatggatttattaatcataaagctatactagctcacatctgaagtcaacatgaagtttcctacttccttgtctttgaaataagagaattagaccccagggagtgacctctctgacttacccatccaactgcaagaaaaaaaaataaaactcggaaaaaaaaaaaaagaaaagaaatggaccagactgagtattccagatttatgcctttctcatcctttactttatgaagcacaaggcaaaccctccattgcttagcacagatggtcccaggacaacaagagaaagaagatgcagcctctttcttgcttttatgatatagtattagcactcactattaacacagcccagtgttaacacagcccaaggagattcttaccaagcagggactcactccacgttccttaaggggaagaagggaaataagaaatacgaaacagaagtttcctttttaatgggccaaatcaggaatatggggaaagaaaaagtctccctgctacagctcctacatccatgctcttatcccatccttataagtgcagtattaactgcttattttcaccatcaaataaatctgaaaaggatactcttaatgcccctgaaatggcagtcaattaacagtgtatttgattaacagtgtctgattcctggacaaatgaactgcaaacctagtgctttagttctaggttaacaaattgcctttgcttaaaaatctctagtatttggttaaaaaaagataagtagtaggtttaaattttacttagatagctaatactaaagtataatttcaaactaagtaacaaacctttgcaataatatgcgataaaatgggggttgggagatcaaactgtaaattcactataatccaaagttgcttaaaaagactggaaagaaaataataaaatattgataatggttatccttgggtagcgagattttgggtcattataattttttcatttatgtttttctacagttttcaaattttctacagtaagtatgga

SEQ ID NO: 106575 - DNA, 1037 bp, Homo sapiens
cagggccaccatgttcgtatctctttagaagaaaaagtagccatttctgtgatacttatttgtctccagtacacttagctcttgattaattgtggcaatgggaagatgggaatcgatgcagtgcaagataaaataggatttttttttttcatctgatgattttaaggatgtctggggccaaaccatttatcacggcagatcgtaagaggaatccgatatcatttgtgctcctctctttctccctactcacatctactggaataaagaatatgcatggaagggtgaaatgccctgagtcagcaaagcatgaaaggaaacctggagacattggaaaagaccccccaaattaacccagaatagactatcactctttgcatatgaccacactggattatcacttgatttacagaaccggcatctgactttttatttcctcctttttatcaagacatcagctgggtagctagcatgcaacttcatttgaaagaactgggtgattttgttgacagcacatcatactgtcaccatttgaatgacccgcattagggagcagcctcaggatgcccaaggtgccacggaaacaaccttggcttcagtgacccattgaaactcctgcctctttcatggctgatgggtctcgcgctgcaggagctgcaggcaagacgaggttgtcagaggtttacactgactgagaaagagtcatttggctggaagcactctatcctccttgtcatgagtgtcagactccatcaatcacttattctttcagcatcatcgattgagcacctactatgggttgggatctttcttgggcttataaaagtaaatttgtattttatcatcttatatatttaaggggtaggactacaggtttcttacgtgcatatattgggtagtggtgaagtctgagcttttagagtacccattacccaaataatgagcattgtacccaataggtagtttttcaacccttatcctccttttatcctcccacctttggtactctccaatgtctattagtcaaaaaagtggatttt

SEQ ID NO: 106576 - DNA, 1042 bp, Homo sapiens
attcccaaggcaggctcaggatgcttttggagaagaactgtgcagagaaaatgatagatccatttttagttgttttagaaaagtggccatgtctagcagcttttattaaagatgtggatatatataaatatcctgaagagtatttacacattctagaaatgccaaagaaggtgaatatattggcatagaaattctctgagtgttttgctttgtttctttttcatagagttgccagtatgtgccttttctctatatgctagcacattctgcctcccttggctgctgggttaatgttttttctttctttttcttctttctgttctgctcctgcagcagtaatctgtcttgggctgctgacacaatgttattttgatgaatgactcactaatgtctctttattttctccactctcttaagtccattagcattttccttttaaacttatttgtgagtctgaggtttgaaactcttttgtttcaagtttcatttggacaaaatcaacctccaagtccccattccaacctcttaaaaagatacatttctataaaatattatttaaatggttttggacattttaaataaaggctgactttattttggctcttatttcaccagccacttaatgttttgttataatgtaatagtaattttgctatgtgattattatttgtagaatttgcctggtaaaatagattatcttggtgcatgtttcccaaacagacccccttcccagcatctgtcatatcagacacttttcatattcctctgaagttcttcctttcttttggacacctgtcaatggtcatattactgagaaatatttaatttccatatcagttttgaattagaagttttcttttaaaaagcaactatgaggacatttgagtgcagtgctagatggtagcgctctgataaacctacccccttgttttgttccaatgtttatagtaatgcttaatgagaagagtggtcatttggaatttgctcttgtgtggaagtaaaatctatagaataaagagatccagaaactgaagtctgaagt

SEQ ID NO: 106577 - DNA, 1895 bp, Homo sapiens
gccctgaaatagagctaaatatagcaaatggaatagatctaaaaaacagagtgtttagaggaggaagaaagcaagttgtaggatatgtcagtatggtgcagttgtaaagcttaaatgctgtctattactggagatttatatgcatttgtagtaaaagtgttggaaatgatgaagtgatgaacactactcaggactgtggtcacttctggtaggaaaaggaagggaaaggaacctaggatgagtacatagggccttcagctgtgtctgtgaagttttctttccttagcttggtggtgggtacatgggtatccattaccagggatagaaatgtgttttatgggctgctgtctatattttagcatttatcataccaagaaaagaatttccttccccacttaccctatgtcattggtgaaacattagttgaaagcaagctttgctttgtttgatactgccaaataaatcacttgtcactcaattgccatttcattgaattgagcagatgcagtgcagacggctctggtgcaataacgtcaatggagtacacaaaggctgccggactcagcacacaccctgggccgatgggacggagtgcgagcctggaaaggcaagtaatgccctgttctgtccttctgtcttagggcagaaatgtgcaagattttgggtgtatgatcagacaccgatgtttagaatataagacaatgcagtctgttttagcttgcataatattttttagaggacagatgtttagaagttagacaattaaaaattgtgaaacttagattatagcataatgctgataccagagaatatacctatcattattgcttcaatattaagacattctgtcaacttaagactttctctcatttaaacatttctaaaattacagtgtgcctatgggaacatttaatgcgagattgtgtttctttttcttctcttttggggatggcactggaaagctattggtaagttgatggaacagtttagaatcaaggaaatgtagaaatatagtacatctattgcaggtactactatgataccaggcttttgccaaccggtgttgttccctttaaggagctataatgtcattcaggatatatccaaatccaagttctcgtgagctggttataattgttcctactgatttgttaatagataaacaaaatctgctacttttgtggcccaatggtaacagtgtctcatgcacctaggagtatgattaacttaaccttctgtacctagtgtgcatctagaaaaattggtgacatgttagtgataccatcatcagcccaaaaatttggtaacaaaaagttttagatataaatcttgatttaaaaaaaaaatacacatggaaattggcattctatctgtaacttaccaaggatacaatctctgaatgatatttctgagtgttttgttatccttatatatatttttcccttttttccctcctctttccattgtccactttacttacttttaataatttattctcatctcatttccttttcctccgctttaccttatagaattggtagcacccagaatgtttctgtggaagaagtcctaagagatgatggaacttaattccctgttccctgatcttatagacaagaaacttctcagtttcttgtctcacaatgagtaacttgtccacagtcactcagatcatttggtgcagcccctccccaccctcatttcctctactgctttgtctgaaggggcagcagggcctactggagtggccctaactgaagctcactgagctcctatagtttctgctggtcaaagaggaagactagtggttttttcagtgttaaaggatcctgaggatatgaaagtttaaaaatataaagtccaatgcgaaaataaaaacttataatgaagatact

SEQ ID NO: 106578 - DNA, 1038 bp, Homo sapiens
ggtgtgaattttccgggagaggtgtttgctgaaaacggaaagaaccagagggttgctgttgttctttttaaccagatggtgtaaggtgttttctttctatgagtcattgattcgctcacgcatcccttcagcaaacatttactaatcacctgttgtcatggacagggccctgtgctttgatgaaaaagacactatctttgcccttagaaagcttacagtctattgggaaagatagtcaaacataaacagataattgctgtgaagtgtgatcaacgttgtaacaggtgtatatttcctactggctatgttgtattcattgcatgtggttctacaaagtaaacagcaaaaatgtaacttcagcatctggatttaatcttggatgtaaagaataaagcacatgttaaaaagtaactgtcctctctaccattacaatggtggggtggcctttactgttacctgggggagaccttgacagccaccgttctcaccatctgtgtgtttctgtgtgtttccgtagcactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatggtaagtgtaggagggccacttctgccctcatctactgattctgcacttctttttattcatagttttccattgcattctaactcgactataaactacccaaggaaaagctgagagtaaaattgcatattagtgatcataataattatgaggatgacacaacagtactgctgctcagtgttaaatagtgctttacctgcactttctcatttcatcctcgtgacagtccaaaaggaagatgccatcatcactttcattttacaagtgaaagtgaggctcagaggcagcaaggttacggagttgggaattacagagctcagcttttttctctccttgttgcctttaatgcccttcgacttgtccaggtgacctaaattatagg

SEQ ID NO: 106579 - DNA, 1022 bp, Homo sapiens
ctgtattacacattgctgtttttttgaacgattcgagatgggtccagaaaagcccgtatagacttcctctttctcattttcagccgtagcataacttttcttttaatagacgagccctgatttacctgaactgaaacttatttttaataaatcccccagatgaatgtgaaaagcaatcctgtttgggcatagctttagggtttcttcttccccccttgtggcctatggtactccttgcctttttgttcactgctgtgacccattcccctctgcgccccccaaccctgcctggcctccgtgcccctctcacccccacatgccgctcagtcccagatactccagccctctcatgcccatgagggaagggaacatctaatcaggccctgcgcatatgcacagcctcattttcacctcttaatttcagttctctcctaagaattttgattatgaacatggactttgggtcaaactgccctaggttgagagttctggctcttctactcaccagtgtgtagcctcagacaagtgacttaatttctctgagtgacttagtttcctcatttgttgaacagaaattttaatagtacccagcccagagttttgctgtatagagactaaatgcatttgtgtatttagttttcagcccagagtttcgctgtgtagagactaaatgcatgtgtgtatgcagttttcagccagctcacaataagcatttagtaaatgttagctcctataattaattataatactgcaaaaataaaaaccccaccaggttaacgaggttgtcaaggacacaatgggtggcaaacattaaagaatagcagtgtcggctaacgtgcacccaatgtgagattctataagttggcaatccaggacttcagatgagaggaaagagcttgatggaaaattaatatccagtgttctggtacagagaactgttaagtcacgtggcaatgcaatttcagaggaatttaaatttgtttgaattcactgttatctaaaactgtgatctatgaatttta

SEQ ID NO: 106580 - DNA, 3055 bp, Homo sapiens
tacttcttcattgtacaattctgttgcctattttagaccacaaactggtggcattaaagcattaaagcacatttatgatctgattgtcaagttaactgatgaaattctgtttttactcaaagtatattttggcaggcactttaatgcttattctgtttattgcatagttgatgatgcaaaaattcagtattttcatcagtaatataaacttcaagccaagttggaaactagtgattctcaaaatttcagtgttaatatcagtcacctggggatctagttaagtttagattcaggcctggggtggggccaaagaatctgcattttaacaagcttctaattgtcaattttgctggtccacggaccctactctgagcagcaagactgtggagaacccaagaagaggcctaggcatgagctggaaatgagtagagctaatctgacattataaatcatggtcccagctgcctgcccagactctcggagtttaatttatttccttaactgagccctggagtaagttaattaaaaattcagagacattgaattgctgtgattctaatattttaagtattgaaatgatctaataatgtaataaaatacctggttgtgcattttctacagttcctctgtatcgtctgttagcctgtccacttctcagacctctttgtattagaactcattgaatagcaggagtgatatatatgaaacatttcctttttttttttttttttttgtttgagacagagtatccctttgtctcacccaggctggagtgcagtagcacaatctaaactcacgtcaggctctgcctcctgggttcaagcaattctcgtgcgtcagcctcctgagtagttgggattacagacgtgtaccagcatgcctggctaatttttgtatttttggtaaggacagggcttcgacacgttggccagtctggtctcaaactcctggcctcatgaaattcacctgcctcggcctcccaaagtgctgggattacaggcatgggccaccgtgcccagcctccatttaagtttttcagagctctgtagctacgttactggcccttactatatctatggcaaataacagtgagcgtgagattccttgaatcaatcccagcaaagcttttgttaacaaatgaataagaatcacgtgcaattgtttcccttaagctcgggcctgattttctaataccgtaagcgagcaagtatgaaagcttcccagggaagctaatctcaaatccttagtcacttaggtgggagtacggattgaggtgcatctgtagagtccatggaggacttgtttttgtatgtagtttgaccacagagggatcaatttaaaatgtgtcaaattaaattcttaatataaaatagatgtggcttgaaatgtaatgcataccatctgatttgttacagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtaagtacattcaaacgaaggtgatttatgaggtctctaaatgtgccattggggaatgggtttccactcagtgctttggaggaccattcagaactggcatttcagccattcaggcaagtgactgaagagaacataagattatttgttggttgcctttttaaactgacaacagtggttatcaatacggagtgtttattctgtgttagacaatgtgcttcttacttaaaaggtataattttgaatccttctggcaacgctgccaggtgagattatcaatcatgcccattttatagataagaaaactgagtctcagaggagttaggtcacttgcccatggtcaggtaaatcactcataaatcacttggacgctgcctgtggcctttagcttgtccagttccgaaaaccaatgctttttgcctcacttaggaactttgtacagccagttgtggatattcagtagtattagggaggctggttgtgaaccatagtcacctgtggaacttctaaaaatagcctcttccccaggattctaattaagtagcctggggagtgaggcctaggaggctttcattctatttttctactcccattttgaattaaaaccacagtaaatttgcacgattttttaaaaatcagaaccaaagtctattgttaaaaactaagtatcattctctatgcagacttccaggccccttcccagtggcagccactgttgaaagtttttgtatatgtttctaacaagcactgcccaatagaaacataatgcaaaccacatatttaatttcaaatgtatttaaattaaaaaaaattcctaattttaaattttcatgtagccacattaaaagaaaaagtttttaagaaaatggccaagtgcagtcactcatgcctgtaatcccaacactttaggaggctgaggtgggataatctgaggcccagagtttaagaccagcctgggcattatagcaagacctggtctctattaaaaaaaaaaaccaattagccaggtgtagtggcatatacctatagtaggctcaggtgctcgggagctgaggtgagagaatctcttgagcccaggagtttgaggctacagtgagccttgattgcgccactgtgcatcagccttggagacagagtgagaccctgcctcaaaaagaaaaagtaaaatataaacaggtaaaattaattttagcaatatgttttatatcaaatattattttaaaaattattaatgagatatttcacattttttatactaaggcttcaaaatccagtgtgttttacactctcagcatacctcaatttgagctagccacgtactagtgctcactagccacttgtgatgggtggcca

SEQ ID NO: 106581 - DNA, 1062 bp, Homo sapiens
aacaggtccaggggagcctctgcataggtaagaatgcaactgtgttgttttgcatgtatgttgcatgtgtgtatgtgcatgcagacaggagagaaagagagagccagagggacaatgagactgagacagagacagaggtagaagagtttggtattaatagtatgagattcagtccttatgaccacatgccctgctgctgaagagggatagaatatataactccataaatcctgaaagcttccattctgtgctttgtggacaatttaaatgcttttccagcggtatctttgattgtatacttttttttctttcaagccagtttcctaattcttacatttcatgttatttcattgtaacaagtcagattagagaaaatagaagtggtttttcagaaactattatctgttttagcaggtccgaaataaaattttcccagtgagtaatggagatgtgtagactgtactccccttaatataatttaacatcagcaaaagtccactccttttgtgttgttctctctcttttggagttattctgtcttattctaccctgccaccctgctgactgtttcatccatacactttctgacagtgacagtggctcagggggaatctctgttgggttttgcccctttggaaacttaggacttcatttttaatcattattcacttttatcttataaaatataagaattcataaatttttaatactggaggaaactttagagagaacttctattccaggccttctctttatggataagaggatcaaggcccagaacttcgaagggactcctaatcttggagctagaatgaatggcaaaattgaacacaggcctcttacttcccagtcctgtgttctttccaggctgtaacaaaaggaaaagctgcagatggtgcctggaaaggggatgttcaaaagtatgactcaaatgagctttgggaagtgccattgtatttaagtgtgggaataattaagaatgaactggtgagactgttcaagaagttgtctcaagcttatagagaaagatagaaagctttcaattcatttaagggattaagt

SEQ ID NO: 106582 - DNA, 1167 bp, Homo sapiens
ctggcactgcaactcaagactgattatgaatttttaaagttagttattgccatttgggatttatggtttgagcctgatttcctttcattttcccctttttgttcttcatcggtgtttatacatttttttctcttttttatagtcttcaatgactttctgtctaataaacagtcaatataagcaatgacctctaaaatccttggtaaattattagaaaatcactgttttaaatacattaattctttatttcttcaacttgatctactgaatggtacttataaaaattctgctttcctttttttttaaaaaaaaactttagtgttaatagtgcagtactccaataaagtcattaagaggtagtaaaaaagaaacttctaatacaggaattgtaccttctttcatttgttcccacttattcattaaatttttttaaaaattatcattttgtttttaaaaaccattttattatgaacatcttcaagcatacataaagctagagacaataataaaatgaaccactgtaaacaccatgaatcttaataatgactaagatttttctacatttgcttatttttctttatgctgagtatattaaaacaaactcaagataccatctctaaatatttcatgataaatctttgaaaagtggggatcttttcctaagtaactataatattattaatatttgatacgtaatattaagtaatattataaataatgtttcagcaaaattaacaattccttcatattgcctacacagtacctatattaaaatttttctcattgtccccaaaatgcctttttacaatcatcagttagattgtgatctaaacaaagtccacacattgcaactcatcgttgtctcttacgcaacttttcactttgttgtcgtcatcgctgttgttaaaattgctattttcgttctagtttgagatttgctgcatatagcccctttttcccttccattgcccctactctttgcttcatctttatcatcatcaggtcaggctgcagttgcaaggattagaaaagcaaggccagtctgcaaggccagagcaggtacccagagcaaagcccctgggccattaagccacttctcagagtgatttaattgaagggaaaggcagtatctttgggaggttttttgactccttgtctgaagtgcct

SEQ ID NO: 106583 - DNA, 1137 bp, Homo sapiens
aactttatgggtttagaaaggagtctacagttccgtttcttcattcatgcgtgcatttattcagttagccatcaagtctttattgagcaacttctctgtgccaggaggagaaaaccaggaactgtccatattcctggttagttgtatgacttcaagcacactttagaatataaagtgaggataacatgtacctttcaagattgaagttagggctaaatgagtatgaaataatgaaagctcccaggacagtgtttatttagcatgtggtagacaatcacagaatggtaggtgttttttaaggttcatgaaaatagaaaacaaaacaccacaatgaggaaaggaaaactccaaatactaaaattcaaaggtaatagcccagtgcttctgggtaatcatgaagggtttaggggacttgcccaaggtcaccctgccagctagtagcaaggctgagggtgctttctgtccccttgtttcctctgtacccaatgcaacatttaaatattttctttcttgcaagtttctcttggcccagtggctgcccttcctgattgtctctgttttgtcatcactggttatgtctatgtgtatacatttgggccatttgagtgtctctgcatttatttgtcttttcatcctatttgtgagttctttagggttcacgatgggaagtggggtgtcttctctccctatggcatgcccttgtgactgcagtgtcctttacatactgggtcctcagtaaaattcactgtgctcactgcctgctagccccacacaccaggggcacaagcaaaaggcctatgggagccctttggagagtggcttgcttttataagccacttcctgcggatccttcccattgcttgtttccagatgagatcccaagttctgtttcacggacactctctatttgaccctgaattttgcacaagaggatttagtggttcttatcagtgcttcctggtaggtgggtgagagaaaggcagggaagaaggctgttttgtttgcctgggcctggaaggcaagtgtttttctctaactcaaacttctccctcaccttcccatctcagcaaggccaggtaatttttgtttcttaaggcatttaagaactgtctactctgtgacccatcaatgctgtgc

SEQ ID NO: 106584 - DNA, 1570 bp, Homo sapiens
tgtttggccattgtcaaggatatgtcattctgggcaccctggaaagcttctgtctgtgtttcttcatctgcagtcttgtagcaacacttcactgcctcagaagcctggttactttctgcctgatgataggttatcctatgaaataattcctcaatttggtcctgcgtcttaggatgttcgtgaaaatacttaaaaaaaaattcttggacttccctgtctctaaaactttatctttctttctattctttatttttaaaattgcttctccaaattaaatagcatctcagggtctttctggtatctccaaacaaggcctaaattcaagaccaccagggagtttcctcaaatgctccccagaggatcacttacttcatcttatacctgtaccaggttgttcactgggatagcatgtggtgtcctattctctcctggaattattatttctaaagtgaatcctttaataaaagataacattgactatttataacctacaagtagccaaatttaagggtgtaacattgtaggtcttttggctttatcccatccagttctgtgttcttaccaccataacaagatggaatataactaaagcattctgtcagactctaaagagccaagggatatgaggagtagaggggcaagtatacttagatacatcaaaaacaatagtttcagcagcaggtatacagtcaagactgccagccaccagcaagtttaatggacaggacatttatcacagttttgaccgtgctagtaagaccattgacctaaacttcttgacttcccaaatctgtattagcaagtacacattttagacatgtgtataaatgtaaacataacatgaaatgtatacataacatacagaaatgaaatctgcagttcccctccttccatcttattagtatatattcagaagacactgaaatatttttttcactgatgaatttattgaccaatgacacttcatgatattcttctcccctaaagcggctacaggtcaacattttaaaaaatgactatttattattgttttattctgtacatgcattatgcaaagcactgtacatgtaccaccttgcttaatccttatcacaaacctatgaggtagttaccattcctaactctgttgtataatacctggaaaaggagctgagatttacagagatgaagtagtttgcccaagatctcacagctagtccacaatgatgacccatgtttctctgtcttattccgtgacccattttctctgtgcaggagtctgtgtggaaaagagagagggggcagaaagagaaagtcttaattagtactgtgattcaaaaaaatcttcaaggttcattttaaaatattaattatgcaagttaatggacatttgatttcctgggctggaggaaatgtcattgtcaaatcctgttaaaaacacaaagaagagtgaatcttaaaaatgtcaggctcgaagacaatgaagatgcgttagttaaaaaaaataaaataaaagtctattttggttccagtcgttattaaggttggggcctttaattaccaccttccaaatcacaatgccagtactttt

SEQ ID NO: 106585 - DNA, 1092 bp, Homo sapiens
ggcgaagtgggagggggtgctgcagtgagtcatcgctgccccaggacctagggcaagagctctggaatccttctggtccttgaaaggttaaggctcgggtaggcagaagccagccgtctgagcccagagcctggagtgcccctagattccaagatagtaacccccaattccaggaccgtagggataggactgcgtgtgtacgtcaagtttgtaaacagcctttactcctcctctctccccgcctccacacccgctgaagcctagtggccccagcagttgtataaatattttactgcgcaggaccttcattttcattggcagttttaggtggtagtgcgcacgtggtttctttgggaactgaggactagggcttcagaaacgactacctggactgtgataacctcatttatattgcgtttaattcgcagtctgcctcttttggggaaaagggccctcatacatcttaaagatatgcgttctggttcttcgtatcttcagccattaatctagctccaaaacccctgcccctttgtcttccttctggaagttatctcctcccaagacttccccttaccacttctgcagcagtggcatcaagatgttgctagttctccgcctaggagtcttccaggaaatcttgaagagtctaccagagtctaccagattttggagtgggctgtgccatcctgccacccctagtcagttgtcagtttttctgaatttcatctgagatgggtcgcccgcctctcctgaacatctctaccctaaatctatcccgcttcacttttctccccctctctccttaggactgatgtctaagaaatattacactgggcttcttctccagtctttctcctcgatcgctaactccatttggcatttaagactatttacagtgcactcactcacatccacatgtccagtctcagctcccaatctttcctccacaaatcctgcatttcaggccatgggttttacactgctttctctgcaccccaccctcaatcctagtcttcattgcctttgtgccttggaatttacttggtcttctcactcatcttcacatgctcaaatcctacccttctttggagg

SEQ ID NO: 106586 - DNA, 1063 bp, Homo sapiens
tggctcacacctgtaatcctagcactttggaaggttgaggtgggaggattgcatgaggtcagttcagcggttcaagaccagccttggcaacatagcaaccccttgtctctacaaaaaaagagaaaagaaataataaaatgaaataaaataaattggcccctcataaaaatttgctctgaaagaagcaaaccttttcaaggtcacctggagttaaaggagggacagtttttagcccgttttcttcgtgggactttactggaattgaatggtattgtaggttaagtggaagtattcattggctgattcgtcatgaaaattagatcccagaggagtgatgaatgatattagtcactagggagagataatccggccaatggaaatgacagtgatgacatcacaaatgactctgtttgcctaatgccactggaaacagcaggaaggagacttgaagcaaagccatcaatttccacagaaaggggaaacccacacccaaatggtagggagggcccaggagccagaattcaagtgaatagtttcctgagtggtcagcagcgtcaggtgatttggggaacagataagcccctggtacttggtagcactgcattctggtcagtgaatcaccaagctgggacctggtgctggctgagctctgtgaccttgggcctaaagaatcttagggagatgtgttttacatgacaagaaatgaaaaggacaattgtgctaactaaataatttgggttccaatcttttgtctgaataataataatgagaatcttttcttgagtacttactatgtaccagaccatgtgtactatgtcctctctgatccggtttcctatttgcagactgcagcaggtagaaactgtgttgtctttgtttgccctgtgagtgaatgaccttagtgtattttttaaaagtcttctaactactgacttcaagcaacaggtactgtagagaaagtagtttgtatcattattgataataacagtagattcccttcattgagttctttgtgctaattattcaatcctcatagctatcctgccatctgggttttaccctc

SEQ ID NO: 106587 - DNA, 1047 bp, Homo sapiens
aatacagggtctgtcctattccctgtctcacaactgattcatagtaggctcttgacccaaggagaggccattcatgatccatgcaggtgaaccaggtctgccgttccctgcccagagtaacaaaatgtggaaagacccaaaagtcttacattctaaccctttctatcaccaaccgcaagaaaggaaaaatgggctttccaaatgtgtttccattacaggatcgagtcatctattattttcatttcagcaatgccaggaaattcagaatcagccacctcgtccaaaatataataatctttcagtattatatttatgataacatatagggaaagaggatatttcacccgggaaccaaggcagtctcaaggagactgactttcttcagcagcaccatgttattataataagtttgagagagctctatactgggttaaatgcaacttttcacccccactggcatcgcaaactaaactgaacggagaaggcagcctctagcaaaacaggattagatttcacaaaaagatatggaaagggatacaaatcgctcaccgtgcctcctgcaaaaatagaagagcctttgctgcactgtttctattcaaaagcgactgctttcttacataagaagtttaggtggctgcttgtttaagaaaatctttatgaagttaggtattttattttactttgttttctatttaggatgcatttcatggaggatttttgggtgtttagatttggtaggaaatgctgtgattaggtcccaggaagaaaacagtggttacttttggtctggggccccactgggtcaggcaattaggagattgtcaaggtggcagcaagtaccaggggcctgtttaaaagaatggcctcgagtatgtcaccagcaccatttttattagaattttctttcaatttcttcgtttttctttctttttttgagattgcaacaagtctgtggctatttcttaaaataatttagtgcaaaagttgtgccccttgctactctgagatcttgcccaagatttgaaaatgtgcccaatgcagatgtga

SEQ ID NO: 106588 - DNA, 1050 bp, Homo sapiens
ggtgaaacccaaccccgtttttactaaaaatacaaaaattagccagatgtggtagcaggtacctgtaatcccagctactgtggaggctgaggcaggagaattgtttgaactcaggaggcggaggttgcagtgagccaagatcatgccactgcactccagcctgggtgacacagccaaatcctgtctcaaaaaaacaaataaacaaaaataaaaaaaattataaaggcattgtagagtcttggtgtaaaatacatttggaaccactgagataagtaagagagttgtttgttgaatcgggctgcccttgtaagttgacacaagacactggaagagtatctaggtgctatggaattgttcaggacatgtggctaattttggtagtgagattgaaactagggccagtttcaatgttttttatcttgcaaccctgtttccttatcctcctccttccctagtggggaaaaatccttaagtcacttttagaacagctaaggaagttgtgtaatgatgggcaggaaaggctattaactctaaggaaggcgttttcaatataatctaaccaactgtagaatttagaaattctagattttttttttctgaaatactggcaggcctagagcccagcaaaacataaaatatatggcactatgcaatttgaagtcttgtttgtcattcctgcagatggatgagtagcttcagtgatgatgaggaaggactcatgcttgtcagggttgtttctctttttttgtttgtttgttgtttttggacagggtctcactttgtcacccaggctatagtgcaaaggtgtgatcacggctcactgcagcctcagctttctgaactcaagccatcctcccagttcggttcccaagtagctggaacaataggcacatgccaccacacccagctaatttttaaattttgtagagacatggtatccgtatgttggccaggctcgtctcgaactcctggcctcaagtgatcctcccacctcgacttcccaaagtgctgggattataggcatgagccaccgtgcttattaatttaatc

SEQ ID NO: 106589 - DNA, 1024 bp, Homo sapiens
acagctcagttcctttgctgtatggcttttgcccccttggtcagtatcttgaaaaggattggcctaacacacaagatctccttcctggctccctgtttctgcctccactttacctcctcctcctattgatcctacaaattccaaaaccatctgtgctagtaggcagagtaattggtgttgaacagatgtctatttgggtaacaatgttattttttaaagtgggcattttaaaaacattgctgctagatgattttggaatgtattttacatcataattcctcaggcccagcaggtttctcaacttgacttttcttaggttattagtgatgttgtttggatgtccttggtacacaccaagagagtggcagaaagagctgctcagcaatgtgcaagaaacccagtgacttctttgagatgaagtgtttcttctggctaactttccacaatgtgttgcagacatacaactaatgggcaatccaggtcctttaaaatcatttcttcttaaaaaatagactacagtaagtgtagctgtgctattcggtaaatcaacatgtgtttatcacatttgcaaagccctgggttgaatagtcattcatatgtaacttctgcatattagagtttctaagctgttttcttccttgccagttcttcttgtgtctccagtggttttatgttcattttttaagggatcagtgagaggacatagataaggctctttgcaaagtgcaaatccctatgcaaatgtgagggttttaaatcgctatttcatcactaggtatacagtatccttctgcccagtaaactgcttcttggttgtgatgggtcaagaaattgacttactagtctactgacttctcagcacttcccagcttctttagaagttttctgggaaaggaaggaaaccatgaacgaggtccactctggaaatctgtcttctcactccatgccctgccagtcagggcatacccaaaatatgggctttggcacagataaaacttgagactcctatttcttgcagggctga

SEQ ID NO: 106590 - DNA, 1038 bp, Homo sapiens
aaaatataaagtagggattgacgcactacagcccatggaccaaattcagcttaccatctgtttttgtcgataaagttctaataaaacacgaatatactcattcgcataggctcttgtacattaatggcagaactgagtagttgcaaggcaaaacctaaaatatttactatctggatctttagagaaagttttccaattcatgatacagaccatagtgcatatcccagaataggaagatggtggtgggatctgaggaggtatcccagaggaggcaataccaaagctgagacacgagggatgcatgggaattaaccaaacaaggctgagaagtcaggggaggccaagacagaggggactgcctgtgccaaaacagggagataaaagagagtgcagtaggtcctcggaattgcaggaatggccagaccggagatgtgggctgtggccacattatgattcttcaaaagtcaagaggatccttgaaagttttaagcagaggcagggctgatcgagtttgctttcttgaaagttcactctgcagtggagtacagtgagcaaaggatgggttgaaagtggactgcttcctttccctcccattttcccctcctccacctctcaaaatatttagcctcttggaatcaggccggtgtaagtgtccaaaactgcctgaccttgccctggtggcctggggatacccacatgaccttgtggccctccagtctgccatggtcttgtccttccccactcagggccacctggtcctacgcataatgtaggagcagggggagtgggggcttaggatccaatttctccacttgacacttgcagccccttcagcctccagacagaaatttgagtggcagtaatgggataaacagtttaatttaatagtaacagaagaactgggcccagtgcaaggaatctcattgccctttttcaaagtgactttcctttcaatgcatgatgtagcagggccattggggatgcagagaaatacaagggattgattttgcctggcaaggggtcagattgtaagaagcg

SEQ ID NO: 106591 - DNA, 1027 bp, Homo sapiens
tcctcacttgtgcctttttcctgatctagaatgttgggcttctctggcagaagcagaaataaataattgagaaaaagcttattatcagatgaacacattatgcattgatttgttcctgcatgtgtattctcataagttaggtttaattaaatgtacaatatagtggaaggattaagtgaaatatgggatagcaactgggcaggatattaggaggtcacggacattagtaaatcggaagactgagtagctacacagaaagcattcacaaaatgatactgagtaaagcctagcactgaactgtagtaatagtaatactacaatcctaacatgagtcatacacgtttccgtcattataattgttacttcccaaaataattgttatctgtctgctgtatattatccacctcccctaattgcaacgtgtgttaaatgggacttggtctcttttgttggtctctatagccccctggccttgtggcagagtttggcaaactatggccaaccagccaaatctgacccactgcctgttttttgtaaacaaagttttattggaacacttccagacccactggtttacatattgttcgtggctgcctatgtgacaaaacagtgaagctaagcagttgtgtcggacactgtgtggccctcacagcctacaccttttactatctggtccactatggaaaatatttgctcatccctggcctaaaccactgactgacaaatattaagtgcttaacaaacactgatagaatgaaggagtggaagaagaaatgaatacacatggatacagagtgtaagaaaatgcagataaatcaaaactgtgaaaggaataggtctgtgcttaaaatttttttctttttaaatcctgttgtattttgtttaacaatataggttgagtatctctgatctaaaaattcaaagtctgaaatgctgcaaaatctgaaacgttgtgagcaccacttgttggagtattttggatttcagattttcagattacggatgcttaacccataagtataatgcc

SEQ ID NO: 106592 - DNA, 1046 bp, Homo sapiens
catgaagtgtctcttttatcacattatgggtaggagatacagcagtggagaagatggatattttctataccctcaaagatcataccctggaataaggggtacaggttcaaaactaataaaagaataaatcaagtaagtgttatatttgaagataaataaggagaggagatggagaataacagggtttgggtagatgctttttaggaagtgtgctcaggaaaagctgctctgatttatttgagctgaaaaataaagacagagaaaaagtgagccatgtaatgtttgggtaaagagagttctagaaatccaaaatactgtgtgaaaggactacatccggaaagaaacgaggatatttacagaactgaaatgagactacatttattgaacatttgccttgtacaagtgatcatgccgagtcatttgtgagtgtgagagtgtgtggttgtgtgtgtgtcaggatggagtgtagggggtgtgatgctgttcaaggactagttagccttggccttctgttctgggccttttttttttttcctctgattcattcactcagcccccagatgctacatgatggtttccaccatgttaatacagaacgaataagccatttggctgtgtcagttctacatgtagagtcatgtattgtgttctaaccattggtcttgctaaaggtttcttttcgatctcctgcctgtggttaagagctattccttgacattcaggctaaattcagttttccacaaacaactttaacaaggtgaaattgctcaacaactttaaatatttaatgaggcttgtcactgtcttcattgtggtgctacaatgagagatgaaagaggctttggaccaaaattggggcatgatggcccaaatcaattctccttatatatattattgtaaaagagtgtcagataaatggatactttaggtagattttaaatataaagagataatttaagtatttattatggtacaggtaaagattttttattttttattttttgagacagggtctcactctgtcactgaggctgcagtgcagtggc

SEQ ID NO: 106593 - DNA, 1142 bp, Homo sapiens
ttcttattgagatttagtaaatatacttgagtgtatatttctccaattattgtaggacaatttccagaagctttaaatgattttttaaaccgtaattttctttaagtaaatggttgctttatgggggagaaagtctgctggtctcccccttccatcatgccagaagttggttttctgtcctatcttttaaatgtcatctatgagctcatgatgcgcatgtgcctgcctctaacctagcctttcacctggacaccagacttccatatccagcagacaacttgtcatcaagtagttttggttttttttcctcataaatgttctcttcaggccttctttatctcagtaaatgaaaccgccatctacccagttcatcaactcagagcctgagcatcagccttaatacctccctcttgtcaaccacatgtaatccattagaaagtttcattgggtctgtctctcaaatatgcctagaaactgctcatttctctccagttccatgactactgactctgaatcattccccttcacttgatctattaaaatagccttttaatgggctgtctgctttcactctcactgcccctccaatctgtgcctcacactaccctccgagtgatcactgtatgtatatttcccctagacatatgctttaaccctggcttcagccctgtaggaactggctgctctttacctctccttccaatctcatctgaaggccctcccttgacctgtgtattatagtcacatggtcctctttgctagcgtgctttcctttgcgtggaacagtctcctccttctccctttgcatgctggcattcctcctcttctcttcttgttttagcttaaatgtcaccccctctaagatgctttctaggtggcttctcctttgttgttctctgttgtttcagcccattcatttcctttacaattcttgacatggtttgtaattattatttgtttaatgatttattctctgctgttcctactagatggtaaactccaggacagcaagaacctcatagttgttttgttaagaaccctgaaataaacacttacaaatagtaagagctcccacttaccaagcagtaagtattttcaagaaatgttctaaaatatatatgaatatatatgtatatgcatac

SEQ ID NO: 106594 - DNA, 1047 bp, Homo sapiens
taagtgagatggggaggcattgaagggtgtcaggtaaaggtaccatctgatgtgatttatatttttaaagcatacacactggctctgtgtggggaatggaatgcaaagaggctggaaggacatcaggtgagatccactgtgacagtcaagacttttaaacctggccgggtgcagtggctcacgcctgtaatcccagcattttgggaggctgaggcaggtggatcacaagatcaggagatggagaccatcctgactaacgtggtgaaaccctgtctctactaaaaatacaaaaaaattagccagacacggtggtgggcacctatagtcccagctactggggaggttgaggcgggagaatgacatgaacccgggaggcggggcttgcttgcagtgagctgaaattgtaccactgcactccagcatgggcgagagagcaagactgtgtctcaaaaataaataaataaataaataagactttaaaacctaaggccaagcacggaactaaagaaactgtagcatttggctgttgagtgaacaaatcaacaatgaagaattaataaacagtggaaccaaagaatgaatcaaagccaggagtgaattatagtcctagaaactcaccccatatccattggcgacccttccagttagaagtcaggaccactgagcactcctgttctgggtcagccagccctctgctcatatttcagacagaatgcattttatgattaatcttaatcctcctacctcccatagaagtaaatcatctaaatgctttcctcaggggaggagaaaaggtaaatgatctctccaaacataccctttaaaattttttcgatgaaagcaaatttttaaacccacacatttgagtgggaactgaatggtgctaaacaaatacccaacttctacatgtgagatctttgaggtgaccccatgtctgtcaccacagaatgaagtttgtaaccacagccaaggtttctaccctcatccttgccccgacttccaactaacaggagccagaagttgcctaggttaagacaggagatggct

SEQ ID NO: 106595 - DNA, 1832 bp, Homo sapiens
gagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgtagtaaggctgaggaagagtacaactgaataatgatgttctttttcatcaagttcctaagagctgacttggagattttattcccagggctccactgctaggattcttctcactagttctaacaaaatctgtgatgttaaatgactgatgctctcaattgtgatccagagttttaaataaatgaaatcaaggtggattttgggaatatatcctgaagttaacatcttgatgtccttcttgttgtaagatgatatttggcaatttaaaatctatgtgctacccacctgggcttgtctcaatccgtggactttttggtgtggcagtttcacctgaattccacacatcagatttgtttggaaatattgtactgtacagggactatgcattatgcagaaagatatagttttctttgaactgctgtaaccttaaattggaaactgattcttgtgagcctactttccttaatcccgccgcccccctcccccacttaatgtaaatgtcttgatgagagataatggatgagtattttgtatgatgaaatcaaacgatttaggaatttgtctccctccgttacacagttgatgcctgaaagaatgttgggggggaggactcaacaccctaattgtattttttaagtttcttttgtgaaagattttttaatgcatttttactgtaaaaatacatggaaatgtatgcattccacaaccactattgcttctggattgatatcttccttgtctctatgttgtctcaaatgtatcagggtcaagtaatcaattgagggcccctgactccaacttgatgaaatgccgttgtgttgaaagagcaggatctatgccattgcaatagcatagtgccttgctactcaaagtgtggtctgtggaccagctgcctcatcatcactgaggagcttgttagaaatgcagattctcagccctactcca

SEQ ID NO: 106596 - DNA, 1033 bp, Homo sapiens
gagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattg

SEQ ID NO: 106597 - DNA, 1352 bp, Homo sapiens
cgtggctgtgcactgtactgaacttctgaccattaggtgtattgataccactgaaactgtgtaacattgtctcccttttctgtcttccctatgcttctgttggatgtgatatttcatttgagagtcatcgtcagtaacctgtgtaccttctcaaaacctatgtctgttgcactgaggatgaaaatccaacactaacaaatgttctttgggctaaaaataaagatcatttaaatacatggttttccaagaagggttgaacctgccacagggttgtgctactgtaatgtctccatgcgtcacttggactaaatctctctaattccattgattagagtcacaaatgggttataatatgttaagttccaatatttttctgacttgattggaacctgcttctctgtgaggctatttttgtaatgagttttttgtacttaatttaactgccgcggtctttggtgggggtgggaagggattttgttcttttgttgtttattgttaatgctctcctatgccagcctgtcattgttccagttgtttgaaaaaacaaaacaaaacaaaacaaaaaaggatgcattcgttgtctgggttctcgagtcaccttatggctgtctaaaaatgtcactgttccgattgcggtctctgcagccttatttgagtgttgccttagactgtctgactggacaaataaactctctttgccctatgttaacaaatgtagattttttttctttcctctgtgttatagggaatctaaatgttcaactttttctctttctctctttctccttctctctgactgttcttggtgctgggccctcccttccacagcgatgatacctcctaatatcgctgcatgtatgagaaatgaaaagctcggggaggcttgcttctaccttatgggccataatcaaactacggtttgtagctcaatcaatactaggtgtttctgtgctgtggcctaatttcctcattgcttctgcttagctctgttttgatatgtttggcaattcattctgagcaccctgcgttctttgaattgtaagtacaacgctgaccctgttgaagtgttgccttcccttgtcttaaaagtaggcataagaagccactggtgatccaagtgccttcctgtatccacatcttcacatgacctttgttaagaacctgttttttgttcattctcgtagccaacccagtatttagaaagaatgaaccttgtttcatggagccctgtatcgtagggctttgctagatgggaagacgagatttcctgcttggtcaggtatctctttgcaaactgcagtccatgggcccaatcctgtccatagcctgtttttgtaagtaaagttttattg

SEQ ID NO: 106598 - DNA, 1616 bp, Homo sapiens
agtggcacacgcctgtaatcccagcacttgtggagactgaggcaggaggatcacttgagctcaggagttccaggccagcctgggcaacatagcgagacgtcgtctctgctaaaaattcaaaacaattagctaggagaggtggcttgcacccgtagtccaactatttggggcaacgggcaggatacgctggcgggaggatggctggagcccaggaggttgaggtcgagcttcagtgagccctgatcatgccactgcactccagcctggatgacagactgagaccatgtctcagaacaaacaaaataaaataccctggaaaaaaaacttttaagcctgaacaccaaaaattatcatgcaaggtggattatccaataacagttggcattataaaggcaattttaaaatttaaatatgtaggaaatataaaattcacatagacaccttgtgctaccttggttagaaacaagtaaacataaaactggtacaacatagttgaggattgatattttttaaggcaatacatgttctgctgagcatgtgatttcatccaagatgtttcaggaatttggttgatatgataataagcctcttctctagttactttgtaagtgccagaagcccggtaaagggaatcaagtctggcagagggtgaatatgtgatgctcaattttttttttttgagacggagtctcgctgtgtcacccaggctagagtgcagtggcatgatctcggctcactgcaagctctgcctcccgggttcatggtgatgctcctattttaagtgggtctgagaaacagcattttggaaattagagttgaagcaggggagttagatttctcaaaagatgtgggagatccaggaggattttgcaaacccccagaagacaaagagtgagcattacagttcagtgaagagataatcacactggatccacttcctttctgtgaaagcgtgttggacatagttgattccaaggtaaaatggaggtgcctatgcctcaggtctctttcagattttttactcgaatatttacttcatcaagtggcccaaaaaccatttgtttcatgatatctacaaggagactgaaggtcttaactcagagtggtttctaagctcttagaaatccatcacgtctggggccgggcatggtagctcatgcctgtaatcccagcacgttgggtggccaaggtgggcagaatgcctgagctcaggagttcaagaccagcccaggcaacatggcgaaacgctgtctctactaaaatacaaaaaattagccaggcatggtggcgcgtgcctgtagtcccagctacttgggaggctgaggcacaagaattgcttgaaaccaggaggcggaggttgctatgagtcaagatcataccactgcactccaggctgggagacagtgagactgtgtctccagaaaaaaaaaaaaagaatccatcacgtctgggacactgttctcgaaaccccagcaggccctttgaaaagatgctctgccctttgtgcagtgcgtgagtctactctgagtccatttccatgtctagttcatgctatctaattctttgctcttgtcatcggtagccttattctttctgcagtttcactcatctcagtc

SEQ ID NO: 106599 - DNA, 1344 bp, Homo sapiens
aaccagaaatcctatgtcaggcctcaaagccagccacctctctctagaagttagcaatgacatgcagtgcctcaaagtgcacgaataaacctttctctccaaatgcacttttctcggtctttgatatgggtaactgatgatgagaaaggagatgattaaaggaaaaagggtgaggaatgatttgaacctagctttggatcaatgtcctcagcctgaataggtactagattttcgtagtcctttgaggggatttttgtgaggcagcagaatgatttcagagctaatgaaccagtcaggccacgctctgaaagcacataagactagctgcttgagcaaaggtcctaaaaggaaaaataagcttcaaggttgggtgctttcttggctcatctcttataattacaccctttttctaaagctttcatcattctggggagaaggcagaaagtctgagtgtttgttcatcaggtgttttcagattgaatttttggtgctagcagactcttatgcctcaccagatgcccagtgattatttttctaaacagagaaagaacaaaacattggcagaagcttaaacaacagctggcaaaaatgaagtgacatgaacacagaatgagtaaaagcatccatcccagccttgggtttcacatttgcagtcccaaaataagcgaacagccagttattttggggctcttaaaaatctttgaagttgccaactatcccaaattttgtaattggtttaaggaggaaagctggggattcccctaattttgaatctggaaaggatggcagcaatgaattctagtttcagggcagtagctccttatacagacaccctgagtattgccaatgttttgaccatcggtgcagagctctcctttaataacatttgcttaatgctttaatttattaacacttaaccttctctttcccttttcaaccctttttctcttccctttgctatattcccacgtaactttaaaaaaattaaaactcaatatcaaagcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatggtaaagtatacctattatctctctctctctctctctttttctctctctctgtctctgtcttttccttttctctttctctctctttgattagtgttcgtgtaactgaatagtattaatttagtggcagctttattcat

SEQ ID NO: 106600 - DNA, 1091 bp, Homo sapiens
attattttaaggaagaagaaagtgacttaaagataaatcagaaagtctgtttaaaccaagctgttctctttcatcctctagtagaggaaacatctggtgacttaacatgacttccgaatccttagatctggcttcagaggtgactctgacttagcctgagtgttcttggacatggacacctgctttgtggtgtggcacataataattttaatttacttaattctccttgcaagaatactgaggaaagcagttaatgctgactatttgtagttaaggatcatggcttgggcttgattcggaattatcaaacagtgatgggtcctgtgaagaactttagggctcagtgactattcccactgtttatccccgtgtcttccattatttcacctgttcagagtattttgtttctttgcctatattgaaaatcttccatctgatcaagcaccaccattcttgtcctgcaactgtgttcatcttgggggtatcattgcttttatcagtaaaataatccttctcttttttctcccctctctgcagttccagattaccaggaacaggacatcttcctctggagaaaagagactggatttggatttaggattctgggtggaaatgaaccaggggaacctgtgagtcttttgcttgtctctcttcccagcatatttttctaaggcttcaaagcaaattggcgacagtgacaaatcaccaagatttaagtccagctagatgcaacactgactctttaatcttgagtagtgtgggtttctcattgggttttgtggagctctctttgtcttgaggaagaagagactagattctttctaaaaagtttgtatgagtgtttgtgaaaggtgggagctgcctctgtagaccaccccttttcccccaagggagatgaaaacagaaagcaaaacaggaataggcatcacctaatatcacagtggcctggtccttctggccaggtcccttcactctgccagcaggtagtaggctttgtatgttgagttgctggtgtgcagagagtacttcgcaaagccttatgagacagtgattggagaatgtcagacccctgcctttacaaaacttgagaa

SEQ ID NO: 106601 - DNA, 1059 bp, Homo sapiens
gtagcaagactttctttgtaacgtgtctgtgtgtcgacgtttatgtctgtgttttctggctcactcttgtgtctttaacatccctagtgtcagtgggcatcttccttttcaacagaaaacctttaaataaatttgccatttaccactgattctcagaaggaaacgaagcttttttttttttttttccatgtggcctaaacggtgtgataagcctaaatctgttggccacaacctcccataccatgctagctcacacctaaatgagcaacagtaggcagaaacttgttacatttggtgtcactgtaggatgggcaaatgttctggtgttaaatgatgctgagaaaaatgggtctgggctggaagtctctgcagaggccctttcgttgttcccagaaaagccacacactcagcagacctaaaacagactctgccaggagcccagtgctggctggaaagcaccagtggtctatttcagtaataatcctcttgcttgagtgactcaaagacggagacacaacttgatttaatttgttgtttcattgaggctattacagcaaatatcctgtagccagctactcgaacagaaagaaaatattgttaccttagcgtgctcaagaaaatattactctcaaattgtgtttatgggagtcctgtgcagtagcttagctccatgttctgggtgttttgcagcttagcctcagcaattataataaaagcagtggatagaaagcacccatttacagccctggcactgagatagctcaagtaaaaagatcagattcaaactcctctgacttgtacttactggtcacttggtttcttctctgttggtgtattcattcactatacattttaagtttgtgggtgaatcactaaaaagggacatctcttcgccaacctaaaatctaaacatccaccttcttcttccctattccattgtacaaaactggagaagaaaagaattaaattctcaggcctgcgctttccttcagccccaaatccagttaattaaataagaaggtatgcactatagcatttgaaaatctcctttaggattca

SEQ ID NO: 106602 - DNA, 1083 bp, Homo sapiens
caaggcagcagtattagaatgaatcagtctgaattacaaatgtgttcatgaatccttttgaagggtttcaatgtttaattaaaaacaaagacgagcactgaagtcctttaaaagccatgttgcctgttttatggtttctctagaattgtgcacatcttaaaaacgacagcgatgcagtgttattagtaaatgtttaggaaaatcagatcctatccagtagcatttactacaaaagaaattataaggcttatagttgaaactttgcctgttcactatatagtttggaaagaaaaaactgaaaactgtcctattaaccaacattgtaaatctgtcctgccttggagagacatgcttacaagtttggaagtggcgattgagcttctttatcatagtgagcttaagaagcttggatatacctccagattttaagagcaattatgagtttgtatttgtgtgtttgttcagttctcggatagatccattgatctgcatctctaaatataagactattctggcttgaaatgcttagaattcacctgaacagatattagtacaagaatgaatttcatcctggacttgatacacttttgaataaatgctgtagtatagtggtagcacaaatatacttaaatttttcaaaaagcaataaggttttagacaaaccatgattgaagtaaggccattcaagaatgtgtactttagaatgtcattaaataaggagagtttaagatagtaataggagttataggaaactctcagtggtgcaattgtaaattctaccttttttacaagtaaagcactgtaaaaaaaaaaagaaagaaaaaatggaatcaaactatagtcttttaacataacagccatgacctttattgtgaaagctgaactgactgttccttatcaatcaaaactaaattaaagtgaactaagagaaagaatgtacattaagctttgcaaaattgtgaaattaatattccagctatgtcaccttcacctgcgtcgggattgagcaagggtgagagagagagagaaatcaattccacgaattttggagaatgtccgagtaaggatccgctgaaaactttt

SEQ ID NO: 106603 - DNA, 1050 bp, Homo sapiens
tggccatgctgtgcttcctttgccggccgaggtgcatgctgaaagtcgactcctctgtgacccaagcaaaatggggcagtgaggccagcatccttgtctgaggaggaaagttggtcagtccactgaatgatgctcagcagttggggggcagaggtgagcctggagtcttgctggttatcaaatgttaggagtcactcagggcttcatccttttcctcctcaagggagaaatattactgccttcttggtaccacaatgcatggaattaaataggctgttttggctacaagttcactctgctgacaaaaagcccactaatttgagcagggacttatttagtcgctggactagaaagacacccctaaagtacccctgaggcctgactaaaggaaatgaagttccatttggaatgacctcatatgcagtggatgctaaccaggaaccaggttctgtcctcattgtgtctcctcgctcactgtagtgatttcactgaagaaaaccatttaagagatatttccaaagaggagcgttttcacattccccgcgcatttctctctgagcttgtggctcgtccagtcaatggcccaacttcagttaatgttgagatattgctttattgaccgaactcctgctctcctcaatacagtacacatttatgattgagttttcctgtatgaatctttttgtgataaaatgaattgcattctgaagggctggcgggggcgtcctgggttgacaggacaattgtaaaacatccgtttaatagaaggctcttgctcaaatgccatttttaccctggtggcggcaaattttcttaagaatttgacttaatcaaatgtgtctaaaaagttttcactaggaaaaaaaaattaggaaaatatgtaatgtggccatagccagctactgtaagtactgaagttgctcaggtggcagccggactgaaatattcggggccaggcgccacggctcagtcatataatcccagcactttgggaggctgaggcgggcggatcacgaagtcaggagttggagaccagcctggccaatatgg

SEQ ID NO: 106604 - DNA, 1038 bp, Homo sapiens
aaactcatttcactgagactctcagtctaaatcacccacaaggatgttgtgtatgagaatttaaaactaaatatcacaccaaaccctgaattttaagtcagtatccaccgttttcgtatgaattcatttcccaactcttctcccttaatctgtcccctctttttttttgagatgaggtctcactttgtcatcaaggctgagtgcagtggcacagtcatagctcactgcagcctcgaacttctgggcccaagcaatctcttgccttagccttccaagtagctgggactgtaggtatgcaccaccatgcctggctaatttttatattttttgtagaggcgggagtctcaccatcttgcccaggctggtctcaagtgctcctcctatcttggcctcccaatgtgctgggattacagtcatgtgccaccacacctagctatcatcttctatttatccatctgttgctccacctacatattcatctttcatccattcattcatccattattcagaaaactagtatttagaacccattaaataacaggtttggtgtgaagcactggaaatactataataaataaggtggtcatggcacctctcttcttgcagtttgcaaacaaaccgtgtattgattgctccttgcaaaaaaaaaaagattaattgccacaaatttccaaaatgtttatgcagtcatttcatcaataagtatttattattttatgtgtgccagacccagtgccaatattggataagaattaatcagaaaacatccctgccctcatggaaatggggagggagaaataataaccacattaacaggcagatctacaaagatcctcacctcatagggattaaagtgtgatgagcattaataaagcagaaatataacatggaagcaagtacgcacataatgtaatcattccactcttaattataataacttataagtcatcataaaatgccaacacccacgattgaataagtgctgtgattgagctgtggagtactttggagttccccagcagcctaggcaacatagga

SEQ ID NO: 106605 - DNA, 1034 bp, Homo sapiens
attgtaaatttaaagtcctacatttagaattatgcattgataggttttcgaataacagagaaggctcatgtggtctgagattgtgctcagaagtacttttatcttctttggtatctaagaccagcccttgaccaagacctcacagtcattttctttcagtggctttcagtggtccctgatgactccctctctagctcctactctctctgtctctctccccctcgatatatatatatagagagagagagatctataactgtgtgtgtatgtgtgtatacatatatatacacacacacagttccctgccccttgcacactgtattacctaatccaactccaggacagtttttcagtttttattgcaacatttgccttgcgaaactgtaaggtatcccatgtgttcagtgacatgtggattagtgacacagcatttgttggaatgcttaggaggaaagcaaaatgtttccactaaaatgctgaagtcgggagacccaaatgcagaggggaatgaatatcacaatgaaaaaatgtaaattgatgacaaaaatagtacatttttcttatgcgtagatccattttgtatgtgacagacactttaggattcaccctttcaaagcctctttgtgcagtttttcttgattcattcagttagtgaggttggttggcattcccacttcctttaaacctggaggaaattaggtccagagaggtccactctctttcccagcaactcaggttttgtttgtctcagtgctgaaatggcaatgctcggcttctgcttggtttccccaacagcccagctgagctctcctacttcttccgtatttacatttaatcagtaggacaagcacaggtcctaatctatgagggttctttaataaaactatatgtatgcattcattttggggaaaagtaagcaactcttggaggatatagagatcaatgatgctcaagggattttaaaatgcaacaaaatgttctgaaatatgctgcatttatcttaaaaagcagtatagaggccgggcgtggcggct

SEQ ID NO: 106606 - DNA, 1518 bp, Homo sapiens
agttaacggttctttttctttcctttctggagagaagatgccatagttcactccacttctgactcattccatatcttttctctaagcccattaataaaaaagaaattttgttattaggtagcgtcaggaaacatttgcaagctagaaaaagctcctgcccactttgaaactgagtttttgtggccagtcaacctgttagttgtgtagctttaaagacatgcttcattgtcccaaatcagagactgatctcgttgtatttttagcatgtgtagccttgaatgaccagtgatttaggtactgagacttggagtaaaatatcagggatgtgttaagaaattgattgactgtgcatacactcttcggctatctgtagaaaagaactgtcttcccaaatgcatgtcgcagttatgagccctagataccttgaccccgttgacctagcagttgtcagtggtaggtccatgtatttcataaagctatattaaaaattttctgtaaatgcatttggtatgtatgaatggctataggattaatcttatcgtagtagactctaaaccaaaataattaaggaacctttgaatgacagcatatagtttaaaagcacaggcttggttttagaccaagtatccccagctattcacctgactgtgtgacattggccatgttacttgaccatcagtgtcttggttttctcttctgcagaatgagaagatattagtacttagagtgcaggtacgaagaataaatttatgtcaaagacaggctctgaatactttttagttatttttgcactaagctttcaacctttaggcatacttcacatgttttcaagagtagcaacaataggatcatccatatcatttcaatgacaccttctctggagtgaccatttatttctcaggaattgcatggagacaattcatccatcttacccaggtctttgagcagtccaaggtatttatgactttaggtctttcttacctgtgccaggtcaaggcttgtgactttgaggtgaaaggctctgtaagccatcaggaatcaccagctttgcaagccatttatttctactgggacatatttattagactatgtgtactgtgtaattgaagcagacttctctgtagctgtaaaaccagtacaactatgttcttaatcttcttcacaaaatgccagctgacactgccttgggagctacttatttcagacatctgaagtccaactatctctctaaattatgatggtcaaaatacttcataatgaccattattaagtccccaaaggaaagaatgtcttcatctttttggagacattgggtctgatacttatgttcttggcagctggtatcatatttgtattgaaaaattatgctacggggttatgatggtatttagccagaagaaggagaaaaaaaaaatgaaacatgttcaaactgggatcgttttttcattcctttttatggattcaattttgtgatatatagtgtttataaagtccttcagtgaaaatgtactctggttt

SEQ ID NO: 106607 - DNA, 1053 bp, Homo sapiens
ccactgtgtcatagaatagcagtcataataactatgaagctgcaacatggaccagctatgactttgtgatggagggaatccctttctttccctagcattggctgttgactccactcattcagcaacctgagtttttaattaggcttttatttttgcaatcggtatgcaaaaggggtcttggcatgatgaacctgtgtaaaagctatgttttaaaaagctttcttatagttacataaacatgaatttgttttcaaaaatcgcttggaaatagttggaattaggtctacacgctcttaggtatttttgttttttctaaatttaaaaatggcttgcattctgtgtagttacttttgccatagagaccacttaccaaaatggcagatgattgcattgaaaaaataacagcactgcccatgaattaatgggattctatgtttatatagtttgtctgcatctgcaaatcaactttcacgtagactttggtaactaaaggaggaagagaaggctgttttataacctagcactagctgccggtagcacccccgtctccccagttttaacaaccaataatgtcttcagacagggccaaatgtcctttaaagagcaaaattagatgtgcttgagaaccactgctttaaccccttcaacacccatttggttttgcttcttagaaactctgtgttctgtttgtttaggtacaaatgaaatccacttctgggttattttttgttgaatatggattgaagaaattttattggagaattccccacttcttcttagtgttgcctctgcatctcctcagtaacggagtggcagtgtagtcagctgtgagggtctccagcgtgatctctgctgtcacccagcagtgcagcctgagccagccctgggctgtgtccatgagcctccagattatcatctgaagtatgggtaggactgcacccttctcagcactgtcatgacgatggaataagaagagggcctgttacaccttcagcgctgccctgttctgatgaagagtttcttattttctggccccttgctctgtcatattga

SEQ ID NO: 106608 - DNA, 1059 bp, Homo sapiens
gggttagtctgtgtaaactgtgcagaagatggaactagatttgatcattctttttccctctaaaagcaaactattgaaatttctatttatttgaggctttcctatttaatttcatagtcctagtagtaatagccacaagcctctttccatttgacccattcttgttcttcatgaaggactgaggatattgtttgtgcacagttctgaaataaggagaaaatagtactcacaatctagttagggaggcaagactaacaagtgagctttaccgtcagtaatatgtagtctgagtctgtgccatacatatttggataataggtgaatggtggggtacggaggatggacaacagtctgctggaactggagcagagtgccccagcctccacagtttgtcattttgggccagacagttatctgttgcgggaactcctcctgtgcattgtaggatgtttaacagcatccctggtctctactgagtaggtacctgtcacatacctgccccctttctccaacggtgacagtcaaaaacatctccagacaatgacagatgtcccctaaggggcaaaatcgccctctgctaagaacagctggactaaagcagtgctttgaaatataggaaggatttaaagttaccaactggtccatgggcagtatttgacatgactcatcatgtattttttaatcagtcttaaaaaaaatattttcagatctgaatgcatttagctggagccaacaattccagcttccccctggcctgctgtttcttacatctgtccttactcttgcccattgtgtgcctgtggcccacaaatcacctgagtttgagacccaaagacagcatacacaaaaacatcaagaaaggcaatgatatcatacatgaatgtgcaggcctgttgtggatccatttcctaggactttcttttcaccatcatctcaaaatcccagtaactggcaacttttcttttctttttggtttaatttatgctttaaaaaaaaaaaagaaaccatatatcatcagacatttccccccttaactttggagtttgtttcctaccctta

SEQ ID NO: 106609 - DNA, 2145 bp, Homo sapiens
ttaagcaagctttacttatttaacatttgtatgcaactcagactttattggatgatttgagttttatttctgttatattcacaatgcaaagtggttggcacacctaaaacttttacttttgttctacaaagcaatgtctcattctccttgaaggtaaacttaatgcattgagttacttacttatatgcattatttattacaaatgtgttcgtgtgtgatttatagttctcattaaggtgtggtgtcatcccttcccctttctggaagagtggtagaatttcattcccttggctggcaggctgtagaattattgttctgtgcttttatttaagtgtggaatttgaatataaagaagttgctttgttgtctctttttgggggacaaattcattaacatcacgtgcctgtcatcgtctaggcactgggaatagagcagcgtcatctgcaaatgaaacaaacaggctcctgatttcatgaggcatttattctaggggaaggggagaaagggcaaaaataaacaaatgaacaaaatcatgccagccaaagaaaagtgctgtgaagcaaatcagagcaggtaaagtgaacaggtgtggcaggcctggcagtgagggggctcttgtagattagaggtgaaacttgagtgaccacagagaaggaaacggtattccagcaggaagggacagttagtgcaaagaccctaagaaagaattggaacagagacctgtgtgcctggagaaaggggagcaggggatggggatggctgaagtcagagactggaggccaggacctggagttcgaattccatttgcagtgtgaggtccagattcacacggtgaagggacaggctctcagtaacgtgttcagatagtccctgtggcatatatatgaagaatgtattttaggggaacaggaggggaaggggagacctgtgagggcttttgcagtagttcaagcaagagtgttagcaacttggactgtagggcagacagaggatcacggcagtgggggacttgggacacctaaagaatagtcagcaggactccacaggttgactgtaaagtggggggacacactttttctataaagagacaaagggtagacatgttaggctttgtgggccctacagtctctgtccccactactctactctgcccttgtagcaggcgatatgtaaaggaacgggttggttgtgttccaagaaaactgtatgtgtcccatgggctgtatttgctgaccccaactgaaggaaaggaaaagggagggagccaaaatgaccccagaatttttgacctgggaggaatctttgctgagatgtggatcctagggtagaaacaggtaggacttgagctgtaaaatcaagggtttcttctcacacttgttaattgtgaaagcccatttgacatccaaatgaaacagaaatgtaggcagttgtctggaatctggggtttggtggttgtgaggttaggtcaggaaaaatacgcatttatgagccattattgtctcaatgagtattctataaactgtgggctgtgacctattactgggctgtgaaatcaatgtattgggctacacccagtgtttttcttggaagtgaaacagaaaacattagagtgtatcacactcactgaagataagtccttttttatgaaatatttactgtgtgtgtatacccacgcatgcatacatgcatacacacacacacacatttcataaaatgggaaatacaatttgtaacacattcatacacttgtgtgtgtgtgtgtgtgtgtgtgtatgaatgtgttataaaatgtatttcccattgtggaacatagtcacataagtttgtaaaagatagaatcagaggttatttagagccatggggctgaatgagattactgagggaaagagcaggaaggagggagaaaaagtgcaagacagaaccctgaggcacatcaccattcaagggtcagactgagcaggaggccccagtaaagatggagccgccagcgcagatagaagaaagaacaggaaagcgttgtatcacagaacccaagagaagacagtgtcacaagaccattgtagcagcactcatgggtcaagaggtggaggcctgcaggggtgaaaacactgcctgtggcataacgtcccctgagggcaggaccca

SEQ ID NO: 106610 - DNA, 2013 bp, Homo sapiens
tggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggaggtaagtagggttgttttgttctttgaattttttttttatcccaaattcattgcttaacttactcatcttcagatgaccactgggggctttttaaatttatttaaatgtttcaaaatgcctactgatttctccaaatactaacctctttagcataaaaattgtggtttatacattatgacagacatatgcagttagaatgataccttaaaacagaaatcagattttgcctttttaaaatgttaagatttaaaaacctaagttgggtgtggtggtacccacctgtagtcctggctgcttgagaggctgaggcaggaagatcacttgagcccaggcatttgagtccagactgggcaacatattgagaccccattctctaaaaagtttttttatatatatataaaaaataataacctttatcctttaaatctcctgaacttggcctgcatagcctgcaaaatgtggctatggtcactccaaacttgtctcatgttcctctcctccatctgatggtgctttagccacactggctgcttttatggagctcctttaatgcttcaagccttttcttgcctcaggccctttgtatttactgtccgttctgcctggaatggtcctttcccagctcttcccagctggctcagtcccattcaggtctccttatgagagagggcttctcccatcactttatctaaagtagctcccaacacttccatataatctttatcacagtttttcataaccttgatcatcatcacctttttagcacaagacgttatttcatgcttttatttatttttcattatttgtctttcattagaatataaagctccataaagccagggcccatgtgtgcatgtggacagctgttatccccagcatttaacacaacacctgactccttttaggtatttatgaatgaataggtattaagtgaataggtatgtgattatttctatttggcagaaacaagaggtctgctaatcatattaaacacttccctccacatgctcgcgtttagtagtttaggatctcagagatctgggttattctaaatctcgaggcattaagcttcctcctttctccttgagtccgtatcccaccctctgcctcaccagaaaacacaggacgtcacactgagcaatactttccaccatattgaagtgtcttgctcctggaatatatacttatatgtgattagtcgtgactgatagttttacacagtgggcctgagaatggctgtttccctgatccttgctaccatgatttgtttcatgaacaacatattcaggccttttgaaaagagatcaagaaccagactttgacttccttttggtttgttgcaacaggagagctcatttgtgtcacagcagccagattctcatgttttcatgaacctgtgtgttctgcgatcagaatggctggggtcatttgaaggaaacccaaaatacagagtagctgtctatgtgaattgaaatgctcaatgagcct

SEQ ID NO: 106611 - DNA, 1119 bp, Homo sapiens
agcgatacctctatctgtaaatttattttatttttattatttttttgagacagagttttgctcttgttgcccaggctggagtgcaatggcgcaatctcagctcactgcaacctctacctcctggattcaagtgattgtcctgcctcagcctcccaagtagctgggattacaggcatccaccacctcatctggctaatttttgtattttttttttttagtagagacaggatttcactatgttggccaggttggttttgaactcctgacctcagtgctccacctgactcagcctcccaaagtgctaggattacaggcatgagccaccacacccccagcctaatttattttaaataagacagctgaatttggagctgtgtggctactgttagtaactacttagtttagggattttgtgtgtgtgtgttgtggggggggtttctttgtttgtttttttggtttgtgttttttaaacaaatatcctaaacttgttttaaacagtaattcttagccctaggcatgcgttggctatatcacaaatttaataaaagatcagataaataggaaaaaatcagttgaatttagaattcaattcaaagtaatgacccttaattttgaaaatagtcattctacatttttgtcaaattattatttgtgactataatatgttttctggtattatctgtgcattttcagcctggattttccgtttgattagttctgttggtttttcaagtggaagccaggcccaaagcagcacatcagaagccatatagcaaaataaaattaaaacaaaacaaaagacataaaacagaccagttccattttctgtgaaggggtttgtggcagctcaattcctgtcaaagtgcatgaatggaaaccaagaagtgtgtcacctgacagggactagtttcatccctctcttgtagtttcttttggaccctggagttgacatactcaatgctttacctccctccatcaacactggggcctaggaacatccttattcctcaaattaagagaggactttcttaagatgctatatgcccaaaggctctagggcataagcgtgaagaattatctatatgttgtctcaaatcttgtttaattctccttttcacc

SEQ ID NO: 106612 - DNA, 1143 bp, Homo sapiens
agatcgagtgtccaatgagggtccacttcgtggtttatagacggccattttctcactgtatcctcatgtggtgcagagtagagagagaaagtactagttctcttcctcttgtaagaattagcccatcatgtgggctccactctcatggtataatcacctcccaaaggccccacttccaaataccattcaatagtgtctgaaggttcaggctcactgaactctccttgagattgactcgtttattcttaccacccttctactgtgtagtctctctgttgatccacacgtttcaagcacttttataatctttggaatataactgataccaaagaaaccagttaaaatccataccatttggctccaagctgtgatttcaataaacattaacctagactttagcctcattggttataactctgggttacctgcctaccggttaagtgtcttgattagccatctagtgtctagtgtcttgtatcttgggcagtatctagtgttgatagactgtcaggaagaagccatatagctaatttggttagattgtttggtagtaattttgccaagttcacaggccaactaaattctcccctgatcaagagtgtacttctaatcttagcaagtgataatttggagatttgctcttatgaaaactctccagcttcaagcttatgcttggagagagatttttgcagctacccctccaccacactcactctatcaccaccgccatcaaaacaataactcacttattgagctcttattatgtgccaggtaccttcccaggcactttacctacattatctgccatggttgtttctcacaactatcatgtgaaataggtatcatcattacctccatttatacttgtgatactcaggcagagaggtttagtaacttgcccaaggccatatagccactaagtagcagagcacagatttgaacactatacatgaggaatagtttaacttctgtttgaaaggtttttggttgttttagtttttgtgggatacctcatttgtgtagtctaaatctatgctgttcggtatggaagccaatggttacatgttgccatttaaatttaaatgaattacagttaaaaaatcaaaaaattaagtttttctgtctcactagccatatttcaag

SEQ ID NO: 106613 - DNA, 1048 bp, Homo sapiens
ggaggaaatttcttgcccccgcagtatttgcattgcaactggtagctaaatccaaaccacttttagcatttttactttaagtggagttactgggcatgaaactaacttttaattttaggaacattacatgtaaagaatcagaaagagctggtagttttgggtgcttttaaaaattacagactaattcatgctctttgtaaaaatatgggcaattcgggagtatagaacattaaattctcccctggttgcccccttcccattctcagagataagccctgtgcagaaattttctagggatatagatatacgcatattttaacaaaaatctgataataatttatacgtatatagtatgtatgtgagacctgttttctcactttttatttcttgcacatattactaagttggctaatatagatttagcttatactttttaatggtgacgtaatattccatttcatgaatgcctctgctttatttagccatttgtttattactagatactctggctttccccagtttttcattgtgatcttttagaatcataggcttaatactcccatcaatataatatgtgaatatcaaatagaatatcaagtataatgcttctgttactataatattgaatataacaaatgtaaaccatagactacaggttggcaaactttttctctaaacagccagataataaagattttaggcttcgtgatttaaacagtcaatctctgttagaactactcacctcagccattgtagtatgcaaatagctgtagacattatgtaaatgaataggtgtagctgtgttcaaataaaactttatgggcactgtaatttcaacttcatgtaattttcatatgtcacaaagtattctcctttttattacttttcaaccatttgagaataaaagttattcttggctcacaggctgtatccaaacaggaattggccccagtttggctagtgggccatagtttgccaaccactgccctggactgtacaatttagagagagtaggtatgtatgtctgtgtacattcacccattgaaat

SEQ ID NO: 106614 - DNA, 1053 bp, Homo sapiens
aaaggggggaaaacctgtctctttgtttgcaaacaagtaacatgtggagcaaaaactatgaaattaatgtctcttgatgtgcagccaaatctgaacaaaacataaactttgagtaattagcctgtatgtgtttgtgtgcatgtgcatgcctctacctcagtctggaactgtttgtggtatatgtaagccttctgccctgatgacatcattatttaaattagtgaccacatgattccttgaattaaacaaaaatctatttcaaatatttcaagtttgtagtattctatcaaagttggtcttaatagctacttctaggactaattattcactttagagtgtggtgttacataagtttgccttgactacgtgtatcagggaagctttaaaattaagttgaataactgttgttctgcctgaaaggattgtttaatgacaaaaaaaacccacaacctagtcccttctttcaccaagtaaaataatatggtgcagtgggcctttccacaacagattcttgttcagacagaactattacctgtttaataaagttttggcctttgatatgaaaccttaggaagttctgtagagcatggttgagttttcagaaaggcacatacatcccccagtgccattgtaccaccacatttaaagaaataaaatcatccgccttagatagtgagctcttagggatcaggagctgtgttactgctttcacaggttaagtgctgagaaagatgggccagcccagagatagcaattgagtgatagttgtgtgcagttcaaaaacccaactgcattttcattaggaacaaggagaagataacatgcagattttattttatttcaaggagagcaaaacaacactattgtactgaaaatgaaacattaattttcatccatttttgcttgtgtaataagatggcctaggaacaaaatgagaaaaccgtaaacatttaagataggaactaggcattcaaggcaagtttaacctatattttcactaaaatctaatttaatagtgatttagaataaaggctgcattttgttaagttttat

SEQ ID NO: 106615 - DNA, 1210 bp, Homo sapiens
gaacagagactagaacgagagttagcaaattggtaatgggtagtcttgtaaagtgaggattgggaaagaaccgaagagatgctcgctgtgtcccttgaactttggcataacctgtctcagtcttatttctttatttgtttagtacggatggttatttgggtaatacaaaaaagccaagcaggacaaacaaaaatcaattaagactagtttaaggaacattataggagcacttgcaataaaagaaggtcactgaggaattgaatagttaagtcttaggattgtgttgttattacgtcccagaccacgtgttgttgaccttgccattgtagtgagtggttgtttatatagtgatgcagcatctgtatgtactgtttgccttagagttgtgtcaatgcaaatcaagtcttgactactctagttattgttgtttaggaataatttatactagcagatgatgccaaattcttgtttctttgctattggaatatattgaattacgtttgctattacgttcagtcctttatgttcaaccttgaacaacattaaaattagtttgcattccgtctgatacatttgctgatggatacataggaaagcataagtttcagctaaattgctgatgaaagcctcggctgatggaagattctttagcaattgaagattgtttaagtagaagattgtttaacatcagtatgagtggaactgtactaagattattgaatctgcctggcatttttgagattgcctaaagacctgaaaatataagtctatttagtatagattattgcattcatttggttttctttatttttgttacgtgagataaagataatcagtcatggttggctagaattatgatagaatagaaccaagctctgtttttcttaacatttggaacctgtctgttgtaattgatgcacatgccaacaatggtcaataactattgatggatctatttttaaagatgtttaataagttgtctttgtggtcattgtgagagggatgacttaaggttcaccctgaatgatagaacaatttgaaactaatttgatcaaaaaaagaatttgtcaatccaatgatattagataaagtaaatgaaagagacagaaataggttttccagacacaaaatgagtgtcttaatcatttgttcagccaatttcaaccactcttgctacctaagtaataggtgtgacagatcactctgctgt

SEQ ID NO: 106616 - DNA, 1265 bp, Homo sapiens
tatgaaaatgcttgttaatacaatattataagtgatagaatactgcaatagcttttactgagaaaaactgtacatagagtgaaagtattgaatggaattggcatttttgttaccaaatctagtaatttttaattcttaaaattcttatctttttgtgttaatgttatttcctttggaacaagaatgtattcataccaaatgcagttagtttataattatctctttaatattagaattcatatattctgtttctagtagaaattctatgtatatctgtgtgcctgtacacacaaacagtataaatatataatcagattatggtaagtatcagtttgcattttctgttgccagttaacgcaaagctgccttgttattatttataacacaaagcagaaaaacatattggttgcaaatattgtccctgtatttctttctgttctctgtaggtcatacatatgaggtgtaacagtatagcatcatacttaattattataaagatttaatatgttctatttcctatctcagaaaatcgagaaactggtttgagattttgatgttagtgaatgactccttctgtcactgctgtgtccagttcagttagaagccctcagtgttgcctttgaactccagaccaatattgtaatccatgtgattgataatgtcaacgattgtctcaaagatacttcgacttagtcgtattaaaaccattaaaactgatgatctttccccccaaattacgtaatatacaaagtgtttcctgtctccattcatggtaaatttatgcatactcaaaattcccccttgatatgtcacttttcttcacacctatttctaacccgtgaaccagctgaattcagttggcatcctaaatatctcttggatccattcactatttttttcaccgcatcttccattctcatctgggatcatgctcatctcccatacagactcttttcactctcctttttatgttgtactcggagaaatcttttaaaatgtaaatgtgatgatgttatcgctgacaacctccacagggtctgcttaggaaatgccaggtccatagcttgctactctgagccctgtgtggtcagcctctctaggttttctcacactatttctctgctctctgctcttcatccccactagtcctcattgagttcctgcctcatgtcagttaaatgtgcatttctctcttagaatacgcttacatttcactatactcttatatttcacaatagttattgaataatttctgtatgtcacgt

SEQ ID NO: 106617 - DNA, 1023 bp, Homo sapiens
tttcacctctcctttcctctgtgtggacttaattctctggcaggtcatgtcaagctttgtcaagatggctccagcacctgcagcatgagaacctattagcaaacaggctccagcctcaagcgaccacctctggcttcatggttccagtaaatcttccatgtctgacattcaaatttgtttgccttagatcatgtacctattcctgacctaataacaaagacaaaaatgatagaatactcctgattggcaaggagtatgatgtagagccaggagtaggtcccgtcctggaccatgtggacctggagtggggaggggcaccacaaggatacctgagtggtgctagcaggagaagagcaaatagatgcagggctgggaatacctacaggcagcctcctcaagggtggtagattattggtggtggtggtgttagtttagtaggcttggcatgtcttccatccagctttcagattacctttactctcatgtgtgtcattgggagcttctcatcagagaaagctttgaaaacagccttttatcattcttcactctgtttttgctaaatcagaaatgtctacagaattactgtgggagatagaaattcactacataccctgattattcagttttaaagccctgtggagattgacatttaatatcatcggcctctataaaaattcaaccagaatgtcaataatgccattcggggatactttgatgacatcacccctgatgtttctagttaataagaaggcaaggagactcaagtatttcgagccttcttttaagactcaagtcatatcagtccacccacatgatactgttctgggggtaactcttggttttcacaggaacataactttttcaaaagaggttccaatctgactcactggtatagctctctccatattctaaacttttgtatacgtttcagcttaattaaccattctttgatctttgccagtgtctaccaaaaatatttatacaaatataaaaataacttataaaatcgtttatacaagagtg

SEQ ID NO: 106618 - DNA, 1046 bp, Homo sapiens
taaagaagacaagaataagcacatctttccaacttggcccaacttcctaattgtggcactgagcttatttatttgatatggtgcttaaaataaatcagctgaaccatttcccttttcccttgcttttctttttttttctgttgacatttttgctctgcaagacaggtcactgcctcagccagcccttgggacttctctaggagagagtttacaagggatgaactattcagtggagggtggggatccagacatggctgttttacaaatgcctctgggtagaagaggctgattatacactttgagcattgcaaaggttttccttcagcatagaagtgcagtgccagggtgacatttcaaattggagttatgggttgcatatttctgcatgttaattaggaagaggatgtcagcattcaataatgttattgttttgcttcctagaaggtctgcaaaaaggcagctgccaatggtataatttttggggacacagagataaaataggggtgaagagagttcttgtttctggttaaagaaagcgagactgtctagagtcctgttctttggcaggccttagaagcagtctgttgtgatgagctctgttggcaaactctgtcgtagaatgttctctgttgataatgaaagtgaccaaatgaaatctgtgctataattggctgttcttctgcttatgaagatggggggagctggcgaagttttctttaattccctgcttagagatccccaaatattcctggagttaaaagtgtagatgtcagagacagactaatctgtatttaaatgccagtcatcatctttgacttgtgtaaatatcagtttctttatgtgaaaatgggaatattgatgcctttttttctctaagattgtttataaagattagagtaagtgaatatatgcgtagtgacacttaatatgtgcacgataaaggtaactttaaaaaatgttgttctttgaatatgtgttgtgataatacactcttttacacattaaccctattatctatctacaacatcaggcctgattggagactg

SEQ ID NO: 106619 - DNA, 1019 bp, Homo sapiens
gtgagactcagtgctcttatggtagcatcccaagttcggcaagctgtggaaatgccagtgttaagggctgggtctttgcttcctaaaaggagccactggtgtgacaaaggagctgttgctcatcctctgcaatctcagcctaaaagcagtgatttaggttggctgtttgagaagtcaagacaatcaccaatggaagaagagaagatacgtgaatcttagccttcctaaaatatcataaccattctagagttttttaaagcctgctttctttgctttatatgtatctttcaggcctggaattaaggacttaatattcttttttcctttctcactcctgcctgctggtggcctttgaaggtcccaggagttactgttaatgattgatggcaaaactgggcgctaacagctgtgggttggatgaccgtttaattttttaactattagaggattgtaggaatgtttaatcaccaagttacccacaatgtcagttgagggaatgctcccatcatagcactgaaagagtcaggcctgtaaaaggtagcctagaaatccccctcttggttgttcttgtatttaaagtgatgagaaggtgggttaaatacagtggtctgggcatgtgaggagagaattgggcttttcactttataagcaattgcaggtatgtccaatgtgttattaaggtaattgaactgcatttccataaagaggatagtttcattaccaaattctttctttaatactgtcataatggcagctgtagcacatataaactaatttgcatgcagataaagaattctgggcagcttggtagcataattgctgcataacatacgttgcaagtaagagctggagcttttactagaggtatgcttgtgggacccatctctctgactttgttaaatttcaaatgaaatacaatcaaggaatagccatttcagtgacgccccatttgttttacaggcagtaacttcccaagttaccttaatttgagcagtcattttggcaaaaaatggcaaaga

SEQ ID NO: 106620 - DNA, 1933 bp, Homo sapiens
gaaggtgggagagggtcaagatcagctaatgatggagaaagagagggaaaggccttaaccaggcaagtatagcaaaggcttactactgcagaaatgagctactgtgtgtatattatatttatgtatatatgtgtatatattatatgtgtatatacatttttatgtgtgttatgtctgtatccatatattatctatgtgtgtgtatacataggtaaaatctatttcactcctaggtatgtactcataagaattgaaaagatttttaaatagaaactcatacatgaatgttcataactgcacataattcacagtagccaaaagttggaaacaacttaaatgtccatcaactgatgaatagataaacaaagcgtggtatatccatgtgagagaatacaactgctcagccatgaaaaggaattaagtaccgatacatgccacattacatgccttgaaaacgtttcactataagaaacatcacactgcaggaagacaggcacaaatgggtacatattgtatcattccatttgtatgaaatatccagaataagcaaattcatagtagttgccaggaacttgggggagaggagaacagggaattaatgcttaatgggtatggagtttctgtttgtggtgatgaaatgttccagaactagatagtgatgatggttggacaacattatgaatgtactgtcactgaattatacaatttaaaattgctcaaatgatgacttttatgctaagtgtattttaccaaaatgtgaaaagtatctactcaaaatctctttcttttaacctgggagcagaaagtccaagcctttttttttttattttaaaaaaagaatatttaccaattaggcattacttaatgacaatattttgtttttgttttttgttggttggttggttggttttgaaacagggtctccatctgttgcccaggctggagtgcagtggtgcagtctcagctcactgtaacctctgctttcagggttccagtgattctctcacctcagcttctgagtagctgagactagagatgtgtgccacaatgcttggctaatttttaaatttttttgtagggacaagttctcactctattgtccaggctggtctcaaacttctgggctcaagcaatcctcctgtcttggcctcccaaagtgttaggattccaggtgtgagccactacgcctgactccatagtattttgaatggtaaaataatgttttggtacaggggccagtttttaccttgagaagaggggaaatattgggagttgacatttgctgagcatttgttctctgctacacatcctgcaaagtgcttaactcttatagattatcaaattgaaatgatcacaacagccctttgtgataggtgatattttcttcacattacaggttcagaaattgagatgcagatggttctgtgacccgccttttatcttactaaagagaggtataagttcattggagtttccactccatggggacagacactacatctccttatatatccatggtgactttaggccctagtccctgtcctgccatggtgtatctattgaatctcttccatgaatgaatgaaggacttcggctatgtaaagtagcaccatgtttgacagcaatttcgctgtgttgaaaatcttagttttgagaaacgcttagataaattttgcaatattggatgaattttgcaatgttatatcaatttgtgacagttgacgtggagtgaaagaaaagcgaggtaaaaataaagtgcttctgttagttttcagtctaaatttcagaacacctttttcaaggtgtttcagtttttttcttgatgtaaatgatagcagtggagcaaggagaaattaaaaagccattttttgttaacttatgatactcttaaaatctttgtagtctttcacccaactgaaaaaaagcagtctgt

SEQ ID NO: 106621 - DNA, 1051 bp, Homo sapiens
ccaaaataaatataaaatgccaggaagtgatatatgctgttatgtaaaataatgaatcagggtgagggggatagagaataaaggggtttgatgtaattttagatagagtagtccaggaaggcatgtataaactgagaagtctctctcctattggttgtgattactgatctcgaatatttcttttagcttagaagttactgaacataacatatagcataagttgttatagcataagttgctgttgtatgtggtttgtgactttccctttgagcccatcttgatgttaagcactttccatatgttgtttaatattcccattgatcttatgagaaagctcttaagcctttgctgtggaagtgagtgtaggggaagtgagagaggttaccttacttgcctgagttcaggtagtaagtggcagagctgatcctgaaatccaaactttgtttaaagcccctggaaacctatcattagcaaggactgagaagcctagggttagtgctctcccaggttcctgaggctaagaaggaaaatgcacttgtggtgaaaactactgtggtgaaaggttaattagaaagcattggtatgtaaactgtatttatattgacgacagactgcttttgtttccagaaagtgggtaaaggcacaggcctctcttcatatgctaaatagttgccacagtctgctagagtgcccaggaaaccagctccctttgtgtctaggaatagtgtggaaagcctggccaggcttttgatccaagtatatttccttgcaccctcctcattgagcacttctgctttggccatgatcacaaatgaggatacaggttaaaaggacacaggcatcttttttgtttgttcttggtcccagagaacacggtatccatttcagatggttgcttggcaatattgtgcagaagaggttttctctttgacagtagctgatatgtgtttctggttgacagtagttggtgtgtctttttgatggtagttggtatgtgtctgtttgacagtagttggtatgtgtgtttgtttgatgtagttggtacatgttt

SEQ ID NO: 106622 - DNA, 1052 bp, Homo sapiens
tgtttaattttctcgccatggctaagtgcctgcaagcttttgatgggatcatcacatttttttgaggggaagggtgtctactagatggaattcctataaaataaatggtgcatcatcctgcctgtagagattgctcatgagggaggcctctcgagaagtcttcatggacctctgacaccttagatcaagcttggtccttcttaggaactctgtagatgcttaagaatgaatagatggctagaatatgagtcatctaagaatttataatttcatcacaataaaggcctgtctgaaagtaaggaagttttacttcactatgggtacttcctggcctttgacacacatcttatgtacaattccactattctgacctcttgtaattaggtcttttaaggaagtagtctccaaagtgagaaatgacccatgagaatacaggaagaagtcctcaggagttccatgtatatacatttttaaaatgttacctttttaatatcatatatacaccacatgttactggtatgccatctctctctctctctctttggctgaaccatcaaaagtaagtggctgacattatgccacttcacctttgcccccattttccatttctcaagtttcttttaagttactctattttgggataggtgttaaattttttgctttctcatgggtttgtcagaagtgacgcattatgaggggatgcgtattttaagagttgtgtctgaagttttcatatgtgtccatttctaagatttaggtcttaatttccgtcatctctaaccattttggtaaactgaaactaatgtacaagtttccgttgcagcccgcccctttccaaagatatagatcctcctgcactagatgagattgatataaatgacagtgatggtgaagatattagcaaatggtaacatgcatgtggctgtttatatttataaatcacactcacatgtattacttaatctacaaaataaccccatcaggtttgcattatgtttgttttcagaaataaccctaatcatactacctgcctctgaatatttctgacagct

SEQ ID NO: 106623 - DNA, 1362 bp, Homo sapiens
tggtggtccccagtgcagggagaggggatggtagggtgcctaggccttcttgcgagctgtgtgccaactgcccctcttgtccctcattgggatgcttcatctgtgggcggaaggctcctctgaggtggtgagagcctcatttcacctgggatgcccccaataccccatggctctagtttctgtggcttccctgctcactcacaggaaatgtaacttctggcaatcaggcctgtctgccatgagcagagcttcttcctccagagcaaagcgtattcacatcagactgaatgggttccagtctgcagagctggttattgctggttattgccgcagggttgcaggaggttattggagacctttgcttgaggagctctgggatggtagttttggagttcctcaattacttcatttactcctcatttgaacattgttcttaacttttcttcattgttctaagctcccaatgaacttcatagttgaccttttttctcaacatgtggtatgtttgaactccaggctctgccctgagtctgggatagaacatacctgattgtaattctgttatggagtgaatatgggcaaataaccatagttgcaagctgtatggagtacctaaacatagggcaaacactgctatcagctcttcatatatatattcctcttcaatacactcagccaccaagaatatcattcccactaaacagataaacagaagtgggatttgtccagtgcacacagctaccatgtgactgtgctcggatttgaatctaggcagtagccctccagagctcctgcttttaaccctgcttctttgcagaaagtgggcagtacaacttctccatggtttcattctggggtaccttgaggtgacaaaaaagaatacccagatgtggagtaggtagatgtgggttgaataatggatcccacatttataaaaatcataaggtaacctgtataaatcctacgtgatatgttatactctggtaatagatataaaatgccatctcataatttataagcagatattatcagatgtatttagaagttaacaatagtgtcataccctttatagagattttaaagcagaggctgtctacgctgacattcagctctatcgcttaggggttgaattaacgtggcaaagtatctaagccactgtaagagtcagctttcctatccttacattgagttattttgcataagagatgcgcttaaaacagcacagagcctggcacacattttaggtgctcaagaaatcttggggttattgttttataagtcagcatggactcttgtattggttatgtatttattttgtaagatggattgatgtaacagtggttcagcattactccttcagct

SEQ ID NO: 106624 - DNA, 1046 bp, Homo sapiens
gcagagaccaacagctgatcattcttacattctaggcaagaaacatgttaagtgaatgcctagtttccatcaggctctgtatcaagcgtgtttggttttttgtttgtttgttttgttttgagacagggtcttgctctctcaggctggtgtgcagtggcatgaacatggctcactgtagcctcaacctctgggctcaagcgattctcctgcctcagcctcacaagtagctgggaccacaggcacgcatcactatgcctggcaattttcttttatttttttgtagagacggggtctcaccttgttgcccagcctggtcttgaccttggctcaagtgttcctccagccttggccttgcaaattgctgagattacaggcatgagccaccataccaggctgggtgttcatatttttttaaatggcaccacctctcacctatcaaagatctactgtgttcaagcagtgttctaggcatgtgctacgtaccaggcattggacataggagctcacctccccatccactcccatgagcaaaaggcagagaacaggagccatatcctgtccctaatgtgaggagatatgacaagagcagatgaatttgacatggcagtagtggacaggataagacttataaagcatggcctcatagctattctgaggcagaaaggaatccggaaaatactatgttaaccatgatattagggattattgtcttgttttgttcatagctgattccccagcctctggaagggcctagcatgggtgggcctttaaaatacttttgttgaaaaaattgaatgagtaaatcaccatttaaaaaaaccttttaatttcgaaataatttagacttagagaaaagttacaaaaattgtatggcgtgttcccatttattctcctctcagctttccctaatgttgacatcttacataaccatggtatcatgatcaaaatcaggaaattaacattggctattaactaatccatgtactattaacatgtacagtactattacctaaaccatgactatttggagttcaccattttcccct

SEQ ID NO: 106625 - DNA, 1040 bp, Homo sapiens
attatttctaaaactccttttcagcttgtgcatctcaagattctgagtcttttctagaagaaaccagaacttcatacttaatctgtctcatgtctcttgtattttcagggtgttcatagaccccctaagcttgttcctgaacacttcaggatcctttgagttcaagttaagcacctccttgaattttgcttcttgtgtttagatttttctgagtggtgggtttcgttccttaaggctcaagcctttgcaaataatcccctccttagtcctgttagagttcttagtaccatttgccccagccatagattgggtgtcctgttgttaagggtgagggagaaaatacaacaatacgggggaaacaaaagctctcaaaatactttaataaaatgagctttctgctatgaataactcatagctctgccaaatagggaagatttattgatagaaaaagaagatagctgtcacatttccaagttttcctagcagtgtttgaagatctataaaagctttttctacctggaggtacaaagtcttgacaaaaacctcaggtacagagtccattagagaaacagggaaagtaccaggtctaacgctgtctaagtgccttggacagcttgtttttatttattccctgtatatctgccatactgatagttttgtatccctaagaattactgaaggaaagatctactggcgtaaccatttttaaaaagtgggcttcgtttgtgctgatgcaaaaatttatgaatcactttctctgatgctcatattagcgaatgtagtagttcccatctggactaatcactgagcagtcttcctcccagacttccctagtgtttggagattttgccacatgtcttttgttgtttttagtgggcaccatagtagaaaacccacccacattggcctgcctcatcattgtgactttgtaccagatgggtttcacttggtggcttttctttgtcctttgcagagctgtttctttcctatgtccctcttttcctatctggagggggagaggagtgggagtagcaggaaac

SEQ ID NO: 106626 - DNA, 1654 bp, Homo sapiens
atgataataatgaatatgaatataaaggcttggcatactggtctcatacaagtaagcagtcagtaactatcaattgccagcaatatttgtcttgaatttgtaacaactcctagtaactacctaatgaatcagcaccatcatcaaccaattttactgaagagaacattgaatcttagagagcagagtaaccttacccagggttactctgctactaagtggctaagtctgggttcaaatccaggttggtctgatttgactgtttggtccactctcaaggtgtctcactcacatgtcaggtcagttcacactgggttttggcaggaagctatgtggacttctccctagggttgtttgagggatctcatggcatggcaggcagcatccctagaacaaaagaccaaagacagagcaagttggaagttttaatgtcttttatgacctcacttcaggaatcacattccatcatttctgcaacatcaggccagctctcttcatgtgggagggagactaactacactggagcttgaacacctgggggcaagaatcattgagtgtcaccttgaaagctggtgttcagttgcatactgatgttcccactgtgagttgcaagctgtccaatagtctgttgtttgttttcaaacttgcttatatcattgttactctaacaatataatttaattaaatattatataaaccaatgaaatgtaagtggggagggaaagctgatatttccctgaaaatttattggaatccattaggacaacttaataaagttctcttgcttaaaaattgtgttaaattaggtgtacgtaaagactgtaaaatataaagggaagtcataaaaaatctaaagcactcaaattggtttgcaagtgtgtttacattatcactgtgtttcaaataagcccaaattagaaatcatagacactgaattataagtatggtttatatcatgaaagatactacagatcccaaacagggaacctaggttcaaaaaaagttaatctactttaaaagatggatgcaagaatgaacactgtgtgtgttaaaataaaatgctttaaatacatatgaataattttatatgatttcttgctttgtgcaagaattaactcatcgtttactggtctcatttttgtgttggaacaagggcttttaatttatgagatgtcccacaagttctttcttacctgttaattattacaaaaggaagtttaccatattgtgttctttcaagagtcataaatcagtttggcaaattggcttgcacttgtaatcccacctccccagaaggctgagatgggaggattgctttagccgaaaagttcaaggctgcagtgagctatgatcttgccactgtactatagcctgggaaacagagatagagcttgtctctaaaaaacaaaaacaaaaaacacaacaaagaacaaagcataacaaaacaagccaagagtcctataagtcattacttttttacaatactatatttatcaattctaagatgcatagtgttctacattttaatatttcagaattcaaaatgcattctacaatgagtggcattctgtaacttaattggcagtatttcttctgccttgttgcttcataagctataattgttgcctcagatttgataaaacgtggtaagttttat

SEQ ID NO: 106627 - DNA, 1024 bp, Homo sapiens
tgcgatcgtggctcactgcagcctctgcctcctgggttcaagcaattctcctgcctcagcctccagagtagctgggattataggtgtgcaccaccacacccggctaatttttgtatttttagtagagacagggtttcaccatgttgaccaggctggtcttgaactcctaacctcaagtgatctgcctgcctcagcctcccaaagtgctgggattacagtcatgagtcaccgtgcccgaccataagcaatgtttcttaatgagagtagtgttgtccaaactgagccacactgtcatactggagaagttgaggatctgagaagtgaagtcactcaaaacactgactttaacaaccgtgaacacaaatgaccactgagttttgttttttgttttgcttttgattttcttaactactactgtcttgaaatattttctggccatgaatggtcctatgtatttctaattagtattgacatactaggtttggctatatattgtggattaacattaaggaatatgatagactattgataaaaataattattttctattggagttagcctgcacctgacataagctacagcatcagatactgaagaaaagggaatggaaaaagatgtcttaaatcatgcaccttttttctcttgctcagctgtcactagagatgtgtttcacctttaatgaattgtttgtgcccgtatatatgtgtgtgcacccgtgtgtatgctgatgtgcttgcaggcttgttttggagcctattcgtgttatctaggtttggaaagaatgaaataatcgtcacagtatctcagcagttcagctggccttgactgaaggtcgattgtttttaggtcctctgggtaagagtattcaggagatggagcccccactggctcatctctaagttgtcacctcacttggtctacaggctttggaagcatattgtgtttctgccattgatgagctggttggcagtatggggccagtaaacttattctcacacaggcatttaatgatgagaaaaaaatt

SEQ ID NO: 106628 - DNA, 1052 bp, Homo sapiens
tggagagaaacaatctgttctttggccagagtttgacccttctggaaacaaatcaaatgttcctatgatctagttgctgctttggggaaaaaaggtagtgtagtgggcatgggtttttgtaactagacaggtctgaccttgaatcctggacctgctatgggcctttgatttctctgcgtttaagatgaacataataatacttatgggacaatattgttataaggataataaggataataaaggaaaacagcatatcataaatggtaatttctactaccactactatggctgcttctacttataggatcagagaaactcaaggtctctagttcaactttgcactcaatgcctgagtcctgtctccgtgtttgacaggcagcctcttgcctctgcttaactactttgaaggatagatgtctgtgaccctgtgatgcagtctttcttcccctggagtggacagtagtaactccccagctggttattcagtttcccctcattttgtgcaatgcaatagaatgcactctggaaacattggctggctttctttccctttaacaccatttgcttgttcctagttcctggtgtttacatttactgccctcttagccttggcaaattcagctctcctcatttaaggtcatttgaccttagatcatcctctgatctcttagagtattaatttaattgtttataaaaatgagataattatagttcctttctatagggtgatattgataagatattattcttaaagtattgaggatggtacctggcacataataaatgctcagtattgtaaactagtctactctgcctcatttttgttagtcagaattaaataggatgattaccttcctcgtttttcacattattgtcctgttaaaggataatctttttctgtccctttctcctgtatacttttttctaatttgtgcatatatgcttattttttatctccacccaaagagtagaactttagttttttaatctgttatgaggttgggtatatttgccaaaactgaaaaaatgagttaaagccctcatttggtgcc

SEQ ID NO: 106629 - DNA, 1098 bp, Homo sapiens
ctcatggtatggatgtatcatcttttgtttgtttattcacccattgataggtatttggtttgtttccagtttgtctattacagattaagctgctatgaacatttgtgtgtaagtctttatatggatgtatgctttcatttctcttgagtaaatatctgtgggtggaattactgggtcacatggtcatctctctttttaagaaatctcttaaccttcccagagtgattgcatcactttatattcctgcccagcagtgtaggagagtttcacttcttccacattttcatcaatacttgctttggtcagtctttttaactttaacctttctaatagtatatcttggtacctcattatggttttaatttttatttctataatgactaatttttcatgtgctcatttgccatccatatgtcttttttgttaaagtgtttaattcaaatattttactctctttttagttggtgttttgtttggaactctatagattctgaatataagacctttttcagatatgtgatttgtacatactttttcccaatatgtgccttacgttttcatcctcttaacagtgtcttttggggaacagagatttttaactatgaagcaatacaaattaccaattgtttccttaatagattgtggttttggtgtgatatctgtttttacttaacctaaagtcacaaaagttttcttctataagttttatggttttcggttttagttttatgtctatgatccattccgagttgaagttaatttttttaaatgtgaaagtccaattgttttagtgtcacttgttgaaaagatttcctttctccacttaattgtctttgcatctttgttggtaattagttgtccatatatgtgagggcttatttcttgattctctattctgtttcactcatatactcacctttctttacaccagtacaacactgtcttgattactggagatttataatgtcttgaagttaggtactattagttttccaactttattcttcattttcaaatttgtttttgctattctaggtccttcaatattccatgtaaattttagaatcactttgtccattttgacaaaacgtatggtag

SEQ ID NO: 106630 - DNA, 1058 bp, Homo sapiens
atcaatttacaggtaagaaaagtgaagctcagagaataatcctggtggcagatacctaaatgtggtattgtgtagcaaggaatctagtagtgaaaggattcagaaaaagtcaagtttattatgacctgagcttagtcaataggaggcttcctggaatgtatgagttctgaattggctcttaaaggaaaccgttacttaaatgcaagacaaaatgcagatagcagtacaacgcccatttttcttgatttaagcaaagcaacaagatagcacagagacagcctggcaaaaagatgaagataaaaacgtatttgcctacttcagtcaggcatcatcagcatcatcaacaagacccctggatggcagagcgggttcaccatttgtattagctccagcctgttagagctggaatcttttattcaggctcagagaggaagagtgcggggattgattagcattgtctacgtaggattgacaaggatcaccactaatttcatgctaatgtgtcacacatgtcatgatattggtgtcactatattgattgttctagcaccctgagctgaattttcagagggccactgttagaattattatcaaacaggttattaatacgtgttacttgattaattagatatttagaaacaagaagcaaacagaaaaccgctaaaaatgctaagtatgcatgctctacattttataaaatctgtgtgtatatatacataaagtaattagaaaacaaaattagacaaatatctaatgactctaaaaacatctttactgaggtagaattaatatacaatatcctgtccatgcttagaatgtatgatttgataagtcttgacttgtgcatatacccataaaaccagcaccacaattaagaaaacgaacatacattagctcccccaaaaatgtccttgtgcccctttataatcactctcctctaccctgtatctcccgatttcaagacaaccagtaacatgttatctggtgctaagtttgttttatctagaattatatgtgaatgtaatcatgtggtatgtattttttttgtggcatcagga

SEQ ID NO: 106631 - DNA, 1175 bp, Homo sapiens
gaaggccaaggggcggacagcattgcatttccagtagaatcacattatttattcattcaagttacacaagtcgtgtgtgagagtgtgtgagagagagaaagagagacagagacagaccacaaacaggagcgaataaaggcaaataaaagaatgtggttgattctgcctgccttagagtctgtgcctgagccagggtgagatgagagacatggttcgactattctcagttcccagaagcctcccatggcatcagcaccttgatgagccaagtgtgagtctgctgtgtaaagacacacattttgtatacagcctggctccttaagtgtaagccatcttcttcatccagggctcacctggagaaacgtagcactgttctaacactaaaggcaaactggtggtgttgaatttagtgagagtagaatattatattttgtggatagtttaagggattcttcaaggactgttttgacagctgtgcagggccaggattggggtgacacgaggaggcactcaccaccggcacagaattgaagggagtgctagaaacctcagtaatgaggataaataatattttaatgtaatattttttaatcaaaattattttaagtgaagataggagccgtgtttgatttttcattttgcctcaggctttgatatggctcagtcctgcactgctctgattttgcctttgtttaaaactgatgttttattcataatggattctttgcattatttttattttaaaaaatattgcatgaaatattatttctttcatatgtggagggtttttttggcgtatcctttaaatttacattccaggattatgattcatttgtttcactctagtccagctctgcctgtgatatttgccttgacttctaactatagaaaccctgagtaaaatgtaactccaagggacaaaaagagcacctagggtgactgtcttcaagtagctgagttattatagagtattaagtgtgtatgtggatcgaacttaatgtgccatggtatgtgaaagactacttacatatttacttacagctatttgttgaacacttactctgtgtctggcactgttctaggcactagggttatataaactagacaaaatgtctgaatttgtggagtctacatcccaggggtaaccatacatcatctctagtcctgaagacaac

SEQ ID NO: 106632 - DNA, 2206 bp, Homo sapiens
acactcacttggaatgcatttatgagctagagaggactgggggattatgtaggccaacccatttatttaacaaaataacagtcattttacatgttgaatctaccacaggggctagtgcaatgcctgacatacactaggttccagttgtgtacactttttttcaaaagatatttatcaaacatctactatgttcctggcacttttctaagtgtcaggaatatattcaggattggaaggaaaattgttgttctcagggagtttaagattctagctggaggtcagtaagggagagttagataaggaccgcaaagtattagtaagtgagttatatggtatatctgaaaatgataatgcctgtgaatggaaaaggaaaaatagagcaaggtaaggggtattgggtatgctgatgggagatgaatggcaggtttcagtagggcttaattaggaatgtgatgtttgtgcaagagatagagtggagagtattaacttcacaaatggcaggggaagagggattccaggtaaagggaacagccagtgccaggtcactaagggaggaccatgcctaaattgtatgaatagcagcaagggggcagggacagtgtggctgggacaaagtgagcagaggaagtgaaagtactagaagatgaagttaaagcagtaatagagaatcgggtcatgtggcaacttcagcatgtacaatataggtttttgggtttttgagcagagaacttccgtggcctcatttgcctttttttttcttgtacagtaattttcctttttactggacagtaaaattctcttattcatgtacatttctgtgatctttagtaaaggttcatatacaagtcatatcgtcactacatcattccagaaaagtcctttgtgctgccccctttttgactcaacatttcaaagaatgattctggatgctctttggatatagagtgtgcctctcagactgtagggagtcaaacttggatgcagaagaccagttatgaggcttgcacagctatcaaggtgagtggtgatgggagctggcacagggtgtgtagatatttttgatgggtggtatgagaataagacaggagaaaaggatgatattaatatcctgacttttgccctaagctcagagaagggctggagtcatccgttactgagatgggacaggcttgcaggtggagcccatttgaaggggaagataattgtttaactctgggtattttgaatctaaatatctattagatatgcaagcagaggtatcaccagggaaggctgctgaattgaaatgtacacattaatgtgtggaaaccggtgtgcacactgtaagagaaacaactgacaaaaaaatctgtgattcttatagaagcgacttgtcagtcttaagcattcagaggtgcttgagtaatctgatagcccaagattggtatctgccacatatttttttttattgtccttcacttctttattcatgctttggtagaaagatatatttactttatgtgcagaaaataccacaaagttcagtacagctctaattgtcctggtgtttgcgtgacttgttaattgaaaaaaataacctgtgttaggagtaaggaagaactggttcagaggattctttttattctgcaaaagttgtttgactccaggaagaacttttggtgtttgactttgggtcactgtgtatcgatttgctcacttctgatgtctgtagctgtcattgcacttgaattgaagaagagagaactgaagagaaggttaaaattaaaagcaagatgcgagattacttggccaagaaaaaaaaaaggagaaaaaagaaaagacaaaccaaatgggatacaaaattatttatatagtctcatctcaaattagattgaaaacttgtatgtacatgtacagaatacattctggaaagtgctaacagttgttatctctgtgttgctaattgatgggagagtttgcttcattttaaatttttttcctatgttttcaggactttctcaatgaacagatacatttttctttttaaaacttgttcaggaaatgtttatttaatatggagttaagtcctggacttgggatagaccagtgaacgaggcagaaaaagtctttgccctcagagagctaatagtttcataagatcatgtgaaattgttataattttttaatcagaaaaaagatacagtaattaatgaaaaaagagtgccag

SEQ ID NO: 106633 - DNA, 1734 bp, Homo sapiens
cttgttcctaggtttctcgtccacttgaatgtgaaatctttgagtaattgctaagtaaatcaatggcttcccagctttgtgtcaaacactgcttatcgctcaggtctactgaggttgctgccagttgtgtcttggctgtttttaggatagtgggtatgttgtagtctggtttttttctttctccaagaaaccaggccaatagatatagcatctgggttcctataagctgaccctattttaaagaaattgctgactttggcagggtactgtcagagcctcaccaattccagcattggcctcctgaaaaccattgttccaactggtctctgctgagtcagctgtcagaattaggccaaagtagctcattctgtaggctgggcaatgcttgataacaaccttccatggaaaggaaaaaaattcactttaagccagtttgccttttttttttttttttttttcaagagtagatttttgaggccctgactaatggaaataggggtagagaatgtcagagtctggatgtgctgtgatgtgttaattattattttattgctatgaacttcacaccactgtcactgtggaaagttctccagattgaactgcctttcatattcttgtgatctgtttcacctttgaaagactagtagaggtcacagtctcatcttcagggagaaaatgacagagcttttcttagtatagattttcaaaacaactttcacctggtgaattagcacctaacctgaatgtgttctttagttcttcttcatttaaaacttggttagatcattcctttgagtccttaaagagccctattcttcttcagcctcattttgtacctgttcaaacactaagagctggtccatgggagtgcagtttatagtgagaaggtgattgtacttgaactttctcctgctttcaacctcctttctgttgctgttcagtttatcttttggtagtggtgttggcagagctgtttaaaaaaaaaaccttgtagttagttcccatttccctgctgtcagtaagaaatatcattcttagaatcttaggaatgtcactggaattcaacaaaatggggttctagttagagattagagaaacaaatatattatttgtgactctgagagacagggtaactctatcctggttagcagccctctcccactgtaacatagcttcattcagctgtcttgcaagacgcatgttttggtgctgagagtaatgaaagtagtgtcatcataggttagaagactttcaaaatcagttctaagatccttaaatagtgtaaatctaagagcagcaataacaacttgggagagaaggtgcttgacatctggactcacactgtccaggtcagtggtcactagccacatgtgactgttggggccattgagatacgtggtcagtgtaaagtggaccccaattttgaagacttagtatgagagataaaaggcaaaatatctcattaataattttttattgatttcatgttgaaattacagtagtttggatatattgggttagagaaaatacactattaagtgcatttcacttgtttggtttgacttatttttaacattacgtaacttaaaatcatatatgtggtttacattatgtctgtgttgcacagtgctgatggactggtgtgacaatgatacctgtaattctagaagttgtagaaggagaagtcatgtctcatgtcagcgttcatttgctgatgtggcgtatgtatctttg

SEQ ID NO: 106634 - DNA, 2750 bp, Homo sapiens
ttttttactttcagtacagtattcaataaattacatgtgatattcaacactttgttataaaataggctttgtgttagatgattttgcccagctctaggctaatgtaaatgttttgagcacgtttaagataggccagcctaagctatgatgttcagtaggttaggtgtgttcccagtaaaccagtggtttattgggacataactccaaagtgagtcgaggagcatctgtatcccaatggcattaagaaaaaagtagcaaagtcttgggcccagcaatatcttattggggaatgtcaaagatttcaaatgagcttcaaccccaacctcaaaagcaaagccctcacacagcaatagttagggatctcggggtaattcaccaggttgttcttacagtgcctcttccataatgggaaagcagcaagcctttgggaaattttagcttctcctgtgaagaaaaactgtgcatcagcttttgtgacctgttacaggctaaggagaaaccttcattcgcccataccagaagcttccctgtgccctgtttgcattttccagaatgcagaatgaagatattggagcgaactgttctgcttgccaactagtgagaaggtgttaaaaaaaaaaaatctgttacttgccaatttgaaattgttcatgttccaacattttgtcattaagaatacgtcttgtagtttgggatggctttaggcaaaattttagtatttttgtgtatctttgtatatttttgtgtatttagtattttgtgtatttagtatttttgtgtatctttgtgtttaatttctgtcattcaaatcacatttgttgaagcaaattgtattcattttgaaaattaacttgcaacaaaagttactctttttggtatgcagtgctctgagtttcagcagttgcatacaatcatgtaactaccacttcattcaaactatagaataataatactatcacccctaaaaatcagcattcctaaaattattttctactgaccatttgtagtcaatcctttccacctcctccaagcaattatatccattttctattcctaataattttgcctttttttctgaatatcatgtaagtgggataatctagtgtataaaggtattagatttagcttttctcacttaataaaatggacttaagcttcatccctgttgttgctttttttttttagacagggtctctttctgttgctcaggctagagtacagtggcatgaccatggctcactccaacctaaacctcctgggctcaagcgataccctcaccacagtcatccaagtagctgagggtacaggcatgcgccaccaacgccctgataattttttaaattttttgtacagacagggtctcactatagtgccagggctggtctcgaactcctgggctccgctgatcctcctgcttcagcctcccaaagtactgggattacaggtgtgagccactgcacccggcctgtgtttttgcttgtgtcattattttgttcctttgtattgttgcatattattccattgtatgaatatactatagtatgtgtagccattcaccagttaaagggcagtagaattgttctcatttttgggaattaagaataaagttgctaaaggagacttcaaagacagcaagagaataggttcagagggccagagagataactaaatatgtattagataggtatttgtgtcaacagtggttttcattttgctaggtagatacctagaattgagatctctgtgtagtatggcacatatatgtccaactttataagaaactgtcaagctttttccaaagtggctgtaccatttttcattttcatcagcaacatctaagagttacagaagctctgcatcttcacctgcccttggtattaaaattaaaaacattttttctttgcctttctagcagtgtggtgacatttcactgtgattttaacttgcattttcgaaatgattaaggatgttgaacatgttttcatctgcttatttgccatctgtatattttcttttgtgaagtgtctgttcaaatcctttatccacatttaaaattgggttgtttataatcatacattttaatgcattgcacaagctgtcagtcagtcctgctcaccattgatttgcctgattcttttaataccaagatgatatcttattttcagacattaagcttatgataggagttggacagatctgggtttatatcttggctctgtccttgactgtctgaatgaccctggcaaatcatttgacctctgtaaggctcagttacctcatctataaatggtcttaatgactaattgctgatgttgttaggattaaatgagtccctcacatagaacctgaaacatgataggcattcagtgaatggtagttcttattacacatcaataagtcttactgacttaggtgaatcaatttggcccgtctgcctttctcacaatggatatgaaggtccctgaatgcgggtccttgttgggttcagtttcccattatagcaccagtgtctagcacagtacctggtacaagaaagatttaaatgaactggtcgaatggataaatgaatgagataaaaatgagtactgttatacttgacttggcaagaatatcacaaatatagttttgcgaggcactatcctgaatctagaaatgtttgttgaactatatctttattacattttccatttattttagtgctgtagtcattgataatctttgtaccacacacttcaaatttatttttaggt

SEQ ID NO: 106635 - DNA, 1883 bp, Homo sapiens
ctttacatctgggcaactttccatgtcagtagatgcatgcctactttattctttctaataataattggaacctacttttgttaggttgctatgtgctagggctggctgatttagtcctcacagaaacactaagatatatttatttattcaacaagtatttatttaacaatctttatgtgctaggaactgtgttctgcctgcctggtatatatgatcaaccaaaacagatgaagatcccttatagggtttatgttctagtcaggtgaaatcaaaacagtacatgtaatagttgagtgaatcatttcgtatattagaaggtgggacattatacgagggaaaaagcagagcagagtaagggggttgagtgtggagattgggcatgttgcagtttttaaatagagttttcaaggtgtcaagggtcgacctcactggaaaagtaacatataagcacaaacctgaatgcatgagggaaggagccatgtgcataactgggtaaaagccaatccattgcaaaggccctgtggcagaagtggtacctgcattttcagaggaacagcaaggaggccggagtggcagaaatagagtgaacaagggttagaactatgggaggagaggtcagagtataaggaagaatgacagattatgctagacattttagaccctaaccaaccacgccacccagaatgaaataggagccattgcagagtcttgatccaggcagtaacatgctcccaatgaacattcacaaagcctcactgaaggtagtaggatgaggttttccgaaggagcggaagcagagagcactgacaggaagttgttatgacaggaagttgttataatcctggtgtgagattatagtggccagaccagagtaatggtagtggaggtgtacaaagtggttatatatattttgagagtagactcatgcctgatggatgacctgaggggtgtgagaaaaagagaggaattgagaatgactccaagggttttggttttttgctttttaacatgaacaactggaaggacagaatagtcatttgctagatgggggacaccaggcgggggtgggtcatctcttagtttaagatcaggagtttcattttggacatagtgagcttgacagtcaggactctcaagaagtcagtggttgtagatggtggagttcatggaaaattttgctgtaccatgatttagcccaacattccccagtttttgaatgatggaaacggtgatgaaaggaacatccttgcacacgtagctttgtgtgtattgtgaattcttctgtaagttaaactcctgagagtggcatcactgagttaaagagaatgcacattttaggatttgaaaaactcccaaattgttccactaaaagaattatataatttacattctcatcagcatgtgtaagcgtgttcattctcttgtttcttaaagttttgctggtttgataggtgaaaaaacatggactttttatagtctttaccgcaagttcatgtttcctttggccttagaggctctgtctagattctggaagatgtaggaatttatcctgtcctgtgaaggtttgcctatcctgggcacagtagtgatgtaggtcacatttggtaggacagactaattgcttgaggacttagctctctgcaaggatgtaatatattcagcattgttcaagcagctaattaaagacgaatgggggggacagctaagtagcagttttaaagtacatctcctttaaaaggggaaattttgaattatatcatcctcagaaagaacagtttattctgacatttggacaagttttaatagcaagtgttgaattaaaatagttggcacaaccaagatagttaagagcaccgagtgaattcagatttctttacagttat

SEQ ID NO: 106636 - DNA, 1216 bp, Homo sapiens
atgagatatcaatatgtttcccgtatttctatatctagtcgtaagcacaatgcttagcaggtaatacacgttcaataaatacttgaatgaatggacacattaagaactttgaccttatgcagtcattatgaagttcaggctgtttcctagagtgctattgtaattatcaaagcaatgcaaaaaagtacaactccttgaaaaatcattttgaaaatagaaaatgaaacataagtttgtttgtatttaatgatacatattattttccaccaaccagatagtttatcctatattctattggaagtaaaaaatcatttagatttctactctgctcactgttgaattgttctgaaaagttcatactgctcgcctgattaaagaatctcctttcccccccatccttcacaatctactagtccttgcatctgaattattgcactgggtatatttctttgccacaataaagattagatcagtgggaatctacaaatttgacaaagactgtatgaaataacttggctataagacagtaagtgctataattttctcattaattgtggagtcatgccaaagagagttgctttaaaaatacatgattatagatagtgacctgaaagggaagccaaaaaagtctgtaaacatttaaactcctttttatgaggcttaacactccagtttatggatgcttttgctatatccctttctagcttgggactttttaatttactacttttaattttacctgaaggtgaccttatattgagaataacttataatatttgagtgcctactatgtggtaggcgcttgttaggcactggggaatcatagccccatcaacaaaatataaaaaccccctgccctcctgtagcttgtattagaacccatcttaatttacttctaataagatcagggaatagggaataaggtaaaaatgattagttaaaatgagatctttccactatgggaagtttttcccagaagttactgtggttggcaaaacaaaagttgggttcgttgcttgcagaaaagtcaagcacaatggaaaaatgcagcataaaattacacactagccctcattctttctgaagtccaactctccaaaagtaactgcatgtgcgtgtgttcctttgtttccctcctaacttttctgcactaatatatatatgcacatagcttttttcttttttctttcaaagaagatgctatcacactctacct

SEQ ID NO: 106637 - DNA, 2625 bp, Homo sapiens
tctcctctgtccgttttcctatttctaaaaggaagaatgtacatgcggaaggctttttaagtttgcttcctggaaattaacatttgtatgttagagcactgtgttatctaggtaagagatgtatgtctgtgggcatcagaaaacagaatccagagtctggcttgctgagtgcttgggagctaaaaggcttttctccctgtctggttctgtaagtgaatgggccaaacccggaaggctgggggatttttgaagattcaggaaggctatgcctcccttcctcttcctaagtcctaagtctaactgacctgggtaccagggggcaatggagtgtacaaggaagctgtcttgtccacagtgttggtatatagactttgtctcacacacaaagggagtggatttgtgcctgaactaaattatttgagggtatgtatggcttatttttaaggattaggtatgttgggcccttttctctttcccagagtttaccatgctcaacaccctgtcaactgagaatcaattaggagactacttatgagtgtgtgctagccaaataacccttgctggtttatagtgttgtttgttttactactcctcttgaatgagtattcagtgctttcaaaagattcggacacatttgttgggggtttcagtaaaacgggaagcttttgcatgagggcattgtgacttttatattgaaaacataaaaattccatatgcacatggtaacccacggaatgacatactgtctttggggttctgggaaaataaatgcatttcttagttgagaaaagcttgtcttttatcatctataaggctcatactttctgaaaaactgttgttttttgatcacttggaagcctgtattaattagatatgaagttggattcttttcgtgatttaacttgcactgaaactcgtcgacaaggcgcagctcatcacttgccaatgaattttagtgctgttgaaagctttagcagtttaatggtatcaacagagactcgattcctccatttctcaactgagcaaacagaagcagtctgcccctgtctctcaatgcctttcctcttttggctttgggaaaggggatggggcagagggaaaggattcttgatgaggatactcctaactccccacccccaccctacccaccctacccaccccagagagttaaaaacggaagcttacccatttgcttccccatgtagtttctttcttaggctgtatatttcaagttgtatttctgtgtttaaaaagatgcttgaggtttggtgtttggatttgttgtgtttgtgctagagagacgtggaatcggtccgttattctttttactcaattatggctcttaaatcggtctgttcctatgattagacttgaggctcctctcccgatccttgctgagcaaaagcatgggcatgtgtgtttgatatgaaaccacccccaggggagactagagcctcactgcctcttcagtttaactgtggccagaagaggcaatttgtgaggtggcccctggtgtgtccactggaactaccaaccctgagtctagattctctaaaagcttgtggcaaaacagtttcacatgggctttattaacagaaaggagctctttgaacctatacgtttgatacccaagactgtttttgtgataaacagttgtatggatctttgacattcttgtgtataagaacagaaactatgcccatgaattaatggtgccatagaagtaatgactatagctgattttactaagacacatctagcaaaggcttctgatgaggcagcctctcctttccccttgttttctattcattcttggcatatggatgggggtagaggagtggaaaaagaagacagagagaataagatctccatatttacaaaggagctaaacaccgtgcttaattgacaccagttattgaaaaatttaattgtaatttctctttgaccctgtgctgcgtaatataaagcaggtgatgtgataccgactgaaactgcctgtttaatgatttcaataaataaatacacagacccatgcattattctgatgttggcttattaggcttgcatggaatagaatttgggagacactgagcactgaaggtaaaagggtttctaaagctgaaagtaaatatagagttgatagtactagaaaaagctaaatcaaaagacacccccccatcagaatactgcagatatttctttttctttgcaactgtatttgcataacaaaattctgttcatttagtaatcaccattttctcagcatgtttgttttttcctttgaaaaaaaaatttcttatgttgataatcagaccccaaatatttgaatgtaagcacatccctcgcagtcatactgacaccctctggcaccagaaaaactgtcatagcattttttgagatgtctggtgggaagaaagcaacaatgccagccattaattcagtaactctgctgatctctgtgtctgatagtaggccagctgttgatgacttttaggcttttgaagtgttataaacactaaaaatgtaaagatgctgccttcctttgcttcctcggtcttgttgacaagtttctgctactgttggccttcagtaaatttacatgactaatttgggatgtcaacactc

SEQ ID NO: 106638 - DNA, 1054 bp, Homo sapiens
actttcaatgtgttcagtgagagaaactcttggcctttttctcacagttatttctcaaaaattgccagtaaagaagtgtctacatttcactgcctctctaaactgtgctctcaaggcactgcagccatagcttgcccttggctctataagccaggcgcccatgaagctggctagcccaggacctactggttttaattttgtgtgtgcgacaaaagagactttaaaagaaatgcaactaagcatctctcctggcttctgctggagaccacacaagctgggagagccttggtttttgagattgagtgtgtcaagatactacacctctgagaaaaaccaagtagattttcatggactctttttcctgtgcttctcttgcacatagagaaacctggtctttggagctctgattgaaaataatttgttattattagggatatttcctaaccaaaatgacggctatttttctttccctattgaagactggaaagctacatccttgaatacttattgaataaaagttcccttctttctctcataaaaagaatgccttttgtatttttgttcccttcagggaagtctctatgcagattccttgcaaaagagcaatttaatttgtactgtacaatcattttcttgtggaaaactaataaaatacaaattccatttttcagcattagcttgtggcaaaaggcttttgaaagttttatgtagtatctgcttttctttttccatttttaaaaataatgattgagaggaaaagtgatgtaaatgctcgtatgtattatgtacatggttgataaagtattcccttaagtttattgtttctctcaaacaaaataggtaagcaaatactttgcatgtaactcttaaggcctttcaccttcctgcaagtagatgtgaatcaagaatgaagccagcgaatctgtgtttcttccgagacatcttactcgcttttttctggcaggtccaggatgtctagggttctggtgtttgcatttcactaattgaagccctgggagctgttccattttgcaggtcccctcagtagtagaag

SEQ ID NO: 106639 - DNA, 1028 bp, Homo sapiens
tcttcttttactcagcgtgatgttttcaggtttatccatgtcgtatcagtatttcattcctttttattgcccaatagtatcctctcatatgggtgtgccacattttattcattcatcagttagtgaacatttgaattatttcactttttggctattatgagtaataatgctgctataacattcatgtatatgtttttatgtggatgtatgtttttatttctcttggctgtatactgagggaatcatttggtcatatcataaatttaactttttgagaaactgccagactgttttccaaagtggctaaaccattttatattagcatacaggacacttccaattatcaacatcgttacttacttgtccttttgattatagccattttagtgggtatgaatgggatgtcattgtggttttgatttgttgagcatcttcccatatgcttgttggccatctgtgtattgtctttggagaaatgcctattgaattcctttgcctatttttaattggattatttgtctttttattgtttagttgtagaagtttttcacatattctggatacaaggaccttatcagataaatgcttcaccagtattttttttctttccatgggtgtcttttcactaacttggtgatattgttttcagcacaaaagttttaaattttaatacactctaatctgtctaatttctgttttttttttatttgtgcttttggtgtcacccaggataaaaaagatttactgcttttttatcttactcttaaaagagttttataattttaggtccatggtgcattttgaattaatctttgtgtttggtgtggaggtgggggtccaacttcattcttttgcatgtggatatccagttgtcccaacactgttgaattttctacttttgttttttaatttatttcattttaacttttacagcatcatgcatagaaagcataattaatttctgtctctcttattctctaataaatgcatttaaggctataatttccttctgtgtgggcatatgggta

SEQ ID NO: 106640 - DNA, 1049 bp, Homo sapiens
agcagtatttgctatttcttaaataatcattatatattaatatcaatatataactaaacatcattatccaggcacaactttgctgtagaatccaacatagcttcaaatgttatcattggaagagtgtttttcatttttattagtgtcttctttgtcatataacaccaatatttcttgatcctcagatactttttttttttgcatttggatgtttttaaacataaatgtgcatatttaatgccgtagttttcttttcccctgaaaagccataaattgaaagttgaatcttataattaattacatcttagaactaaggaaattttgatattgtgaaaattacaaagtgctataatgtgaatgtatcacccaaaattcacgtgttgaaacataatggccaatatgtagtaagagatggggcctttccgaggtgattcagtcatgagggtggaaccttcatggatgggaataggatccttttaaacagacttgagagagtgggtttcctttcttccagtcttctgtcatgtgaggacccatcattacccttctgggggatgctgtaacagggcgccatcttggaaggagagaccaggccctcaaaagacaaacttgccagcacttggatcttggaattccctgcctccagaactatgatacatttctgttctttataaacgactgtctcaggtattttcttatagcaacacaaagaaagacaaggctattcctttttgttagttctgctttaactttatattcaggcttacaagaccagcatgtaggcttttcagtttcttagggattttacctacaattagaataactttctgttcgatggcagtaatgcctcccttttatctacgttctatggttcaatcaactagacagaaaatttaatgcatgtttccaaataataccttaattttttattccaaataattgtcaaatttttattatgtagattgtcatataaatttttttattcaaaatggaagcagcatcgtgaatttcattgtcccctttgaccatctcaacactgtgctatatat

SEQ ID NO: 106641 - DNA, 1246 bp, Homo sapiens
acacctgtcatcccagcactttgggaggctgaggcgggtggatcacttaaggtcaggagttcgagacctgcctagccaacatggtgaaaccccatctctactgaaaatacaaaaattagccaggcgtggttgtgggtgcctgtaattccagctactcaggaggcctaagcaggagagtcacttgagcctgggaggtggaggttgcagtgagcaaagatcatgccactatactccagtctgggtgacagagcaagattcgatctcaaaaataaacaaacaaataaataaataaacatccgggtgtggtggcatacacctgtaatcgcagctactctgggggctaaggtgggaggattgcttgagcctgggaggcacaggttgcagtgagccaagattgtgccactgtactcctgcctgggtgacagagcaagatcctgtctcaaaaaaataaataaataaacaaaataaaaaaataaagaaagtaaaagtaaaataaccttcagggcactgagaggcacggtgcagtggttgctgagtaaacataggttttggatgtggaaagatacgtgtttgactcatagcccttctgtcctctggctttgtgatcttggataagttcctacccgaggttttgcaatttataaaattgggacaatagtattatccccatagacttgtagggagagttaattaacataatacatgaaaagcaccaagagaggctctggcacatagtaggtgctcaaactgcaaaaatatgtccatgtatctgatgagtagaaatgcacattctgtgctaattgaaataatcatttagtaggcagagttgaatggatgcaaaggaggagggaagggatgttttacatgtaactaccctgcacaaagtaggactcgccggatctcctctctgggttgtgggtagaagtggactttcatttcagagtttgattctgtaattctttcgtcaaaatatttgatgtttcctagagcagttgcaattgagatatgtttcctatataagtaatctaccattgaacctgagttggacaatgtatactttactaatataaggcacactgatgggcacacttaaatagtaagtgtgatattgtagacttattttttctctctccttcattaactcttatctgctgaaagcccttcagcatgctttaaaagtaggtcagacactctagaagggtctggttggcctacaagggctggtttttcttttattgccaactgt

SEQ ID NO: 106642 - DNA, 1222 bp, Homo sapiens
aagcaaaggtcacctaaaagaggaaaggataagtcagttttgttctgcagcttaacactttgttcatcaaggctcttcccaatactgagaccattgtaaccagtctaagaggtattgatcattgacttaaaggactttacggagggattacatgtgtttgatctacaaggcaatttaaatttgatgtggtaaacataggtgatactggtctttataagatagccatattcaaaagggcattttagcatctgctatcattgcctattattttaaatgggaccataaattaccattagttctatttgaacttacagttttctcttaaacatagttgtttccaggatggcttgcctaaaatcaaccacttttcctgtgatctttgacaattagagctgataacatgaactagacctatttgtcagcaagtgtccaggataaagaactggatgttggaaaatagtttgtctcctggaatgtgcatacctgtgttcaggttgtgttggacactggtggaatgcttccggtcataactcatgaacttgagagttctgcaagcatcataggactgatcagataaagagataaaggtcactggaaactttctctctattgctgtttctctgcccttgtcctctatctaaactaagggctgtctaaaaggattgctttagcctttacaaagcctagcctgtggcaaaactatgactagtaacaatagcaatagctctccagcttttgggtacctactgtgtaccggatcctctgtcatgatatctctctctatccctttctctttctctatcatgtcatctctaactttggcttcatctaaagtacaactcttaaggatctgaacgcttcgactctatctcttttctatttaaccacagatgtttgttgcgtataatgtaaacaacatttatcttgatcagctttctactctttttctccccttctcttctacccatcatgactgtattttcccatgtgcccttggcttgtctgtgatacggggactcctcccacctactgacccaccccttgcctgcttacacctgtccttctccattgaaacgtatttgctatgcatcggtttgctagtgggcttcctttaagaagacaagcattagaacaaagaagtgaatgtttcttattgtggtatgaggttcccttgtccatcatatatttgtgactttaaatgtggttctgtccaaattatcct

SEQ ID NO: 106643 - DNA, 1132 bp, Homo sapiens
cattggaaatgaagaaataaagctccttcattctcaggttatttttagcattgccataatgtagtggagctgtatgtgcatcatagcacactttaccacttacggctcagtttatcttaattctctggcaaaggaaatgcaggtaatagcacccctgttttactggccaaaagatgaagcaacaaaattgaactttctcaaaattgtaccatttgaaatgccatattactcattcctcatctgctgctattttactttttaaaatttgtaacggcgttgttgaaatataattcacataccatacaacttacctgtttaaagtgttcatccagtgctatttttgttacagttattattattctccactccccttttatcttccctttattcaagaacttttattatttctacagtaagaagaaagggcatgttagttgaaatttaattatatttaccattcaaaataccactagaaaaaccccaacagaaaagagatgcagatgcagaatgagttcaggggcctgttgtgaagtctgagggctactctgctggctgtgtggcctggcacaagtcacataacctctctgaatctcgttgacccttcagtaaaatggaaatagtagtactgactcaaccactgtcttatcagatacacatagcaatcctataaggtgagtcttattaaaggaaacagaggctcaagagaggttaatagtttgcttaaggtcacacagcaagtagcattgtcagggttaaaccaattctttgtaactctcaagttgggtgttattagtaatagcctgattagagtaatatacaaacagactattgagagtaaaagaaaaaaaaaagtttctgatggctgaatttagagctctagttgcttaaaataatgacgttttatctggtgggtttggaagcaatggaaggcacaataccttaaaaataagtatattctctctgatgttcaagtaattcactggttgtacaatataattttaataatgattattcagattcaaaaaaatcattacatgattttcttagcatatctaagtttatcttattttccattagatcttttctttgtgtacctatggaaaacctttgcaatgcttgtaaacatgcctac

SEQ ID NO: 106644 - DNA, 1188 bp, Homo sapiens
attctggttttattacttagaatttattacttagaattttcctttctcctctctatcacccagtcctttattttcctagacataccattttttgaaccagcaaaagaaaggaagaataatttaatgttccaggtatcgtgtttatttctatgatttgtttgctataaatggttttcttttaaaaaaaaaacttgcaaatgatatgctagagtgctaatgttttctgataaacattagctaattctttctgtaaaagaataagcagaactaatctcaggcattctgtagattttaaaggacttagactatagttctagatgataacctccacagatcagattctagaatagcccctggctttccattttactcattaataaaacagaggctatgagaggagaagaggtttgctgcaagtaacttgggacagggccccaaggttgcctctgtccatggagtggctaagctgcatttgacggagaggaggttgtgatgatgtgttaatgtgaacttgtggtcctcagttcttttagtcttttagcattgaagttataaactgtagtcctagtaataacctcgtagtaatttcttatattttggcttaataataattaattcctaatgctaatcacataggtagggcagggattatcattctatttttacaaatcaagaaactgaggcaatgaggaagccaataaaattaaagccataggtgatcagggcttcgagtctcctgagttcaccattgccctgcttcttctgcactgtcaggcattcctcctatagtaaccctttgaagttgggggtctttaacacccattttacggatgaagaaacaaagtcacggggagggtcagtaagtggcagatctggtctttttcactcttatgtcatctagggctgttttcataggtgccctgtagctgcctctgaagttatagtacagcaggttgaatacaattttgcagaaatcagtaattgcagaatcatgattgttctctgtgtaatttttcccctacttagattccaatttaagaaatggggatgaagcaaatgagcacaccatttcttgatgcatctgtggtgttaccatggttacattttggcatgctctcccatttattttttccactgatttattggacctgactgtgagctaaatggcttgattttaagcttaccact

SEQ ID NO: 106645 - DNA, 1055 bp, Homo sapiens
ttctacatggttctgaagccctgtctttactaaaaatatataaattagctaggtgtagtggtgggtgcctgtaaccgcagctactcgggaagctgaggcaggagaatcgcttgaatctgtgaggcggaggttaccgtgagctgagatcgcgccatcgcactccagcctgggtgacagaataagactccgtttcaaaaaataaaaattaaaaaaataaaaaaagctgtagtaaattcatggaaatttgaagagattacaagtatacctgtagagtaaattcctaccattcgaatccctggtcaaagaacattttatgatttgacagttattgctggattgtcttctttaaggtttcagtaatttatgcttctagtaatagtgtctgcaagtgtctatggcacatatttaaatgtaatagcctacattaaacactttgatattttggccttctagtattatgtgagataggatctctaaattaatgcattgccagtgctgttttatctttatgacattctggcttgactttacccctgcagaggaaaacctaaagtacatcctcctaatgactaggggtggcaggctagaactgcatcctgtggctttcttgcaatcagttcttggctacttcttttctaggaggccctgtgttgatgtggtatgtctattttatgtatttcctgcaggaggaaggctgaacaaggacctgcgacattttctcaatcagcgattccagaaggggtctcctgatcatgagctccagcagaccataagggataacctttaccgccatgctgtgccttgtaagtagttggactttggcatctcactgctgtgtgtgtgtgtgtgtgtgtgtgaaaagtccaggggagaaaggagatctcaacaactggttctggaacacctggtggttggcctactgagtgactccttaactcaagcaaatcataattcaataacagtgtcgtggtgtgcctgggtttcagtcatggctctgcaatgtggggcaaattatctaccctttgtaaggcccacttttcacattagtggaaagg

SEQ ID NO: 106646 - DNA, 1052 bp, Homo sapiens
ggtaggcattgagagggccatttggacaactttatgatgtggcaggttagaaggaaagtcagtctttggtttttatattgagattcacatagatgttttacagtgtccttatgactgtaactgcttttaaaaataattattggctgagtatggtggctcacacctgtaatcccagcactttgggaggccgaggcaggaggatcatgaggtgaggagtttgagacctccctggctgacatggtgaaatcccatctctactaaaaatacaaaaattagctggatgtggtggcacacacctgtagttccagctactcgggaggctgaggtgggagaatcacctggacctgggaggtggaggttgcagagagccacgaccacaccattgtactccagcctgtctcagaaatatatatatatattttattttacttttttactttgaaagtttccaaacccacgctagtgttgaaaaaacaacaaaacatgtactcccatcaccaggattcaccagctgttaacatcttgctacacccatgccatctgtccatatttacacctatttccattttgctaggttatctgagtttagggtacagatatcatgataactcatccccaaataaccaaaaattaccacaaaatgatgacattttcctacaagccatgatgcagttgtcacttatcagcattcgttcagtaacatcatcgaactttgagttcatagtcaacattcccttagctgagccataaacgtctctgttgttcttatttttttaaattccagatctaatcaagcttacacactgcattgttatgagccttggtaaaagtaacaatttactgcacacttactatgtgttatactggatattgcgttagtgcatgatctcatgaagctgcacagcccttttgagcagatactattattatccccacctgatagattagggaactgaggctcagagaagttcagcaacatgcccaaggcaagctggtgaatttggggcctcgatctgaactaatcaagcctcgcttgaagttcagcactctta

SEQ ID NO: 106647 - DNA, 1092 bp, Homo sapiens
cggatagaaggtttgatggtcatagcatgtttgaccagtggcagaataatgtctcattaaagaaaattgattgttcttgtgagcactgaagggcttgatcaagatatgggagtggctgcaagcattcattggtgctggtgcttgaagaaaccttttgaggtagcacatggttcagtgttagctggagtgtagaatccatcaacgagataattacccagctcacagcagtcatgttgagttgtgtttaattttggggagccttctatttgttctttcatcttttccagtgctttctaaatgtgttggtgctttgtgcaccttcagaagtcagcctgtgcaacttttaagacatcattattatgatttcagtgtgggaaagccctgcatttgtgatcccagcaggccctttctcaccttgttccttgtcatcgatcacagcctggcagaaaccttgggcccctaacccatcctttgtatttgatgtctgttcttcaaactacatatcagttactgatgacttttctcaggaattggtgtgaaagagaaaagcgtggctgagccacagtgagagacatcaaagtacaggtcacttggagtctcctgattcttttagatgaaatttctacccagctaatttcagttttcttccttagtcagggcaggcagaaacacgatttaaattcccagggctgtgactctaagagggtgttagaatttttccacttccttatctcattgatgttcttcactcccgtaccactctctgcacctggttcagagtcttatatttcttctttgaagctaagggcacttcatcttaggagattatacaggatgctctatcaacagaagattctgtgtgtatattttgacaattagtgaatctaccgtgaattcacagtctgagaagtaggctaggcttagaaccctggctacactttggaattactagtggagattagaaaaaaaataccgatgcctagtccttccctatagattctgaattggtctgaagtgggggcctaggcgctggtgctattatagacatgccccaggtgatttcagtgttcattgaagtttacttccctgtct

SEQ ID NO: 106648 - DNA, 1034 bp, Homo sapiens
gttgtacttagtgggaggaatagggaaaggtatgtctgccctatctttacagaaggggaagtgtcaccctctttatttttcgtagatagcaaatgagacattgacttgactatataatccagaacacttactaacaagagctgttgagttggcatgaggtgtttgctagtaacatggttttaaagtagaataataagtactaagaaaactagttctatgtatttatccagttcttttatttccagctcttctaagggaccctgaactgagaagtcactaatggaagggaaaagtgggtgaggagctgagaaatgaataactcaccccaccatctggtctgctgcagttcagaaagtcacatggtgctaccaagttagatcttctcctctgtgtttactggaggtgccaaatgctatatttaagccaagaactgattttgaaaatatttttctacttctgttttgtcaaacgtgttctctggcatattatgttagggcttgttctgctaaagcttagcagagccttctgtttcttcaagctgatttggcttgcaccactcaaaacattagaccctcattttggaacagaagtcttctctagagaaagcactaagtatgatttaatttccaggcaggtaatacctatcaaatgagagatggagctttattccttaattgttattcttttatataaggcactttttaaaaaagctattttctgctcaagcctgtttgactacattttctctttccagaatctttctaattatggggagaaaagcaaatgttaagctagccttctttttatcaagaaaaaggatagaaaatgtaaccgatttactttcatgatttgattttgcttgaacttttgagatgccagtatgacttcagtatgtataaacagagcttacatatcaaggttatagatagggcggactgtctagctaagtcattataaaaacactttattcaaaattttggtatctggttgaagaagatggttttctgctagccttaagtatttttggtttgctg

SEQ ID NO: 106649 - DNA, 1010 bp, Homo sapiens
cacaaaacggcacacaggcactaatattcaactgcaacacttaacagattcactggacatttttacgccctcagttttgtatatctccgtgtgtacgttaaaaaccttagagatgattgattttggggatgacgtgtgaaagcatcaaatgacaacagtttccattctggggctgttatctgggcataaagatctgcaaactgagaagaatcagggcaggtgataaatcttttcattctaaaacaatttaatgttacctttgccatgtattctatatctaggtccatatattaatataaagacttaaagtaaccatttagagtttaaaaaaattccattattgatagtggaacatacatgaaagtattgagaatcaaattaatcatctctaatctcaccatccagagatattcctgttcacatatggctgtatttctttctagttcatttgccttgcatatttcactgtgtgtagcaatcccctcctcctcaccatggaaatataacgcctatgtgtatgcatattttgaacatagttggagttgtgttttatatactggagtcacatggtaagtgcagtgagactccaccagtgtaacaaaaactctttataaaaagaaagagagagtgaaattttgttaattatgcctcttcttccccaactcacaaccctgctagatttaaaataaccttggcctaactccctttcactgccttaggaagggtacaatagaaatgcaaagagaaacttagaggggttgattcttggcttttgagctcccaaaagtccagattctggaagtttagggaattgttaaatgcaatttgtgctatcaatgattcgggttttataaactcctgtagtacaaaatcctgcataagtgtgatttcattgcacatgacattgtgttctgtgccccacatccatgacaccttatattaagtcatggtcctgataacacggaagcttgcaggtgtctgtaatttattctaagcacatcggaaagccc

SEQ ID NO: 106650 - DNA, 1060 bp, Homo sapiens
tgagatggatgcaagttttctaacttctgactaaggagaacaaaattttctcaatatatggtccagaatttccttggtgatatcgagggaatttttttttttcaaatttaacacttctgaaacttaatttttctgtccccattgcagacttgatgacattaggagattatatttttattaggaaactgaaatccagaatggttagtgaggaggcccacaccttcatgcatacatagacagcactaatgtctgacacaagagctttctgggttatcagtgaattcaagatgtagccaagatttgaagagagacagaaataaaacctgaaaagattatttctgttaaataacatgacttctcacacaaagtgtggaagagcttcgacttgggaactgaactggagttggaatttacctgggcattggaattggaattcaactggacattggaattcaacattggaattcaactggaattcagttgcattcaagttcaaatccaatttctacctcttactaagctgtgtgaacttgggcaactttctcagctcgtctgtgcttccatttctattctgtctgactgaggtaatgatagttcccatatcaaagagtggtgaggactgaattaaataatgtatgcgagcacttagcactgtccggcaataaattgtacttatcatggtgatggatgatgacaactcaaaaattctcctctgcatgtcaagttgaggaaaatgggaaaactctttgaattaatagatctgtatgcattccattgtaccatcagtggaaggaggaacagaagagctctttattttgtcatctgtgttttgctggagtttgactcagttatatttcagaagtcacagttgactgtgtatgtaataatctgtaccataactatgtatggttggatgtagatttttttccttttaattagtgcattgctttatgtgttttttgagcctttatgggtttacagtaaagtatcttccaatgccatctgggactacaggtggtgagacactgttttttctccgctctacgtctctgtctgtcct

SEQ ID NO: 106651 - DNA, 1053 bp, Homo sapiens
tatcaaacacaatgaaaatgaagcgtatgtgtgacagttgagtatgagacttttattttattttgtttttttttgagctaaggaagtaggcaggtaaacagaaaaccttcactgcagaattgacacactgtaggggaaaattgctttgtctgtccaaagatatgcttagctgacgagaaattaaacaacatgattgaggaggaaaacctgaataagtggaacacggaagtaaaaaaggattctgtcactatttacgcccattattcaagttggaagatgggatgattcttaattatttatttgggtgtcaatgcggatagaaaatcaccatcatagaaggatacattaaaatgagtaagagattttcaaaattcacagaataagtatgtctggaattttgcaggttttcaggagcctgttgagttccagggtaggagagagatgtcacgccaaatgacagttttcttgttcaaggagcgtgaacacaacaggctgacaaaatttgaaaagagcagtgctgatgagcaaaaggaaagagaagaaaggacggctctgggcttcctgctctcagtgaggcaagctgtgggttagtgtcagttaaccagatatgagtatgcttccaggagtgtggcatggacttgaggaagtgccagttacctattccctgacatgatctgttccctccactcagggccagtggacatctgtatgtacgtttcccttaatcccattatgtttttacttgataccaagtagctcttttgttttgttagcaacaaagcttgatttaatttcttggtttgcagagtagatacttaagaaaaatgcaaaactactctcactttgctgtataagcagctaattttttttttacctttttattttattttttaaaggttttctttttttatcattatactttaagttatgggatccatgtgcagaacatacaggtttgttacataggtatacatatgccatggtggtttgctgtacccatcaacccgtcatctacattaggtatttctcctaatgctatccctcccctagctc

SEQ ID NO: 106652 - DNA, 1960 bp, Homo sapiens
tcttcacatgggctttcacagagtgaaagttttaaattttgattagattcaattttccttgagtggatcaagcttttggtgtcatgcctagtaactttttctctggccctatatcctaaagatttttttcttaagtttcttcttaaaagttgtatagttttacattttacatttaggtgcatgagccatgccaagtaaatttggtgtaagagataaaggtcacaactgacttagtgtaaagtgtgagaggcaggtcaatgctcctttcttggcctgtgaatggccacttgctgtagctccatttgtttaaagattatatccttactttgctgaatgctttttgaacttttatcaagaatcaggcatactttaggtctacatttctgggttctacattcttcttcccttgatctaggtctctttccctttgccagtaccacagtcttgattactatggttaaatgatgagccttaaaattgggcagagtgattcctcccacttccttctttgtagggagtatttttgctagtcaagggctgggctgcttgttgtcactgggtctccttttctggctttgcatgcccacccttgatgctacttttgaatcttggattcattttctaggtttctctccagaggggtttttgttttactaaaggaaataaattccccttttccagggaattttttcttttttcctctgagtacgctaaaagctaaccctagaagttaaaattgtggatgtgaatgatgttatttttgcccccttaaacctgccaaactcagctggacaaagtagcatgtgtgtgtaatcctagctatgcaggaggctgaggtgggaggatagcttgaagtcacaagttcaagaccagcctgggcaacctatcgagacctcatcttttaattaataaaaaaacaacaaaaaaacaaaaaaagccaaaactcttattaaacatcttgctgtgaacttgttctgctttggtatcatctactcacttgggcatctaattcttaagttcttttcattttgttcaaatttagctgtatgattgagaatggggatgaagatatggaaagtacttgttatctatgagtgctttgtttaaaagcaagatagctttgcactgagtctcagtaaacttgaacataaatagaagtgcagagggtctgctagtatttatttatacagaaagttttcaggggttatcttctatggaaaatgtttctaaacagtgtgacagcaaaatgatagtgtaaattgtaatgtctgtcccggttggatatataaacatatgaagtgcttttttcttaaaaatgtttgggtggttcatttagagtaaaaaaatgatataactcacgttctaaaataatgataggataaaataaggattttatctttcagtgtcatttaggtgctttgttactttccagggactctcgtgagaaatggaattatgggcgtagcttatttggggcagatgtttgtagattgtggtctataaatgagacccaggtctttggaagagagagggaataaattcagggagaaaggatttagaattattcttggtgttataaataatgaagtggttgcgcttaagtaaatataatggcattttagccaatagacaaaatagtacctaagccctgttttcaaagtccctgagacactaatgcacagatgataaatcaaaatacaagaatgtaggtgctttgtccctaagccccactatagatattgattaaataggtctggatctgtggacctatggagaactcctttgccagaatggcttaaaatctaaagtaggccaaaatcaattcttcatcttcccaactccgaaactaaaatactgaatctttccgtcccattacaagaaaaactcacactatattttctcgacttgcctgggaggataattctagtatgtgtgcctggttgtcccataattgctatca

SEQ ID NO: 106653 - DNA, 1056 bp, Homo sapiens
gtgcaaatttgaaggtgaagtgtatttgagctgctggtgggacactttggtagaattgagcagttaggaacatggaactcaggtctgttttattgtatcctgggaaaatccaatcttgtctttattttggttcaaaacagaacttactttgataaaagctaaggcatatttccttgtgagaagcagtaaggtggaatgctttatcaagtaaaaagattgttcaagggaagtgctcctagagcttttgttttcccttgaagagactgatgtctgggtttcagagggactatgtgtttccagatgtttccatttgtgagtgtcaagttgcattagatgccacattttagtgacttaacatctcattgcctcagtgaggacaatttggggcacaaaaatcatagtcgaggaaaatttacatttgcttctcttgcagtctgtttttccagagtagggatagtgtagaaaaataaaggtacaaacagagctgccagcgtcaatagtttcttactcagtagttctcaagtcagtgcctctctgatttggaataaatattttcaatgtgttccctttattatcctaatataagatgaatagataattcatcctgctaagtattagttaagagaggggttttcaggaggtggggattctagaatattaggaaaatatgttggtatcctccttcattgtagatgaatgtcataggtcataatgccattcatctataatgaagaaggataccaacatttgatattggctgctaagccaatgtcaaaacccagtggaatgacacttctgtagagtttatttcccttcctgctatcttccctaccccacggaaatgtctgtcaccatataaagcacagtagcacctaccagtagcacctaccttaagcctcagtcttcccccttgggtaggaaagggagtgaagggaaggtcacttttgagtttccatgctttcttcttcctctccttgaggtggttcttctgtcttctcttcttcctccctttcctttttctctaatgactactgtaagccttttctgaaggtgtta

SEQ ID NO: 106654 - DNA, 1081 bp, Homo sapiens
gtgttctgggctgggcacggtggctcatgcctgtaatcccagcacttcgggaggtcgaggtgggtggatcacctgaggtcaggagtttgagatcagcctggccgacatggtgaaaccccctctctactaaaatcaaaaattagccaggcatgatggtccacgcctgtaatcccagctgctcgggggctgaggcaggagagtcgtttgaatccgggatgtagaagttgcagtgagtcaagatcgtgccactgcactccagcctgggtgacagaacaagactccatctccaaaacaaaacaacaacaacaaaaaacaaaaacaaaaaaaaactgttctgaatatggataccctgtcagaattcaacatctgctggtcttcttggatcaggccgcctttggtctctccaaagaggctaacctggattcctctttggtgagaggacagtagacatttcaaataaggcattaaagctcctccaggaaattatgattgtgggcatttccctcactttttcaagtttccagtgtctttagaatctcacttggccttcttagaaacgtgggcaattcttgtgctatattttatggtccaggtgccttggaacccggttgtatgggggcactgtggacaagggtccaagtccttgctctgcatttaaaggttacatgatcttaggaaagttttcaaccttttcaagttttagcctctgtcttagtctgttttctgttgctgtaactgaatccctgagactgggtaatttataaagaaaagacatttattatgtggccaggcgcagtgattcacacccataatcccagcactttgggaggctgaggcgggaggattggttgaacatgggagttccagacaagcctgggcaacacagggagaccccatctgtataaaaatttttttaaaaaataaaaatagccaggcatagtatctcatgcctatggtaggtcctagctactcaagtggctgaggtgggaggatcacttgagcccaggaagtcaaggctgcagtgagccatgattgtgccattgtaatccagtctgggcaacagagcaagaccctgtctgct

SEQ ID NO: 106655 - DNA, 1225 bp, Homo sapiens
gtatgctgtggtgtgatacattaatttttgttgagaatccaaatgtatattttattttattttattgtattgccacaaatgttaggaaattctgtttttggtatctagcaggagggaaaaaaaacatgaagctcatggacatgtattttcatgggcagttaagctattctttagatgaaaatggccttaatcattttaattattttaattataagtggggaatacatttatttattcattcaacaaatatttaatggggactccttatgtatcaactactgttctaagtgttagagatgccccatgaatgtaaaggataaaattcctttatatttatattggataaaatccaatataaaggtattggatggggaggctacaaagggtgaatgaagaaaacagataattaaaaaaatgtatctcaagtggtaggtgttataaagaagactaaagctgaatgaaatggcagaaagtgatggagacagagggtttctttacatagggtgagcagggaaggcctccttgataaggtgagttgaataggtacctgcagaaagttagggaagggggatgtttctgatggaggaaaatgcttctaagatagggaggcaggagtgagctcactgtatttgtagaatagtaaagacgccagtgaagctggaacccatttggtgggaagggagatggacggtgactggccattggattttatcttgagtgagaagaggagctgttggagggtttgagaagtgttgtgatagcatctgccttacctttgggagggtcattctggctgcttgtggagggtagcaacaaggaaagtatcttaggtgatgtaggatgagtaaagagtgagtaaagcacaaatattggtggctacactcatggcagacatcacaaatcaaccacagaggcctttcccagtgtcctggatgttgactgggacaacttcccgacatggcctgcagctggaactgagagcccttggaatctgcacagcaaatgaagtctttttatttcttttccaacaattcaaatatcaaatggctttccagtgccttatctctccttaaaagaggtctaggcgtctactgtagattcattcatcccccagcaatacctactgagcataaaaaaagcaagtctataaatggatgaacttcataatttcagatcatatgtcctgggaagaaaaaggatgtgactgagacctggaacataagga

SEQ ID NO: 106656 - DNA, 1974 bp, Homo sapiens
tggggatttgaggaaaccgcggaggagtctgtgcagtagtagaaagccgtgtcttgggtctagaaggaaaatagggattattgggaagggtaggtaaatatgagaagtgcacatctactgcagactgtgatgagacggggtctagaggataactgaaaagaaggagagagatttagctcaccatagaggcgcatttctacaaagtgttagctacttgtgccttttttttttaaatgaatttttatgtcgtcatgcacttgaatgcacacaaattttcagaaactgattaaaatgattgttgaaaaagaaaattgaagtgactaccatagcattcctaaattttaaaaaccacataagccccattgactcttttgtcaaatgtgcaagttcttggtgccaagtcagatgaggaagaaaagtttcaattcaaaataatctctctggacagagataataaggaacagagaagatcgagggcaggagaaacctggcaagtggtaatgtctagaaaccccgtaggaagcctggggaaaggaggcaatctaggacagccagcctgatttgagcttcccactggaaagggtagatgctccctcctcacatggcagttgagttgacacttggggctggtgctcatttggtaacaactgtgtctaagaacattggaatgagttgaagcttggaaacaaactgcaaatgaggtgtctcctaaggaggacagagctctgttcagggctggggaaaactaagcctgttcgtgttggtggaataaaacatagaagaaatgaggcagaacagatagccagctggacttggaggatgttgtaggatggtcttttcctgtgaggattagtaaaagggaatagtggattggtgatgccctgccttctttcccctcttctcatcccctgtgctaggagatacttcattaactgagacccttaaaacgcaaagtaagcaataaaaagggttgttcagattgtaccagcttcccaaaaaaactcactgaattctaagcaagtgaatttcttgaaacaactttaagcccatgcatgtctaagaaatccctagctaacactgaagttaacagttcccagggttaatgggaggtcaggtagaattttattgacatcctcattgctattactaatctagaactcattttcctgaggttcatttacccaagcaagttggtacaatggcactctccctccttctctcccgcaggcatccccgtcaatgaggtggaggcatctgggcacactgggaagcctgtgtatattctttggtgtcatctaaactataaattagcctgccactttctattagtgtgaccttaggtgagttttgcacattttgagtctgagatgactgcaagatatccaagtagcagtgtccaagaggcagctggatttctgggaggagctcaggaagaaaggtcctggctggaagatccatcagcagagaaagagcaattgaagccttgggcttgggtagaattgcctaagggcagttcatctaatgaaatgagaaagggcacctggagtatatttaaatattcttagacaatttttttttattgggtctttattctaatcagggagaaaacttgtccagggcaatcttgctagcatttgaatagacaattgactggccagtcatgggtcctcacttacaccctactcctgcgtccagcagatgcccttgtggtgttcattactctagttaaactcactgggcattggagcagttgtcagatttgctcatcttctggttcagtagtcaggaagcacgtatagcagcaaagactgaaagccagccaccccctgccaaaacagtagagagatgcgcatcatgccttgaaggccaaatgaggcagattgtcaggtgcagcatggtgctcctgaacgtggagggtgggctgcctctccaagcccgtcctctcagtgtctctgctccagattctgcttgcaa

SEQ ID NO: 106657 - DNA, 1114 bp, Homo sapiens
tagcatcaaccctgaaacatatcagtcattaaatatttaatttggaagtgtgaaatggcaggttcactttttagattacacattagagccctgccaatcagcactgaaggaaagttgcctacatctaaggtttggtcagactttgggaatagaagtttatacaacatctacagtaactacggcaaacacattcgtgtttgatcaatgagctgtcattccctgaaatcttttgccaagtctttagtttatccgactgccatgccgagacggtggttcacttgaaatgataaatgaaatccacaggtggttttggtatggacattttttgtttatgtcttgtgagatggaattataggactaggatttaaagcaaattgagcatcctgaataaagtctttcagtgtcttcctgttgcaattaaaataacatgctggaacttattaccatggctgagagagtcctgtggtctctggctcctgcttgcgttttcatttccatcccatactgttccccccacccacccatccattacgctgtagtcaacatgaagtcagtaatgctgtcagatttgctttgtctctggacctttgcatttccatttcccctccacatctctttcccttctcatcccctgtctggatcctccttatctttcactcctctccaggatattctggactcctaaccacctcaagccttcttctgtccttatttggcacagtctgttgtgatgctgtttgccagctcattgagagagaggactttggctcattttcgacagtttcccattcagaccactgtgcttggcacccaggaggtgctgggcgcacatttgttaagtcagtgaatggaggctgggtaatttcagggaaggcagaggctatggtatggcgccttagtctttctggaatagttgctaaatatcccagtgaggcttttaagagttccgctcagatttagctcattcatgtcaacagttgccatggtttgctatttcagagcattttttaaaacataaattttggtcctttcagacagaagcatcaatttggtaaagattattttgttttaaatcccatttgcaaagcaaaatgaaatttaaactagcccgtgt

SEQ ID NO: 106658 - DNA, 1035 bp, Homo sapiens
atacttatcccaatgaaagctaaccttcctcttcttttggcgtttactaccatctctttattcttttaacaattcatttccatatttaaatgccattgatttctttaaaaggggggaaaagccaggttgggtcctatctgtaaatcattgtcctgtcttgaacctcaggtaagagaggcattggctttgtcaggttgattctaaagattatttttcaactccaggaagtgggttacatttataggggtgattattttggtaaataggacatatgtagaactatgtccaattccatactttttgatggtgagatgcttttaaagtgtgtagacattgataccttatccaatattacctcattctttctatgtgccagttttatattcttcacacagttacagccgcaggttggattggcatggccatgactttggatttttagcgacctcctaattttattggcttgctttcctctctggttcagctatcaatatagtttaaaggttttactgagaaagaagcttgagagggtgtgtaaaatccatagttggtgaaatatctttttatctttgtggcttaataattatcttttctccagggattcttttgccaactttttttttttttttttttttgagatagggtatcactctgtcacccagtttgccgtgcagtgaccccatcatggttcactgtagcttcaacctctcaggtttaagcagtcctcccacctcagcctcccaagtagctgggcctacaggcacgcacaaccatgcctgactatttaaaaaattttttttgttagagagacagtgtctcactgtgttgcccaggatggtctcaaactcctgggctcaaacaatcacctggctcggcctcccaaagtgctgggatagggagccgctgtggctcaggccggttgccctggcactcggggaggcgaggctgcacgtccaaagtgctgggattacaggtgtgagccactgtgctcttttgccatctcaattgcatggtttgattcttgacaaagtgctt

SEQ ID NO: 106659 - DNA, 1049 bp, Homo sapiens
gttaggcagagctttgggagagagaatactgagaaaggaagtaaacattccctgcaaagataagcaattaagtgattttaaagagctgggaatttcagagtcaggtagcaagaaaggaattgctgttccccactgttcctaccactctgtgaaataagatagtctgcctttgtgtcggcctaattgctgctcttcccttcccctcatttttgtgcactgcacatcgaggtaagtgactgataaatctatcctagatggagaagaatttattatttttattttccttctcagagcagtttctcaggatgaaatatatttatgttcacagcctcatgtattctgaggtctgtgtgttttctaacagattacacaaatccctttgggattacaatcagctggcctgtagcatacacaacagtccctgtatcattctctgtgtgaaactatcccagatccttaggctagtcctgaatctgatacagtgtctcagtcctaagaagatggtgtctaatacatcagttcctaagttgaggacaagaggatgcctttaaaacaatttgagggggctcgaatggtttaattttgtaaacgatttttttggaatataattgtttgttttcacaggccttagaatacagaactgagtctcggatacctttgattgtaacacaaactttttgaaagctctacttcaacaaaccacttccaacacctctgttgctccaaggaacatctcaactgagatgtgcagctgtcttggctttggtttactaaatttacaaatttacaaatccaaaacggaaggaattctacaacctaaactcttcctgcttttttacttaagcagcacaaatttttggttataaaatgaagtgttttcctataatgagtgcacataaatatttcattgatgcaattatctttcacatgaaataattccacagcatggcgagtgcctgagagaagtgataaatctgcttcctttccccaagtgatttcttttttaaacaaacaaaatgtgtgtctgaaacggtggtgcttgtgtgtac

SEQ ID NO: 106660 - DNA, 1077 bp, Homo sapiens
tggggcacgaggtcatttctgttctcaaatgtatattgatatggctgttcaaagattggttcatctccatctcgtgctggaaacacgttctgtgaaaggaattgcaaaaagttctcaccgttatcctttttttcatcatcttaggaagctatctcttaggtccagccaaaatgtttctggcaatactgggtaacttgcttctgctgttagaatgcccggtcatggctttctctaaaaaaaaaagtttgtgttgaccagtatgatgtcacattaaccacagacgacatagcctatcagttgtatgtcactgtgaccttgtagaacaccttatcaggagttagagtcacagaccaatcaattcaaggtcccgagtgtaggtacagggatttctgcatggaagatgttatagaatgttcataaaaaccttccacagtaactctgcccacttggttagacagaatctaccatggtagtagaagcttgggggaaaaaaatctttcttatgttgtttgctcttggtgaccacactctgctattacagtaggtttatgtggagctggagctgattcagcacttttggccctaggggagggcagatgaccaagcttgggcacttagggtagtgctccatcctcatggccactgtgattagttcaggattcagagggtggtctaagctggaccaatcagaatcaactcaagggcttttgccagacctatctaagaagtgattcctggaatggaaagttttgagcttgaagctataggggaatgtctagatattgcaagatgttttcatctccgtttttatgttgtcctcagtgttatatcagtttctaggcacatatatttgtacgtgaatcctgtaataatttgatctgagaacgtgctctgaaatctttgtcatctttcatcacaggctacttcgactgtttataccagagtcatgaaaatgtgaaataacttaaaggcaagatgcattactagtatgtaactaaagtgtatattgatatgcctgttcaaagattgcttcatctccatctcgtgctggaaacatgttctgtgaaaggaattgcc

SEQ ID NO: 106661 - DNA, 1095 bp, Homo sapiens
tcagaaaccgtttctttccctttctcgcacagctaatcctgggagctcttggaaagtgtggcaggaaggatgaggttgtactcttcactagttactgcttatcagtatccccaaggatcagtctaatgagaagtgggtttgtgtacaaagtctttgcaagttttcatgtcttgtaaatgagagtagccaaatctggcttgtctgtgtgttttacctaagtgcagagcacctggactgcaatcctagcacacagacattgaaaagaggcaggaacttttcttctctagattctgttatctctctgaggttggtgccctcttctttatgcagagactgaattcgttttatttctgaacagttcagcaggggctaatttgctaaattgatacgtgaatgttttctaccaagaagctatataatttaaaggggaaaaatattcataatacttaaaatagaattgtttaattgcgacatttcagtatcccagtattatatcagaaccacaagtaatcaactctgacaatattgtacacaacagtttctaaaatttagaccctcattctttcctgtgcttgtaaacttagcaagaatggagattacaccttatattccaattctggctactatccacatttaacattcttcttagtatcagtcttcgaatcctggggataaataagcacagcttgcttttaggctgaattttcagagcgccatttattatttaaagcactaaaaatgcctgatttatgcatgataatgtaaatttctttctttctttttttttttttttttaaattttttgagacagagtctcactctgtcacccaggctggagtgcagtggtacaatcacagctcactgcagcctcgacttcccaggctcaagtgaatctcccacctcagccgccccagtagctgggactacaggcatgcaccaccatgctcagctaatttttttttttttttttaagagatagggcttcactgtgttgcccaggctggtcttgaacttctggactcaagtaatccacccacctcagcctcccaaagtgctggaattataggtgtgagccatcatgcctggtcatagatt

SEQ ID NO: 106662 - DNA, 1096 bp, Homo sapiens
aaccctgtcagccatgggaaaaatcgactgagacgatgttcttctttttgagaaagataaatggacctcagaaagggacattatagtgataggaggagtagattggattttaaatcagacccaagatggagaaaagtaacactcagaattagagcaggaatttcggtgttaaacagcaaacctgcattgcccttccctgggagtggattaacaacagctgtagtgacatggcctcctacaaacatgtgaaggtggtttcattgcttccattcccttcttggaagtgtccatctgactatcttctgtgcttctggactgagcaggcaaggaagaaatatcctagatggttgcagtgatttatttatgccttaatatgccatataatatagccactttgtttcaagattaagatcaaacatccaaggaagggactggctgaagatttaaacggtcttcaaattaccacatctgctacatctgtccctataaaccagatggttttttgataggatgactctcattgtgtgagagatggatgaggtttccttctctggtttttctcttggattgcagttgccactgacagataatcttagagcagaaatgtctgctctgatgggctaaatcttcaagatatttcattatttgtttttcttattacagtgttttgaggtcaaacattctaaaatatagagatttttacatacaattaattttctggcttttcatttaaaaacacaaaacacagctgggcacggtggctcacgcctgtaatcccagcactttgggaggctgaggtgggcggatcacctgaggtcaggagttcgagactagcctggctaacatggtgaaatcccatttctactaaaaatacaaaaaattagcggggcgtggtggcaggtgcctgtgatcccagctactcgggaggctgaggcaggagaattgcttgaacccaggaggcggaggttgcagtgagccaagatcgcgccattgcactcattgcactccagcttgggagcaaaactccatctcaaaaaaaacaaacaaaaacaaaaaacccacaacaatgacagaaaaaacaagtgatcttggaacc

SEQ ID NO: 106663 - DNA, 1167 bp, Homo sapiens
accttagtggctgaaagcagtggttttatagagatagaggtttcctgaagttttcagaatgtctattgataacagttgagagtagattatttcttaaccgatgcaaaataatgaacagtaattaagttttccatcgtttctccccactatcactgggattttcctgagaccttaacagtaaatgtgaaaataatgtgtggccctacagccagacacccttatcactgccctgttcaccttccctggaagaggcaagtaggcatggctgttagaaacaaagggttcagatttgggctttccaggttcagatcccaatatctcagtttactgggtgtatgacctttgcaagctcattaacaattccaagcactggtttttgcagtggtacaatggggatagtaattatactaacctcctaggatttgtgggagcattaaattaagataatgtagtaatgtccctcacacgatgaccagtgcccagaaaatattattagcatcattatcagtccagtaaattgttttaaaaaccaaaaagacactagtggaaattgatttgtggtgtttcctggcagaaaaatgaatatgggttgttatgtttctgtgtgtttgagggtgtgtgggagtacgcatgcatactgaatgcacattcctatcagaggcttcagataaactagtgcttgaaagccattccaggcacatccttttgattgtgtccctctattgcactttgcagatactgcatttttttttttacaacttgaaggtttgtggcaactttgcattgcccaagtctattggtgccatttttccaacagcatgtggtcaccttgtgtctttgagtcacgttttggtaattctcacaatatttaaactttttccttgttctgtctgtcttggtgatctgtgatcatttatctctgatgttactgttgtaatttcagggtgccacaaactatacccatataagatggcaaacttaataagtgttgtgtgtgttctgactgctccacggatccccctttcccatgtctctctccctctcctggggcctccctattccgtgagccacaacagtattgaaattaagtcaattaataccctgcaatggactctttaagtgtttgagagaaaggaagagtcacacatctctcactttaaatcaaaa

SEQ ID NO: 106664 - DNA, 2095 bp, Homo sapiens
aacatttcctgacagtctttcttatcattgaaattaggatcctagagtataatatagtctatatcttctataaaatcagtctatatcttctttaattcagtcttctttcttaagcatgtttccatacgattggaacctttgcatcagcctggtcagctacttaagatttcattctaaccagactcattcatttaaaacagtgccactataatctttctcagcctattcttgttatgctgacttccccatttcatttattcagcaaacatttactgagcatttgctatgtgccagttatactttgggccctcggagggaggtagaagccagtaatggggttcaaaatctggagtcacatcgtctaacctatgcaaaccagttctctgtgatatattttgagagacattgggtgatctatagattctatactattcatctggtcctaaaattctctgatatggggcatttagttctgaaacctgaaaactagctagaagaaacctggccatgaacaaactgttagaagcacattttaaaagttagctttcactgtttttctctattagggagatacccatgaagcttttggcctttcctaaaaactgatttgaaatgtaatgaacaatttgaaattttcattcccaagaacaaaacaaaacacccaaatacatccccttattaggagtctaatgaaggaatgttaagtctcactttttttttttattttaaagttttagaataacaaagcccacacataatcatggtgtcttggtgagtatatattatctttatgtgtaaattaattttccccagactttattttattatattaaaatgtgttccactcaagacttgagaaccaacacaaaaaatgaatatgtgttaaatataccctagagacagaaaaaataaataattactttaacaaaacccttagtgacacgaatagacttttcttttagactttttttttttttgagatggagtcttgctctgtcacccaggctggagtgcagtggcacaatctcagctcactgcagcctctgcctcccaggttcaagcaattctcctgcctcagcctcccgagtaagctgggattacaggcctatgccaccacgcccggctaattttttgtatttttattagagatgagatttcaccatgttggccaggctggtctcgaactactgacctcaggtgatctgcccaccttggcctcccagagttctgggattacagacatgagccaccacgcccggcctagatattttaaatactggcagagatgaggactgcttcagagatatttttcttgggtgatttagaaggaagatggtggaatataaagaacttggtggacaaacacttaggaatcttctagactatatcctgattttatagtatcaggcacatagtaaaagcttggtataaagttgagcaaatgaatggattttgaaaggactgaacttttaacattagaatatgaatattatcaccatgggaaaaaagatacattatttattttaacaagtgatctcaagagtgataatgagatgatgtggtatgaatcatctttgtatgcctagacgtatctagcatccaggaaaatatgcagatgtctttgtagagagaagtcatgtagggtctctttctttttttttaagcaattgatagaatgaagtttatttaaccctgtctcccatttactcctttcttcaaaagctaattttcatatctgttttcagacttttatgtggacagatgtttcagggtttgtttgcaaacatttcccagacatattgttgatcagcaggtttctgcaattaacagcatcttcttaagcctgtttcctacattctgattgactgtatgacaaatgctgtaggttttcacagatgcagggaaagagaaggttaccagctcagcagaatcctgtggaaatcagatatgagtcttaggacagttcattggaaatggaattcagtaaaaggttgagagcgcatgaagtagtgtggttgtaggtggcgtcttgaataaagtcagctgttgtgcatgcaccccagcagacactggggaatgcacagacacattcact

SEQ ID NO: 106665 - DNA, 1065 bp, Homo sapiens
cacacatacatccttacatacacactgcccacatttgactcagtgatacttgcaaagaccattcttcagtgacatttggaaactgcctttgtcatctctctctttcctaaggcctctattaaatgacaagattattgtcttgtcctcttggtaagaagtccatactgctagcatccaggaagtgttttttagaaagcggcttatcagaaccgtgtagaacagtgcccttttctccgaaggtcaatgcaacatcataatgttagattgaaaagagacatcaaaagtagacaaagggagagacactgtgtgctctttgaagctgaccctgccacacaatgggaatgctccagcctggctgtgatgccgggaacatttctcaggctctttctgtcagtgcaccattgcccagcagggggcaggacaatttctttcttcatgagaagcctccagctgaaggatctttacatttatttcaggtctctgagctagagtaagggcagaaatgggatcgatacctttctcatcttttgaatgcaggactagttttagggttttaatcagatgtttcccccaaataattatagcttatactcaccaagctgtttcccagtgccaggcacgtgtgcacacaataaacacattagctgggtcaaccctcatcacaaatttctgaaactgtttttaatccccattttaaagatgaggaaacaggttcagagaagttgaatcacttgcctggtgcatcttatataaagaaaggtttcaagccactttggtaacttactttaatgtctcatgacacctagcactgtaatattctttcttttcctgcaaaaatttcaagtagtactatgtttcgtatgttgattgagaagagttaatatgtaagagcccttcctacaaggtctacttgctctcccttggtggctttcaactttcagcgtatgtaaaataccttgcggggaacttgtaaaaaatacacattcatgaaacccgagattctaatgttatagatttgggattggactccaaagtaagcattttacctcaggtgagggaaatgta

SEQ ID NO: 106666 - DNA, 1048 bp, Homo sapiens
taattgatttctcacagtttctcaaccttgccatatttgaggccgaatacttcttgttgtaggggctgtcctgtgcattgtagggtatttagcagtatccctggtctctacccactagatgccagtagcatcctccatttgtgacaaccaataatgtctccagacgttgccagatgtctcctggggcatgatattcccccccagttgagaaccgctgctttgggaatatatattggaaattaatttacttaacatattatgaatatgctgcagactgggtaaaatgtgataacgggaatgtatgggcagtttgcaaaatctggctcactgaggaccagagtgctattttcagaaatgagctccaagtgattaaaagaaaagagcagtcagactggatgtctgatatttgggtagttttgaatataataaaatcaacagtgtaagtaagcatctttgaaaaggacgaatgacctttctctttctcctttccccgagttttgtttgtaagctttatttctctccccagatgctccgctttatgtcttgctgtggaaaggtgattggctcaacagctccattctagggggtcttttctgcacctctctgaaaagaaccaactaggactgggagatttatctcctcgagtcaacagacctttgaagtcagcgagtgttgttgttgttttggttagaacccagttaatttgaccctaggatttgaggtgccttagagctctgtgtgtgtaagatgctgtgacatcacagaaatgggtctctcaagccagtttttcctgaaggaagtttctggaaagagaagaaatgctctaaagtatctctctagagaagattatgtgtctctattgtttaagggaaattgggtgatacatttagttaaaattgaagtttgtcttgctttctaaaccaatgaatgtcttaactttataaaccagagaaagcagaaatgagtacttaatttctcaaataatttattttaggatttctttctttaaatcatgtggctgacaaacctaaaagttgaagcagttaat

SEQ ID NO: 106667 - DNA, 1031 bp, Homo sapiens
ttactagctgtgtgaccttttgagatactcaatttctgaggacctcagtttcctcatctgtagaacaggaaaaacagtaatacctatgtcagtgggtggtgtaagaattcaatgagaaaatcatgtagaggacttagcagagtgcctaacctataataacacacccatgttatataactaaagaaacaaatagaaacaaagtaattattgttactgatagcatttttgtttccctgggccctgcttatgattctccagtgaatgaacaaatgaacaatgagtagttcacccttttcttgggatcattataatgtaaaataatgatggcatcctttggagatctgtgtgttttttcttcctgttttttttttccgccttcccattctttgtacttcacttgtccacctgctgtgcagtaatgagattcgtaggagaggctggtgttcggagaatgaattaatgccttgcaagtcgcctctgctacatgtatctcctttatcatcactaaccaactatttagactttcaaaatctgagaaggaagaaatgggtgttcaaggagctgaactgttagtgggacccacttcaggaggcatttgtgattctcgttggagggggaaaggaaccacttgagctgtgattgttcatagactgccctcctggcaggcgctgggtgctggaagtggcttatacctagtgaaatgcagccattctggggtattgtgagccctggatagtgagttaccataaagaaaaaatgaggcagttcccacccccaccctgctgacctcctgaaaactttttaggctcttactccagtctgctctattgaggtgtggatatggaagggttaagcagtccccattttgtgtctatttaagcccatttaagaacaagatggaaaatgcagcttttcatcttgtcaggaccatttttcatttctcacagtaccatccccacacctgacgtgttttcacaagcacttgggagctcagcaatccttgaagggagggtggagatgaaacagatcac

SEQ ID NO: 106668 - DNA, 1051 bp, Homo sapiens
ttaggaacaataactcagtagttacttcctgtattagtttcttatttgctgctgtaacactttttcacaaagtgagtgccttaacacacatgtacttattatcttacagttctgactggtgatgctgggctaaaaccaagttgtcacagggctgtgttcccttcctaaggctttatgggagaatctgtttccttgacttttccaacctaaggacattcctttcctccatcttcaaagcctgctagcaacgttgtatccttctgtgccattcatctacagtcttatcttttacagatgcttatgattatattgggcccacccagataatcctatttaaaggtcaccataattagtgaccttaattcccctttgtcatgtaacatagtcacaggttctgggaagcaggatggggatatctttggggtgattattctgcctattatgcttactaatgataatttctacaatctgtgattgacaagtgtttccctttgatagttagggtctctagacttgggacatgtgataaatggacatgaaatgcatgccatcccccagaatatatgggaaagtgaaatctaccaatctgctcaggagacccctctgtttaccagcgagtctgtttttacagaacaatcttaggtttatagtgagggggggttccccagtcagatggttcagacttccactgactgacttcaggaaagctgcctgtactctctgtgtttgcgtagttgcagagtcagggtgatggagattaatgagagaatcagtagaaacctttagcaaatctcttccgtggtagctgttattattatagatgttgccattattggccagaagctatttaggatcttgtaatggcctctcagccatgagatgaaaactgaattatctataatacgagtttaatgtcaagtcaatttcattatatctttggtctttgaaaagcggcagttgctatataatttgtataataattttttaaatgaatctatttctgtgaaacaaaccactactgtatttagttttaaaaaacctattccatgca

SEQ ID NO: 106669 - DNA, 1009 bp, Homo sapiens
tttctttttgttgttgttgttgttgttgttgagacggagtctcgctctgtcgcccaggctggagtgcagtggcgcgatctcggctcactgcaagctccgccttcttggttcacgccattctcctgcctcagcctcccgagtagctgggactacaggcgcccgtcaccgcgcccagctaattttttgtatttttagtagagacagggtttcaccgtgatcttcatctcctgacctcgtgattcgcctgcctcggcctcccaaagtgctgggattacaggcgtgagccaacgctcctggccctaccacatgttttttatccagtcatcagttgataggcatctgggttgtttccactttttgacctcttatgagtaatactgctatgaatatccacgtactagtttctgtgtggacatatgttttcatttctcttgtatgcatacctagagtgggattgctcctaggaatgtggtaactccatgtttagctttttgaagaactcccagactgttttccaaagtggctgtactattttgcattcctaccagcaatgatgagggttccaatttctctgtgtgctcattactccttgttattgcaccttttttttttgagatggagtctcactctgttgcccaggctggagtgcaatggcacaatctcaggtcactgcaacctccacctcccaggttcaagggattctcctgcctcagcctcctgagtagctgggattacaggtgcctgccacgatgctcagctaatttttgtatttttagtagagatggggtttcactgtgttggtcaggctggtctcgaactcctgacctcaggtggtccatctgcctcggcctcccaaagtgctgggattacaggcaagggccaccacacctggcctgcactttttttaaaattaatttttttttttttttttggtacaggctgggtgtggtggctcacacctgtaatctcagcactttgagaggctgaggtgggcagattgcttgagccg

SEQ ID NO: 106670 - DNA, 1048 bp, Homo sapiens
agacttctggtttgacctcaaggaaacctagaaaggtctagtaaaagtgggggaagaggaaaaatgcaacctgtaactttgcaggccattgcagggatgactccctaaggatcaagactaaataaacttttttcttgattggctcatgcttactttcttaaccccgtcactttccatgcttggtttcaaccatcctgagctctctcttacttcttgaacttgctgagctatcatgtcttcagtccttggcacaggctattattttctgagaaatatgcctttctccccatattttaacggctcctaacattcagcggtgttatcatatccatttatagttatttttaaccacccaaggctaattagatgttcaacccctgtgttcccataacaccatgaacttgtccctgacagtctactctgttttattattgctcatttatttgtccatctggcctaccaggcggtgcagtcccagagggcagggaatgtgccctgcttgctgttatatttccagcatctagtatagccctcagttacacggagtaattttgaggaatatgagtgaatgatgtgtgagagttagttcccttgtcactcaaacacaatgtgttttggcattctatttaaagtttctgggctgcctagaaccgactaaacataacatctttgttttgacagtagactgttcactaaaaaaacggcagaggaagacttttcaagttgagtttatcatttggtgatccggtttcttttatactatgttgctatgaaaatgctccagtggcttataaactcgaggtgtcttaaagatgaccgggccctgtgtctgtaaaagctcatccttcacccattcatcacatcccaaatgaaaaacctttcagagattgcctttccatgcctaacttttgttgtgactgagcttagagtaaaagtttttgtaactgaatgtggcttctggggaggaaataggggcagttttattgttgttccataaattagtctgatgtcagaccccttgaaacatgagataggagaagaatctggt

SEQ ID NO: 106671 - DNA, 1022 bp, Homo sapiens
cagtggtgcgatcatagctcactatagcctccacctcctaggccccagcaatcctcccgccttagcctcctcagtaactgggactacgggtgggtgtcgccaagcctggctaatgttttacattttttttgtagagatggggtctcactatgttgctcaggctggtcttgaactcctggccgcaacggattctcctggattggcctcccaaaacactgggattataggcaaaagtcaccatacctggcctcattatttatttttaattttttgtttgttgtgtgagcttggggctttgggaataaataaacttctctaaattttccttgtgttttcactgagcaactcccacacataatggttgatttatggctagtattgagctaatattattttcctttgaggctgcctcatttctctgaacactgatttatttaatgctttctgagacacttcagtttggtgtgggtcacaataaacagaatgcaaactggaagtaatttagagtgagctaccgtagagatgattttattgccacagagggtcttgagtgcaagccaaactttgaactgtgagcagacctctgcaacgcagctggtgatggggtgtgttaggattgaacttgggcatagaactgcaagagcagttccctagaatagcttgaaatgaataatctaaaatgcataggggaaagtggtcataatgtaggtacatactagccactggcttccagaaggaagcagctgttatggtggcaagtaaatgatgtttggaattagaccagagttctgttcctgagttcaagaccttggctagtccattctcctttaaataaaaattattatttgtaagattgggatgagaaagcgtgtgggatcattgtgtgattcccaggacaaactgcatttgaaaaacattcgaaaaaccttcaagcacttgtaacatatgtgtgacttgctagtcctgccctcatgggcttttggagattttttcatcattgttttatgtgagtttacttgggc

SEQ ID NO: 106672 - DNA, 1160 bp, Homo sapiens
attttcacctttttcactaacagaagcacattacagcttcccttttggctgtttgacttgctagcctcactagtcttgcactctcgggtcatcattaggtaaaataaaggtttcttgaacacaagcactgtgatactttgacagtcgacctgctcactgaggtggccgatatgtgattaatgggtggtgagggtatacggggtagaaatgctgtcctaaaggccggttcccctttgagctggacacagtggaatggtgagagatttcatcacatcactcaggacggtgcatgatttaaaacttatgaattgtttatttctgaaatttttcatttaatatttttggactgtggttgaccgtaggtaactgaaactgcagaaagcgaagccgtggataatggggggactactgtagctgtagtatttctagaaattcttttcatgaaaggaaatttcagttcacaaagctcctgggaatatttattttgactgcaatcagcatgaatctgcgaagtttaaggaaacccagagcatccttcctaagccatggtaaagaggcaagagccatggtaaagggcagcacccctacacctatcttggcccgaggcctacagttggcggcttcctttggaacttcagagtgtctttgatgtgcctttcagaatgatgtctgctccatgggtcctgatgacttatgtttcccgggaggaagaaaggcatggaatgggcgaggggttgtcattttcagtgcttctgaggctgtgtttgtttgtttgtttgtttgtttgtttgttttgagatggagtctcgctttgttgcccaggctggagtgcagtggtgtgatctcggctcacggcaagctccgtctcccgggttcaagtgattctcttttctaagcctcccaagtagctgggattacaggcacaccccaccatgcccagctaatttttgtatttttagtagagacagggtttcaccatgttggccaggatggtctccatctcttgacctcgtgatctgcctgccttggcctcccaaagtgctgggatgacaggtgtgagccactgcaccaggccaaggctatgtttttaaggtgaagaattgaagatgcattttagaaatgagacaaactatattcctttcaagggctgttgctccata

SEQ ID NO: 106673 - DNA, 2055 bp, Homo sapiens
ttagttttcagaacctaacattcaatacttgattgagaaggcaagtgtgctttcgtttgtccatgtgtgaccattcattcaattgtttatcaatcttttgtttagaaatcagcagattaattatcccaacaaacatgtattaagtacctactatatgccatgtacttgcaaggtaatgaaggtactgcctggagccctcctgaaatatgtaatctcatggaagagaaagaggaaagagctaaatgtgtccacaaataacaaaacaaagtcaattacgaggtgtgtgtgcaccatgaagggacctaaataggttgctggagttgaaagtcagtagacctggggagggattctactccttgcattttgtggagtgcgggctttccctcgctggctgattgcagaaatgcaagagctccaagggagagctgccatcatcttccccggcgatagactcccaccattcctgacagagatgaaacctttattagatccttggaaataagagaaggaaaacacccatcagttcattcgattctctccagggagccacgctggagttcgttttccatttgttgttgtggttacgagtttcttgtctggagcagtttctgacttgtgttcctaatcaacactgtaatggaattactcatgtttcatttaacagtctgtcttaaaataaccttttggaagtactgaattacttttctgggtagaggcattactgccacattcatgagccgtttgggtgtatgggatagagactggataaaagagagaggccttctgctagttagacttcataggcagcctctctctgtggcatgaattgaatgtctttgggagaagggtcctcttgggcttgcccaatgtgccaaagtatctaaaattccaccattagcatgcatttctttgagttaaaatggctttacctaatatgtgaaattataggtaaagattttgatagcactttttgatggataaattcatgtactggctcatagttctgtcatacttgaaaccatgatactttggtaaataagtcctgaaataaaagaaaatgatagagaagtgtgtgtctgtgtgtgtgtgtgagagagagggagagagagagagagaggatatatgtgaggttgtgtgtgtaggagcagcagtgggagaagagttggggtggggaattcagaatgggggtgtatagcagggcactagagaggaaaggagcctaggtgaattttgaagacagattgtgagctcctgtagaaagaggaactggacaggagtcattaatttctgtgcaagacaaaacggaatggaatgtccagtgtatctgttttgcctgcataatatccatttcccttcctttggtaactgggcgccactttttatctgggcaactgaccttctccctggcctcagggctccagggctggccatgtcactaggccagtaaatgagagcgtcccatctttagtttgagttgagttttccatcacagctgaaagttttttgattgttcaggatttctgcaggatggtgggactgggtagaaggtatttctggaagacctgtaatttaaattgttctttcccaccccattcatttctcttctctgtcacctttcttggctccagtcctctgacttgggtaagcagtattatttctataggaacttgaaatggatgacgttggagaactgaatttctgtcatcttgataaagttttacataaagttttctcaccttctttttcagcttccccttggaaatggtgacaactgttaccatgtcctagtggtcttaaatttttcttctacacttgacctgctgaagtgtccggaaacaagtttagggtcccaccgtgggcagttatcccagttattagagcacatcgtcactgtctgtgctgggaatgctgtgtgaaacctttttacgctgctctgctgtctgtgtgtagcatagtatttcagtgtaaatgcatttcttaataacctacccatgggccctgtggaccataatcattggctgagttctcctttggaattcccaatatccaaatatt

SEQ ID NO: 106674 - DNA, 1081 bp, Homo sapiens
gtagtgcttcgttctttaaagcaatcaacaaccgtgtgttggccccaggctggattaggacagatatttcattcccagatcatgggccccagaattgtcagactttttgacgaaaggaacttctattcagtcccttgaatcattgagatttccactagctcagcagcacaggttgcagggagagagcagatacgaatgctgccgcctccctctagagaaggggctctcatggcagcaactggtggggaactgtacgaggcaggacttagaaatacagctgctgtgtttcccaagtggatgatcttgcagctttcccaaatcaaaactaaaatgcagttaaattttatgagcttcattcatccttttcctctctgtagatattagtattttctttcaaaaagtatgttttcataagctgcctattaaaatgccaacactcttagcaactggttatataaatgaaccattttatgtctttgttttaaaatgatcaaatcaaatcactatagaattgaaatctgaattattgtcatttcttagagacataaaaagatgacagccatatttttctttataaaagagttctgtaagattctgtgatgctctgagcattctatgagcagtcctgtgattttgagggaaagatagtctgctggggttgttagtgctgaggtgcggttgcttaagaaatgaagtgcttgctttcttagctgaaaaacaaaacaaaacagaacaaaaaatccaaattatgtagttcaaagactggaatcctctgggcgaaagaaatcatttttgactttttaaaagacttgatttcatggatgccttccatgaaagtcaggaggtctgagctgatgatgatttcaaatgctgtgtgaatgagaggtgaggaataaatactggtaaatgtgaaattctaagccttagattgatatacattaaaagaacttctatgatggagtattgtgtaccagtcattgaggtaaacaccattacatgcatcatctcaactaatttttactaccaccttagagaatgaattttatcatgactgttttatgtagatgaatatgaaagaagg

SEQ ID NO: 106675 - DNA, 1031 bp, Homo sapiens
catttcatcaataaagcagaggcacattgacagatctctgcagctgtgctgtccagtacagttcccactaccccatgtggctatttaaatataaattcattgaaatgaaatgaaatgtaaaattcatctccttagtcacagtagccattgttgccattggcgaccacattggacagtgcagattatggaaatttttcatcactgaaagtgttttttttttggatagtcctgttctagagatttctaaaaccttgtttgttcactaagcgtcctctatgaacgtttaagttctactccaaatccttctagatggtgatttccaaccatgactctacattaaaatcacctggggagtgtttgaaaatgccaattagaatcagaattgggagggggagggggctcggacccaggcaccactatttgaaaaaatgccctcagtgattccaatcagctgccaactttcacaactaccattgtagacaataatactttattttttaatatacaaatcagtgtctcctgaacttagtacctttcttttcctttgtcctcctttgaattctgcttagagagaggcagtggagtatgttagatctctgcgttggggagtcagttctgcctcttactagctgagtagcttttggttagttatttagccagtccaggcttttgttacttcatgtgtaaaatgtggacactggtacctgccttgaaacaagtgaggattaattaagataaggtatatgaatcactggtgacagtctctggcacataagcccttaataaaaatatattttatgatataattttaatatttcaaatgtatatgacaagtaataaaatatattttaaaatattacatgtttaatagtatagaatatgctattttaaaataacattcttgctaagataatactatatgatttgacttcatggattttgctctgcctgttagggaacttttaaatattttctttaatatatccaatgacgaattaaggtgggaatttaggcactcctttcaagtgagc

SEQ ID NO: 106676 - DNA, 1045 bp, Homo sapiens
agaataaaagttgaaactcctcagtaagatgtatgagttcttcagtgactacttcctgcttattctctggcctcatcttgaactccctgccttccccttgagttattaaacgttgggttcctccttcatgcagtgttttgtccattgctgcgctgttgtacaaggcatttcttgggccagcagtgctctcaactccttaccctctgcccctctgcatcttctgtggctaacgtggattcactgtttgggctgcatcttctgggaagtctttcctttctcccacgtctgggttggacccccctatttgttctgactgcacgctgtgcttactctctttaacactcagccctttattcagctgtaaatctagatgctgttccatcagaccaggaaacttaccatgtttattatcaggtctccagcacctggtatggtgcttggcaaatggagcctcagtaagtatttgttgaattaaattgagacagacatagaaactaaccaaaatagcacagtgaatgcttggtagaaaaatgtatgtgataactcatggaggactaattaatcagtgttttctggactgggacagtgtttgagtaacatagaatattgtgtgtgtatgtgttttaaggactgcagatttaaaaataattctctttaacaaaggaaagtcaaagagagagacacacacacacacacacacacacactcataattttacttagttgttttctaactgcagttaatgcattatgtcttttggctttccctgtgtaactagaatggaacaattagttaccatggtctcttgctttggaattgactgttttaagccattatcgtagtccaaatttcttttacgattagcttttcttttttattagaccattgtgtcttgttctattacatttgcaatgtcattagcttaaaaacacaggcaaagcctccttttttgttactgtgataaaagtggtgtttactgaggccacagcagtagttgttactttgatgacatagagcagaataggaatggtccaaaagagttgtg

SEQ ID NO: 106677 - DNA, 1081 bp, Homo sapiens
tgtaatggtatatgttcattgaagacatgttgctttggacttgtgaatcactcttggccacctaggaattggaaagcaggccagatgtgatgtgaaagcaagccctactatttgcacatctgcagctctggccattatttacatccgtcctccaagatcccacatgggcttagggaaaaggcagagcagggattcctgaaattatgtcaagttccaaattcacagggacgtaggctaggcatgggtgacgtggcaaaataacttttattccttttttaatgaaaacaattcttaaaattttcctaaggaaaaaaattgtgtggtaaaaataatcagtaacctgattgattgttttgtacttggcattgtggtaggaactctaggaaatagattttaaaagattcttcattttatcagtgaggacacagaggcacagtttaaataattcacccaatgtcctaccatctggtaagtggcagaaccaagattcatacccagtttcttaaattctggagtccagtgtgcactatgacctctcatatggtgaaactggggaaggaggtgtgtgtccatcgttaaaaatggaaggttcacgaagcatcctcagtgcttatacgaagcatcctcagtgcttataggtcagctctggcacattgtacaggctcaataaatattttttattttttaaaagtagattgctttgggtaggatttttctcagttttattgccttctcataaaaatagagattaggtataaaagctgtcagtactgcaggagaagccacctggaggtgtaacagtaatgacagtgagaaagagaataaagataggttgttgacaacagtgtatgcaatgtgtgtgtcaggagaagcaggctgtggaaggctttatatagctttatatggcataccacattgctcccatgagccttggactagtggaatgaataagaaatgttctctctttcatttaacaaatatttattgagctcctactatgtattaggaactgtgctgggcactggaaatagaacagaacaagatagctaacatccctgcttttgaggaagtttttttcctt

SEQ ID NO: 106678 - DNA, 1251 bp, Homo sapiens
ctctctctctgtgtttttttttttctctctctccttttataagattttccccaggtgtggttttagcattacacaaaaagcctcaggaagatttgattccaaaatcagacttatccttaaggtggaaattagaacaactgcgatgcctcaaacagatgtttcctctgacacagtatgtgccaagaccttaatggtagttttcaatccacgacactggctttcatattaaagatctgggcagtgctggtggtcagaactcagaaagatctttgcctctgtatgtgtaccaggcttcatctgcataaataatgatctcacgtgtgtctggaatgtcatttttcacgtgtatgtagataccgttgtgactaataaaacagtttatttgtaagcattgctgaatccaaagtagaattggagggagagtcagtcaacacctactgaaagcacaactgtttatgtagggatccatgccatagttttgccattatacaaacatattacactggaaaaaaacttgagattcctgatcaagcttaattatctttggctttcagaatagtctggaatgatttaatatctttgagagtaatggctcagagactttccccaacacctacagctgtctttggcattgcagatgttgcaaatggggttttgtacaactctcatgcttattaaaaaacatttgtaagcaatataccatgtgtcttagtgtattagggctgctataacaaaataccttagactgggtaatttacaagcatgagaaatttattgctcacacttctgggagctgggaagtccaagatcaaggcaccagcagatatgatgtctggggaggtcttcttcgtcatagattgtgccttcctgacatgccagaaggggtagaagaaagcaaccttgagcctctttagaagagcactaatcatattcgtgagagcggagccctgatgacctcatctcttcccagaggccccacttcttgatactatcacactgggtattaggttccaacataggaattttgggaggacactgacattcagaccatagcactatgcagttggttccttttgattttaaagaccaagaggctaagaaggtgttcagaaatgctcttcattttgcctgagcctatatattaattttctgttgctgctatagtgaattaccacaaacagaatggctaaaacaacacaatttattattttatatttgtgaaggtcagaaggctgacgtggatgtcactgg

SEQ ID NO: 106679 - DNA, 1088 bp, Homo sapiens
ttgtgccttgacattgggtcctcagttgagcaggtaacccccagcttgcttgcctgcagtgatgtggacttcagttctgctctcatctcttatctaccataccaatttttataattaaaacaggaataaacaaggtgcttaatgtaatctgcaagggagaaacagggcgattgaacagaagggctgcattctggtttcaagcacagggcgggagagtctatatatggtgcagagggtgctaaaattgtaaatataaattcttaaatctgccaaataatggtctgtaaatagtgtaaaataagaatgttctcatttacatttaaatagtttagatttcttgtttttcactacaaaaatataatattagtgcaaatattatctggcaatgaaagtaaatacaccagacagagtcgttgatttcttgtatatagtcatctgttttcaaacactggcttatcacgaatggcctttatcatactcatgagttctatttgttaaagtggcaagaatcagaaactcaggaaatgcaaatgcatgggattaggaaattcattggctttgggttgaaagtgaatattttctctacttgcttgatacaagttaacttgctggtacatttgtcattgctattaagtggcccctttaacactattttctcttcctgccagacaagtctgaaataatgaattttttaacgtccttatcatataactgtagtttcttgtttccttgatgtgaataaggtagttacatagtacttagtccctgacagtaaaataaatattataccagaggggcacttaaaaatattgtagaaaaaccaaaatagagcttttaaaaaagtttaggcaacccagaacaacgtagaaaaagtaaattggagaaaagagaaacagagaagaaacagaaaacaaaaaatagaataaaaaccttaagacctaacacattaacaattttattaaaagcaaatgctctaagaacatcagtcgaaagacaagagattggcagcgtggactaaaacatgacccagctatatgctgtcttcaagaaactcacttcaaatgaaacaatataggcaggttcaaagt

SEQ ID NO: 106680 - DNA, 1047 bp, Homo sapiens
cagcttagaaagaaaataaaaaaaaaaaaaagaatacaacttatgttgggtaacttaagagagcagttgttttctttgtgcaaactgtgcctcaagttattttcagtgtattttaattaaagattgcctgtcagctctttggaagtgtcccattattgcaagttgaacaataataggtccatggggccaggagtaagtgtacttcagtgctgaagtagattctcaggccatcagatatcgatgtcagcttcttattaagcctgctcagaaccagcgtaggatacgaaacattctaagttgcttcgctttgcttcacttagctcgccactttaattcttccatatgtttctcatttggttttcttttatatgaagtttcatttaggataacatgcagttccccatgttcaccattcttccagtaaaccaaacagagacacgtggtctgacaaagtggaatgcttctgacttcttctttttaattctggcaataaattggggaaatgaatttcctgtcctttgggtaactcttattctctggttgtctcctttgttcttctatcggggaagggtattgatcacttctgagctatccaagatcaaccaaaatgttgaagtctcactgtgttgcccaaactggactcaaactcctggactcaaggtataccccaaccccagtctctcaagttgccgggactacaggtgtgagccaccatgcttggttccaaaactacatttaaatcccagctctgctatttctgtgacgtgagacaaattccttagttaggctgagcttcagtgtcctcacttgtaaaatagtgaagagcgtagtacccagtggaatttcatcatcaaaagcacatttaacttatacaaaatcatctctgcatccttagcataaaagaataaataaacgattgagaggatgaatgaatgatagttgaatgatgtgttggttgttccccatgatgtgtaagctcaagagtactctcgggattttaaattcatgtattttgatatttatcatacacattgataaatatattta

SEQ ID NO: 106681 - DNA, 1064 bp, Homo sapiens
tgcaatggcatgatcttggctcactgcaacctccacctccctggttcaagtgattctcctgcttcagcctgctgagtagctggggctacaggtgtgcaccacaacacccggctaattttttttgtatttttagtggggatgaagtttcaccatgttggccaggctagtctccaactcccaacctcaggtgatccaccagccttggcctcccaaagtgctgggattatagatgtgagccaccacacctggcctgtcggggcacttcttgattgagataaccactttctccctggaaggcttccatattgagtatcagcagcaaaatgcatcaaacagagagaagcattttgaaatcatttaataaaatatggtcttgtgaggatagagactgcttttgtttccttgcattcagctgcccttttttggatacgtctcaggttttacttactgatccagaaattcattgcttgtctccctaatattaagttaatggggaggttagtgtgggcagaactgagaaatgaatacgttttgatacattccaacttcccagcagctggtaaaagcatggtatgcattttagacttttgatattgaaacatttgagggatggaactcgtgttaaaaatttcgtcagcacaaagtatgcataggtgaatgaattaagatcttatctttgccctactaggaatttacctatcaatgcattaaacatgtacttatagaactatttatatcacacaagcaaggtgatgtttatggtttcagttgagctgtttaccacatcatgttgggttgggctatcattaatctgaagacttatttttaaatcttgagttatgaattaacaaagatgctgctgatgtgtcccagagtagaaaccacaattaatttttttttttttcttgagacggagtctcgctctgtcgccctggctggagtgcagtggcacaaatctcggctcaatgcacttggttcccggagggaacctccacctcctgggttcaagcgatttccctgcctcagcctcccgagtagttgggactacaggcacgtgccaccat

SEQ ID NO: 106682 - DNA, 1050 bp, Homo sapiens
atggagtttcagttttttctgatttgtaggggtctaatgcaggtgcttagctaaaacaatggcctcccataaagtttagctcttttttttttgtagacggagtctcactttgtcacccaggtacctcctgggttcaagtgattcttccacctcagccacctgagtagctgggattacaggcatgcgccaccatgcccagctagtttttgtatttttagtagagacaggatttcaccatgttggccaagcgggtctcgaactcctgaccgcaagtgatctgcacacctcagcctcccacagtgctgggattacaagcgtaagccaccatgcctagccagttttagcatttttaaagcacatagcacaatatctggcacacagcaggccaacgtgtacatgattccttcttctcatccctccctttcttgctctttaagtttgacagctccaattatacttatggtggatacagagaaacgtggtgttagctcattcagaaaggaagaggaattaactgaaataataatacaagccaatcagaaaataggatttgatttattactattttaatttatatgcagttggagcagatatatttgcataaaatgtttcttgaaaattgcactgtggtttcaccccatgtcatcacagatgagttttttgcagagataattagaccaggtcattggtggttttaaaaagcaaagatttctggtcacaaggctatcttcctcctcctttcctcttctccaaagatagatattcataattagatcctgtgatgagataaagagtacaacagatttaaaaggaaaagaatcttcatttccttctgggaagaagcaattatttagttattctttatttgaactttgaaaatcttggttcttatcttttaccaatttattaatagcattacccagccaatcagagtcacagatctataagatgaaaaaattagttgaatgcagcagagacccattgatgtgttgtctccacaactggcttgtgtcatagatggtaggctgagctccttttcctaatcattat

SEQ ID NO: 106683 - DNA, 1041 bp, Homo sapiens
agcaggtggtagtattacatggggtgatcagggtggactttgtcgagaagtcaagaattcagaaaaatatgcaaagtattgaaaaaagctagtttgtcttagaatctagctacaattgtttaagaactcatttaacaagtctttgctgagctgggtcatgtaggaatggttcttgtcacccttgccctgtaatggcctgtggttttttgagggagattagttagctcccaacatataattaggtgctcaagggaataatgccgacagatttccattggcattaagagcaggaaagactggatgtgggtaagcattctcccaaagatatatgctgagtgcatttgtgataccccataactgatacaatgagacactaaggcatttttccagggtgcagggagtctgtctagaaggttatgtggtgaattcatgacaggccctctgttcagagtcaaacagcattttgaatctgcgctctacccgtcaacatttggtgtgttgtgtcacgtctttgagatttgttttcctcctctgtgaaatgggaatattcatacttagcccaaaggttgatgtaaggattgctgagagcatttagtttggggtctcacacatgttgagtatttactgtgcagtggtgatcactgtcatccatcctcagtttgcaggatcatttgaggttttgcctcaaggtaaacctcactggcaaggtggctgtgataacagttagtttcttaaaggtaactggaacctaggccagaggagaggctgtggtaggaaagcactggagcgtctttctttctctacctgaaacagggccaactttccagaacagcatatggaccctaagaattcatggggatttttctcagcaggcagacttgtaagcaaatgacagggcagggaggagcagcttatggattcctgatagatcagtggttacaaggaggcacttttgggactgccatctgttcccatcctcctcagacctgacgcctcctcagactcctggaccctgagtctccagtgcagagtggaattcag

SEQ ID NO: 106684 - DNA, 1012 bp, Homo sapiens
agaatggagaaggggacaggctaatatgtattaaagaaagggaagacagtggagaggaagagttggagacaaaataattattagttgggtacataaatttttaatatggattcaaattctagctctgccatttactagctacttaatgttagaaaacttaagtcaactctaacaagcacctatattatagggactgtgagcagtatatgaagcattgcctaaaagtaacagctcacatttaccaagggctttccattgctagtcattgtgctaatgtaattatttaatttgatctttacaacaaccccatgagctatgttctgttaattttcccagttttcccagttaggaatttggaagtctgagagggtcagtccccaggttacacaactggttagtagagcgagaactctgataagttgacaccagtgtattgactgcagaagactgggaggcagacaaagagaatgtctttgcttatagacaggaacaggtggagaactgttaccgacccaggcagaatagaatagcagccagtgattcatccagggctttctgggctgctccaataagggacaatgactgcgtggggttagggagaaaggaaagttggaaattttctttttgtaatatttagccttatctgaagggcaaggttttgagtttctgtcccagcattcagtagaaaactttgcacagaggtaaacctaagtagttatgattcctgctcaccttactttaagtcccccagcctgatttttcctaagccggatccctgagcctgcgtgttccttccctccacctcactccacctgctgtgtttccagctgtactggcctcatgccagctcttgactgctgactgctttggcctctaagctgtaatactggcctcctgggaagcacccagaattccacagttattttcctctctttccccttcagcaattcccaaatttgcttttctcagtgttgtgctttcagctggctggctgtgctgcagtcacgctgtc

SEQ ID NO: 106685 - DNA, 1343 bp, Homo sapiens
tggggtcttgctgtgttgcccaggctaatatcgaatgcttgggctcaagctatctgtctgccttgggttcccaaagtactgggactacaggcgtgagctgctacacctagcctgcatcttcactttcttgatggtatcatttgcagcacaaaacttttatctattttttttcttttgtttgtggttttggtttatatttaaataggcttcacctgacccagggttttgaagatttacttttatatcttctaagagtttcatagttttaggttttacatttaggtatatggtccattttttttgtgtattgcataggaaagggtcccaacttcattcttttgcatgtggatgtgaagttttcccagcaccatttgttgaaaaggcgattctttttctgttaaattttcttggcacctgtgttgaaatcaaatatgcagaggtcttgacacactgttactgtccagtctctacacatgctgtccttctctcccacaaagtgtaataatgtaataatgcaataacgtgcctgataaccaaatgagtggatttcagcagtccccctttgtctgaaacctttgtgatcagagggaataaacatcttagaggcatgaagcccttgctcagataaggagaagatagagaaccaaagtgccataatgtaccaagtaaaaagcatcagatgtgccagaaaataagcagtaggaattaactttgagggttatcacaggaacactatgtagagtaagcacaagcagctcagctgtggacgagctttgctgtagattttgctgcaaacctctgcaggcctgagagcttgccgtgggtccagagagcagcagatgtacttggctgtgacgtcactggatgtgtcctgatctactccttctccttctcatacatgaggttatctgaggtctcagccaagagacaaatcagcactttacccacggacagcaccaaagctcgccatcttggccgctgccccagaaccttggaaacttctgcagtgaaatggattctgattatttttattacctttgttctttttttagaattgaagtctggaatacataaagtgtgttaatattaagtgcaacttcgtgaccttttaattgaggtattactgtgtaaccatcaccagattaatatatggaacatcataagtaccctgggagactccttgtgctatttcccactcagtgctctcctcttaaagaggtcagcactgttccggttcttctattaccatatatttgttttgcctgctcatgaacttcaaataaataaaaactatggtatgtactcttttatgtctggcttaatttgtccagtatgtttgggag

SEQ ID NO: 106686 - DNA, 1003 bp, Homo sapiens
tgaagtgctttcataaacaatgatgtgatgaacaatttttgtgcatacagccttatatatctctctgaatatttccttgagacaaatattacatgtggaattacttggttttagatctttaggttttggtacatatcatgctaatacaaattttcttatactctctccaatccttaaatctctgttcctctaacagaaaaccaaattccatgtgctctcatttataagtgggaactaacgttgaacagcagacactgggcctcccaaagtggggatggagagatggaggaaggggttgaaaaatgcctggtgggattgtgttcattacctgggtgacaggatcattggaagcccaaaccccagcatcatgcaatatacccatgtaactaacctgcacatgtaccccctgaatcttaaaaaaaaagaaaaaagaaaagaaaatctttgttcatttgatagcaaaattagttgtttaatagctcagtattttagtagttagaaaatggattcaagttgtcttaaatgtattcttccttaattttatctcacattttgatgccatgctttttgtatttaagggaagtactttttggccattgttcacctatcttgtgtgtttctagatgggagcttggtcaagttctcccttcgttcttccaccccatgtggtacaatttttccttgtgtatcagtaatgagtctgcacttggatacctcatgcacagtatcgctatgtgctatatgcacagtgtcactagttccttgttgtatctaagaaaaggcagcacatggcagggtggagagagttggtaggctttattcggacgtgtttttctttctgttacattgtgaattcaggaatctaattagttgaccatcaccttgaaatccctttaataaaacctgtggttggtttcttctactctctgtttatcttgctcttttcattcttgttcttttccctttaagataagtgtattctgtcttgcttttctgctagagt

SEQ ID NO: 106687 - DNA, 1515 bp, Homo sapiens
aaattgaaaacactgtgccttagataatagtggtgtcctatgattgtgagcttattaacgtcctaaccagacatagaatttttatttttctgtctctttagtttttcatgagttttatgtttactgtctctgtctaagagaaattgtggtatttggtaaaggtaaggaagttaaagaaatagatacaggttttatggtatgttatagttttttttaatgcacagtagaagttacaggtttatgaatttacatcccagaattcagaaggctgtggttttatttgtagatagaaatcttatttccccctcttgcccctgcccttttttttttttttttctggtatcagtctgctgtacagagttctaatatgtgctttatttttgtagtttttgtgtattactaaagtaatacatgtttgtggcaaaaattcaaataaaacacaggaatataaagtagaaaactaaatttttcctgttatctccttctgttctcaacctaaaattctaatcctccagaggcaaccagtttgggatatattttttcaatttttctatacagataaaaatatgcatatgatctttggaatctttttttgagatggcatacatacttattttactcatgtctgagaatcttggtttcaacttagactattcttaatcagtattttatatttattttaagtgcaccttgtattttatgagtttgcacagaagcctttgacattaactaggtactttattttcttaaattattaagaaatgacagtggtgtatacccattctgaaatgttttttggagaagagatgtgtaggatcaggtaggagaaattaatagtttactggttcaatactggttattttgttcaagctttctgtgtatcagccaacatataggtttggctgcattagcagttacctcaaatcacagtggcttcaatatagtagaagttcatttctaccttatgtaacggtctagccatgtaacagtcctacgctactgtgattctgcaaggttggggactgagattctgtctcatatattgctctgtcattatagagatattgtcctcctgtgcattctggctagtgagacggagacaagaggagagcaggtctcttctcttcacagacacggcttggaaatgacacactgtgcttctgctcacatctcataagccagaccttgctcgtgtggccataactagctgcaacaaaagcctttaatgagggcagccatatgctcaactgagagtttggaggaaggggagaatgtatttttggaggtaactcagtctttgctgaagatcatgcctttattatttttttaaaaagagaatcttgagacacgcttatttgagattaaatgaaaaatccctttgatgtaccaaatgaaaaaaaattgctatttagaatattttcttgtcctcatccatttatgcagtttgactgtcaaaaaatacaacatataatcttgctaataataggacatttacatatgaactttctgtgcaga

SEQ ID NO: 106688 - DNA, 1032 bp, Homo sapiens
aaggggttcttgcctttttaaagtgatggatctttcccatctccttgcccacattctctcctacatatcagatgattactttctttgcttatttaattcagccatctcactctgacccatggacattatatcagccaggtcaactgaaggatcactctggattagtgtggtggtttcagtcttttagaggctatgcttcagaaagtttcacagatgcttacttaatattagttgtacttttagcgtctcttggttttggaaaactgctatgaatctgataatgaatagtactagcctatagaggtcattatacattatatctttgtaatattatatttgttacatatgtatacatacacacatatataaatatatacataaacatacacacatatatggcatctgtatattatagaaaatacttttactcacatttttttagcgcacagataatttctggtgtacctgtagaatcccaaaccccttggaataaccattttccatctgtcagattttgtggttcatagtttttgggagcattgaattggaaggtcttgggcatcctggccagtcttctggcttttttcttttttttagaaaggagaaattaaagcttttagttctttaaactcagtatttcatttttgagtgtttaaaaaaaatcttaaagattcttaaatgtgtatgtacttgtgtatatgtgtgtgtttaagacttgtgaatccagttgctagttttaattctaaatctcctttcatttctaatgtcattaaaaattttatcccatttactacttgtataattttattttcttaacatctgccagtggtaacttgcaatgtattccaacatgtttttcttcttaacgtagcctcataggaattcttttggacataaaggtttataatgggcctcttgaatactttggttgccaatgctagacatatactaattccctgctcagtacttcccttggctctgactctgaagatgaaagacatagtcttcctttctcaacctctccttgactat

SEQ ID NO: 106689 - DNA, 1666 bp, Homo sapiens
tatatatatatatatatatatatattatactttaagttctagggtacatttgcacaatgtgcaggtttgttacgtatgtatacatgtgccatgttggtgtgctgcacccattaactcatcatttacattaggtatatctcctaaagctatccctccccctccccccaccccacaacaggccccagacaacaggggtttgtatcccagtcttccaacaccttagggctattgtcatgcatgttgcttgtcaagtattttgctgaatactttggagtatggttgcttttgtcacccttggttatattgtgtatcacgttgactcctgcaaaatagtggggaaaagtaaccttggtaatgtataattaacttatgaagtagaaaatacttctgtcccttaatctaacattttagtttgttggggcttattgtgctagcagcccaggcttctcttcccgttgtgctttaagggttttattgatggtgcttacctaagtcctagttcagtgattggtcagtgatgggtggtagcgcctggcatattaccagatttgtaataggtgctcagtaaatgacttcttaccattacagttatctgtctcattctttaaagagcaagtagttgtccatgttacaaacccattagaatagtttttttcttcttgttattggtttctttctttcctttttttttttttgtgtgtgtttttctgtgacaggggctcactcagtcgcccaggctgaagtgtaatggcgcactgcatcctctgcctcctgagctcaagctatcctcccacctcagcctcccaagtagctaggactacaggtgcatgccaccgtgcctggctaatttttgtaatttttgtagagatggggttttgccgtgttgcccagactggtcttgaactcctggcctcaagcaatcctcctgcctgtcagccttcacaaagtgctaggattagaggtgtgaaccactgcccaggctggaataggttttgttgtctaaacaaacgaggcgatacattttatttttgtttttctttccaagttaatgttttgtgctgttccagctgtctattgacaagtacaataggaggagttcaatcaatgtagcttattgggatagttctaaaattggaatctgggttgccattccagctgtatgactggccttgggcaagatccttcaaccatagtggttctcaacttgtacctcttataaatggatgggctgatattttgtgacttgttcaactcctgagtttttggctatgtgaatctgctcgttcttttaaagaagtgtttgcgttggatgtggtgttaaagttggaatgttcttgcaagtcctttgggaaattttggtccttggatctgtgctgggccttgttcagacatgaaatgagaaaaatattgttgaattttataaagcttaatgttttgaagttggatgcacaagaacatgtttctgacctcctcggtgtgtgtgtgtgcctgtgtgtgagttgggaaggcatatgatgagtttttttgtttgtttgttttttgttttgagacggagtctcgctctgtcgcccaggctgaagtgcagtggcgctatctctgctcactgcaagctccgcctcctgggttgacgccattctcctgcctcagcctcccgagtagctgggac

SEQ ID NO: 106690 - DNA, 1368 bp, Homo sapiens
gcagtagataattgtaataaagaaatcatgaattcaaatagtagttcttcttctaattttgcatactgtctttaccacttagtaactgtgtaacctggggcaaaatttgtaatttctttgtgtctgttttcttaattgtaaatgggactcgcgtaattccctctggacttctgatgagaattagtgatttaatacttgatacgctcaataaatgttgcttgtcattattttctattaaactatattgttggatttttgagaatgcatgaagaaacttaacgttaattgtgttttgatttttaaaggcgttatgtaaattttgttttgtgcttttctccaggcaagaaaccggtttgaatgtaattttcatgaaatgaaaaaaaaaaagaaaaatgaatagtaaatctgatgttagtatctgccatttatttcacatttttttttctgaggttgtatatgtctgggaacctttggctttgcttggtagaaagaggactaatgactccaattagaggacatcagtagagaagaagggatgaaggatgggagataggaaagaaatcttattttcagtaacttatgtgccagaaactgcactgtagccttttaccagtgtagccttcttagatactctgagagagataataagagaagaatggattgttacttaatttttatcgtccctgaaattgaggttgttagtgtccttctctggtgtgttacctggggaaaggaacaatgattgcagttttactttcaggctaaaagctacaaatctgagctcacatttctgtttgtttctgcctctgaccctgggtggctttgtgacctctctaagcctcagtttcttcagttgtcaaatgggtctaatagtgtttcctatttcctgtcattgttaaagaagagcccatgagaatctgtttcctaacctagcttggtcataagaatgattgtaatgcattttttaaaataatgggacccatcccagagctacagaattagaatttccagggattctgtgattaagtgccccaggtaagtcttactgttaggctgatttgggagacattaaaacaatgtgtaaagttgaacagttaacacctaatacataaatgttagctgctgttataattatacttaacattaatttaatgttttaggtaagttcttttatatacgttctttagatttgctttggtaggttttgataatttctaaaaaataaacacaagaatgccttgtatgccacttaataaaatgttggtatgccacttaataaaatctgattctgctattattatcttaaacaaaatctgattctgctattattttatgtccatcaaaaagttatgcaaagttttctctttt

SEQ ID NO: 106691 - DNA, 1076 bp, Homo sapiens
ctggagaagaggtgctgaagttttgaatgggggactctgtgtgttgtactagctgtgaacccgtctagggaacaagtgctgacactgcccacttagaagaagacacatttgttaaagaagtacagttgcctttatgtctggcattttagttaaccagtagcaaaataaaggactgatggatttattatcagattatgcccaaccatgcacatattgccaagtcctccatgaacatcacagatatctaaaataaaagagacgtttttatttgttttaataaataacattagctagcacctccgtttccaaccattcagtcctgtttggaaatgccacagtgatgggtgtgtgttattttgaactcatgtgaaggttccatgacaacggtaaacattcatattgcacattttcataaggcagtgaatctggatgaggcaagtggcctcagccggcaataaagatgtgttatgaaatttcccatgccagaagagacactcatagctgggattggccttttcaaaagcagttgatggtgatgagtgataactccccttttagttttggcatcagatggagtttgtagctcattggcttcattgtgttgcctgggtatctcctatttagacttaattggatggtttgcaccactgtcctaggtggttgctagtcttttcaaggactatccttactgaatactcttggtattgtatttctcttttcttacacgaatcctcaattacaacaacaaagaaaatgctaacatttgacatcactggtaaactaagaatgctttagattaggatttccatttgctgcctttccaaatttgataatttatatttggatatccttttagcatatttttggtggaatggttcactttattattatttttaaaagatggatgtgtcctagctttcaccaaggaacaactcagtttagatggaatgttttataaatatgatgtaatggaaattgaacaggatttggagtcacaagggcctgtgttggcatcttagtgccattatttattgtgtgaccttgggcaatcacatagcctttctgaacttccattt

SEQ ID NO: 106692 - DNA, 1186 bp, Homo sapiens
tacttaaattgacaaataataattgtacatattcatggggtacatatgatattttgaaaacatataatgtatagtgatcagatcagggtaattagcatatccatcttctcaaacatttatcatttctttatgttgggaatgttcaatattttccttctagctagttgaaactatacaatatattattattaactattactttgcctttggttgctgtcattttcatttgcttttctatgtcagtatattttgaaggactttgtatactaagtgtttcaaaataataggaacttttgtgaaatgagacatagcaaatgaaggagccatgaacttactcctattttctatacctgtcaacaatttgaatttcagggttcttttgttttgttttgttgtttttctttatttgtgtatataatttttttacacgtacatatgtacacatacaaatgaacaagcctgtgtgcatttaatttttacaagtaaatgcctactttttatgatgccacactaaactcttccatattactgcctttccctagggttttgtaaaatagtgctttatctccaagctactacccagccgccttttatttaaagtgttcagtggaccattatttgggatgaataaaaattcgatgttatgccacagaaaggtaggattttggggagaaacaaatacaggaaacaggtggaaatagatacattgagaagaatccttttgagcagggatttttgtagaaaacattaaaccaaatcgtatatcaaactctctggctggtggtcagtctaatcacaagcatttattcttaagtgtcctacagagagaaaaagctgtttatggctgtatcttgagttaaatatttggatttggactgcaagttaattttagggagaaaacatctgtctttctgaaaacagtatgcctttaaaagtgatccctgtggtagaatgttgttgaaatgcttaaatgctttccattaagttttttttttccccccttttcctttctttctttttttattttttttggacaggattttactctgttgctcaggctggagtgcggtggtgctatcatagctcacttcggcctcaacctcctgggcttaagtgatcctcccacttcagcctccctagtagctgggactgcaggggtacaccaccatgcctggctgaattttaa

SEQ ID NO: 106693 - DNA, 2552 bp, Homo sapiens
gaccctttcattctattccttttgatccttaatttctgattttgttaaagctccttaaggcaattttcattttctctctgctttcctggtaatgttggcagggtgatgctgctgatctggtctgattcccaagctggaggtaatggcgtgtgtcctgccctagtgctgctccctgatggggagcatgctcagtttcctgcattcaggtacgagcagagacttggcaggatccgccccgttcagagttgcaggaagagccctggatgcctgtcgcaaattggaataagtgggagggagccacaggctggtacaggtaagagagctcaagctctgtcttttcacagctaaaacttagcccttctgctgtgattcttaggagggccaggggtgcttcctgcaggaatgaatgacttgtaggagcttactttacatacgcaaggggctgggctgtggctgccttctcaagttctcaagtccgtgtctaggggctgctatcttcctgaattgctgcgaattttactgctaaggaaccatcttggctgagtttgttttcattctactatatgaggttgggcttgcattcagactgggagcagtctgtggcttccctccttgtcagatactttggaggtgggagcagtgttcaggaacctgattctctaggcagacacaattgcgatgtgagagttttctctctcctacagctttgcttgtttgtctccctcgtatttgtaaagcagtaaaataccaacctgtaagattattgtttagtaaacataagcaaatccagacatttattccctactattgctatatttagaaatgatcattaatccatatcagagaactctcacaaatatatgttatttttgcattccttagcgtttaataaatatcatggggaaacattaagaagtatgttatccttttgaggagaccagtcttggtagttctttttgtgtagtgaaaatgatgtattaaaaaaaataatgaattttaaaacctcgtaagtattttctgcagcaaaataaggatgtacttgtaaaagtgctaattattggaaccctgtgggatagcaggcatttgtgagtttttaggcattctgggatgtatacatgcaaaattgtggagggtgctgaggaaatgagaacagtagaattagtctatacaaaatttgcctttttcgcagaatctggggattggaccagagccccgatataacttgaacagaagttatttgtgtatgtagataaatgattttcaccgttctgaagcttaacagaaatattttcaatagggaaaaaaccttgccgttgcagttctttattttccacagcgatagcaagccacaagtgagagaatgtttttaattgaaatcacataacttcatctcagccaacttccaattgcttcccctttgcagcgttttgccagagtttcaaacaagactgtacaagaaaggaaaagaatgtggtattcacagatactaaaacattgtaaaaacaacgctcatatctccagccaatttcgtcaccacgtgactctcacccttccaccgaggatgaacagaaatgtcatccatacactttctctgagctcccagtctctggtctgggcctgcatggtggattcctcatcattggaaagaccaccctgggctattttgctcttccttttgtgtggcgtcatcttttattttttccttgtctctggattgttttggttagagaggaatagtctttatgttgggctctgcgttgcaagtagtataaatgctcttgagcaaaaataaaaagaggatgtttactgtaagggtatctgaagcatacccaaggtaagggttatccagtgtaggccagttttggaaacaccccgggactaagactttgaaccttatcaggtttttctgtaggtatttttcatttcctgctgaatgcgctcttacttcattcttctgttctctcaaaatagactgatctgcttcccagagcctggctgtccacactcctagcatatacttcttcctctcaagggttcatccagactgaagctggaatctcttagttctgattgtaaataccagggagaaggattctcaatggttcataataggtcagatgtctgcacctgtggccagcgtaatggcgttctatgcgaaaatgatggctgaaagtatgtcttttgtaacctataggggtaagaaaatggctagaagactggggagacagggtattcatctggtaacctggtggtgttcaccacagttgcctttttgtgtttctttgtggggcctcttactaactccctcttcacgccaatttcaagttcatcaaaacctagtcaaatggtgagtatttatatgtgtggtgttggacagacagatatggctaagtaattctgtactagtatattatgattaagtgaacatttattgagtgcttaccatatactaagccctttttcaagtctaacactaggcaaataatacatgactcttttaatttttgctcacacctttatcacctcttcccaattataacactgtgttttct

SEQ ID NO: 106694 - DNA, 1006 bp, Homo sapiens
tgctctgtcacccaggctggaatgcagtggcacgatctcggctcactgcaacctccaccttctgggttcaagcgattctcctgcatcagcctcccaagaaactgggactacaggtgtgcaccaccacacctggctaatttttgtatttttagtagagacagggtttcaccacattggccaggctggttttgacctccagacctcaggtgatcctcccacctcggcctcccaaaatgctgggattacaggtgtgagccactgcgcctggcctagaattattttctgtgcctgattttaggcaaatcgaaataagcacttaggaagtttgagtaaatcaagctgactggcaaggataaaaacaaaacctttcagaaagtaccttcttttccctctgtcttagggaaactgatctctggagaaggtgtgtgtacgtgcaggcatgcgtgtatgtgcgtatgtgtgtgttgcattacatttgataagaacatttcatgagtgctctttgtgtgtcagaaatttcattcttatgctgccctaggaagtaggcattgctgttatcctggttttttaaatgaggaaactgaactctagagagaagttacttgcccacagtcacacctgagttagaaacggcatccaggatacatacccaggactcctagtccaagcttccacttgccactcctgtactaatattaagacttcaagctgtggtggcttatgcctgtaatcccaccactttgggaggccaaggtgggaggatcgtttgagcccaggagttcagaaccagcctgggcaccatagagaccctgtctatacaaaaaataaacaacattggctgggagtgttggtgtgtgccagtagtcctagtcccagctgcttgggaggctgaggtggggggattgctttagcctgcgaggttgaggctgcagtgagccgagattgcgccagtgtactctaacttgggtgacagagttatacctctccccaccactccccccaaaaa

SEQ ID NO: 106695 - DNA, 1070 bp, Homo sapiens
taaatcagaatcttggggatatagcataggcatcagtattagtgttattcttatttttagtataatttttaagctcccctgtgtattgtaatgtggggttctggttaagatcccctatacggagtacctaattttgttgaatcatattgatttccattgcagagaaagttccaggatgaggcgttttcttgtcctgttacctgcttaagctttgtctccaaatgctgtccaaagaggggatgggcagcctcaagaggcagtcaccaccttatgtgcctggtcaccctccccatgtggcaggtgctgcatccacataatgaccagcatatggccctgacctcctggagcttccagtctagtgaggagagggaggcaggctgtaaacaattaaactcttcactattttgtcaatgatacttgtgaactgaatggtgggtaggtgatctgtcttagccagggtggtctaagacctggagaatgagaaagccagagataggattgatggagaaagggcattctgggctgagggatggtggaagctacatcctagaagtgggcagagcttggagtgttggatgagggtaggtctggggtagaacagtgggagctgggttgggaagggcagcagaggccgggccgcagggccctgaaggccgtggtcagggttttggattttgttctaagggcagtggccattcactggaggggttttagcaggaaccaagtttcctgtcacccagtttgatatatcagagggtggatgtctctttgaagatgtggtaggtgagaaggggcctgagattgtgtgaccttatcacccttctaatcctgagagtcaagcaggcaaaacagaaactgacatagggttggtcattccaggccattcttgccctcatgggctctccttgctgcatattttgtgaaatatcagccatcagggtagtggtgtctcattactgtctggaattagttggaaagttgagaactgaatcaaaaagttatggcacaatcttgacagcttcctcaaagattaagtagtctgtgctcctttctaatttgctagatttaca

SEQ ID NO: 106696 - DNA, 1021 bp, Homo sapiens
ttctttttattattagatgctaccattttcaagatgtgccttcatagtaacagtatattttcagggagaagaatgacacacttctgcattattagctaatggaaaacacatgctcaaatatagtgatgttaaagaaaccaagtgagcaaaagcaaggttatgtttttaataagagaatgccttaattgtggataaaccatcccagaaactcttttatttcggtattttaaaaacacttggagaactctttcttatatccggaaagcaccacaaaaatctgtcagatgaaaagtctgttctgatctgtgtggtgcattcctgcctagatatgtagtcatttactactgtgtagtataatttgagtagagtgcagtcctcaactaagttgttagactacattttgtcctttttctgtaacttctgagtagtgtactctaaatttgctctgtagacctgagctgaggtgcaaagtctgtttttgttaacctgtgcacaatggtataaatatagaaattgagacttagaatttagaaatgtaatagtaattggctgagtgtgtaatcctagctccttgggagactgaggtgggaggatcatttgagcccaggagttcaagactgatgtgggcgacagagtgagaccctgtctctaaaaaaataagaaaaagaatttttttttttttttaaggcaaggtcttactctgtcacccagggtgtgtacaccacaatgcccagctaattagaaaaaaaaaatatttcatagagatgaggtctcactaggttgcccaggctaagaaaaagaaatgtaattgcacaagacagttgtctatctgttgagtttaataattaaaagttgggtcttgtattttgtagggtgtgcttgtgttttttctggtcattaatttttattatcttttgatactttgggaaataagaaacagctggtcctttctcacaactagtttgagaagcagtgctctaaaacagtagttctcaaccctagctgaatatcatatcattta

SEQ ID NO: 106697 - DNA, 1001 bp, Homo sapiens
tattaggcatttgtcgaacattaggctcaaatcctcttaaggatggtggccttcccagagctctcaaactggtagcctgtgggctggatttggactgcacctgttttgttttgtctgaggggagctagagtcagcactgtgttttaattgaattgagcgtgaatgccttgaggcttggcttgaactctcaggtcccctcttagtctccataattctctactttttcagacattgtctgcttcactagttgaggttatctgcatggcccctgatggcatttgaatttgtgatgaaaccaggaagtaccccagtttgaatgtgttcatttgtgggttcagattaattagttaacagatcgatctttgttctgaaataaatgttgctggatttatgttgctcactatgcaacagagagttgacttttttttccaggcttttcacaggaggccctctgttggtagaagtccccgccgggtttatgctggctgagtatgtatgctgacctgtggatgtagtcatatggtgcatctcttgaaggctgatgtttggttgattgtagtatgccctgaggtgattttgatcatgaagctaaacctaatggagaaaacatgaaagccaattagttgttaataagcattaggggagaaagcagggtctaagatcctcttttcttccttctttgtctccctttgtcctttctaatggtctctctgggtttaaagcaattgctttctgggtccatgtgagtgttttctaaattgccaagaatattcaggagtgttagaaccccttgaattgaagataaagaccttgggatacacagtcagtggtagaattcctccatggtactctactcacattgccttcaaaaaatacgatatgttccgaaggaatttctcctccctgtatttcctctgttaactgtcttctgctgtgttttcagtttgttttctgtggaacacctgcctgaaggatgctctttgcaaataagtttgcaaaat

SEQ ID NO: 106698 - DNA, 1129 bp, Homo sapiens
agaaataaggaagcacaaatgaactgctttgtccatagagaggaaagccaggaagtataaaatgccattagttacctgatagtcatcattttaccaagcaaagagaaggcagttttcaggaaagcatatggaatatggctcttgatggaactacgtgccacttgaaggatacactggataacccagagggatgattcacaaccagtgcagctgtaaacttttcttttaattaggtaggaagcacctgtgtgttattcatcgtttttcctcttcccagtccagtctcttcagggattttaaaaaaagaaaaagacccaaacaatttggaatttaaattttctgtaggagaaagcagccagtgtctaaaaaggggcaagtgtgcagatcatctgctggaagacaaggtgagaagagtaacttgaacgggtgtgaattttagagggcaaatgactgtgcacattgcaaggtgtttggcatggagcgatgtgttagcatcccgttggtgtttggatttatgcttctgaattgagtatttaaaaatatttaacagaattaatgctaaatatgtacaagctgctgttcaaatgtgaacagtcctagcatttgtatctcctgtgggctctgagcattaccatgagatggcaccagcatcctttcatgacctctgtgtggcaagaggctaagtgagactggtcatatgattagcagtttcttgcaagggactgatcaacatcatttaccacacaatttgcctaagagattgactttgtccttgaatgagttgttctaaatgtgcattataatgctagcctaaatatgctttgtaaaaaaattatcaactatcatttattgagtgcctactacatgctgagagctttacaaatttattcctgtgtaactttcactactatcccaagggggtgctattatcttcattttatagatggggaagttgatgctcagaaaagtaacatatcttacccgaggtcatgcagcaggttactctaagcaattgaactctgttgtacagtgctgaaaccctttgtatatgtacatatatcctgtaaatatccatccaccataagcaaatttgtttggcacatttgggttgatactgttctcaactttg

SEQ ID NO: 106699 - DNA, 1031 bp, Homo sapiens
caagagtataatgcacaggtgaatatatgttcccaaccccagatttttaaccaagagaagcaaaagtagagtgcagaaaattgacctgagagagttatgtaagtttcttcttaaactacagatgcccttctaggtatttaataaaaatgcttaatgataggaattcatgtttactgattctgaccctacctcagtgtgtagatattctctttgtaactgtaaaattagtttcattcttttatttttctgagtagctgtttaaaaacaatagacttcgttagagcatttttagattcacaataaaattgagaggaaggtacaaagatttcctatgtaccctctgcttccagcctgtgcacagcctcccccattatcaacgtcccccaccaaggtggtacatttgttacaattgatgaacctacattgacacatcattatcacccaaagaccttagtttacattagggttcattcttggtgttgtacattttatagggttgaacaaatatgtaatgacacgtgtccaccattataatatacagactagtttcaccgcctaaaaattcttggtgctctacttatttatctccccactcccctaacttttgatctttttactgtctccatcgttttgccttttccagaatgtcagataattggaatcatatagtatgtagccgtttcacattggcttctttcacttagcactatgcatttgtaagtttcctccatgtgttttcatggcttgatggtgtgtttctttttagtgttgaatcatattgccttgtctagatgtaccatagttcttttatccattcatttactgaaggatgacttggtaattgcacataaagcttttataaactttcatgtgcaggtttttgtgtggacataagttttcaactcctttgctgaataccaaggaacatgattgctagctagattgtgtggtaagattatgtttagttttataagaaactgccaaactgtcttccaaagtggcaatataattttgcattcccaccagcagtg

SEQ ID NO: 106700 - DNA, 1095 bp, Homo sapiens
cccagaagagagtgaagcttataaatatggaatgccttgaggtgattgaatctaggagaagagagattaggttttcacctgacacatgtattataccttaaaaagagatggttcaggattagaaattcatacggtgtttgtgtgtgactgtcagaatttgatggaagatccaatatgttctgttccccactgcttaaaactaaaaagaagataattttagagcccttgttttttaatatcactgtttttaatgactatcacaggggtctttgagaaattgagggcacaggtcgaggtgtttagctggaaggaaaaaatacagcaggatgcaggtggaaaccagctctttaaatagatggctaatatgtgtaaatgaagttggccagattctgtgtgggccctaaaggatgtgaacaggactgttgtgggtaatttgtgatgtgcaaaactccctaaaataagtgtggctgccaagaaatgtggtttgttcactgattcagagctttccaagtctagtctgggtcattgcgagaagtttgtgtgaatttaaacatcggacctgaagttagaccaagtgaccacttagatttatttcattcctgagtttccaggaatcttaagttggtgaccaatgggataagattgaaaaaagttaaaaggggttaagatgatggaaggtctgtgatgtctggctaaaactgagagttctagtgttcaaagcagtagttagatatcaggaagcaggctgacagactgtatgagagaaattattccagccgtgtataatggtcactgttaacaaagcctcgaatgggggaacgttgcctttttctaacttgaaaaatgtgagagagagagagagagagagagagagagaaggagagagaatgagagaatgaaaatatatccaagttacctcctgataccttctcttgtgtaagcattttttgtttgtttcttttttgtttgtttgttttttctttttgtttttttttgagacagggtcttgctctgtcacctgggctagagtacagtggcacaactgtagctcactacagcctcaaactcctgggctcaagagatcctcccccttag

SEQ ID NO: 106701 - DNA, 1478 bp, Homo sapiens
taaattcccacaacagtcttatgaggtaggcatggctgtttattctcatttgatatataagaaaactgaagcatggagcagcgaggggcagtgtgggatgtggggtttcctaaccgaatctgaccagagacaggtttagtggtggaccttcggtaattaagagcccaccaaagcaatctgggaaacctgctctagtactctaagcaagctgtgacttacaggtagataatttggggatgcgggatggcctcattcttgcctcatattgtttgagcattctgattcctgccacggaaatgatggcttctcctagaatccttgtgttatataaattcacctcccaatgatattcttgcttggtttgatgctagaaattcttgaaatgggactcatgtatcttaaagtgacaggcttaattttctaattttacagtgttctggggagggagatgcaatcccactgctgtagaccgacctttcttaattcgggcattttagtagcttctctggaaggcaagaatttgatatgtggaaaggaaagacaggtttgaatagggcttgtgatcctactttagtccagtgaaacagcacttgattaataaatcatttaaatcttcctaaagttaaaatgatggaaaatgctactttttaaatcaaggttttaaatgagtgtcaattggtaaagagccataatggcattttttacagatggtcttagcttcaattattcatacatctccttgaattattttagtattacccaagagatgaaataatgttggataaattactgcttctgcttctgtggacagctgagtctaatacttaaaaaacactttaattattttctgttaatattactcttaatataaaattcaggtgcattgatgctgcaagattaggtgcttatcctctacagtttcagagctgatgctagttggaattgcttctttgtggtaatgaggaaacaacgctcttttttgcatatggagagagctgtaccttaggcccaacatgttacttggccaaatgtgcttgtgcagtgtaccccctgtacagctgtatgtgattggccaaccttatctcttatctcccatagcagccttaatgtctccttgttaactctcatctcacttaaagttacttgttgaatgtctctcattcttgctagagggtagactccctcagatatggcatatacttgtcatatttattccaaggacataacagtgccaggtacctagtgggctttttatgatgtttattatttaagatgtttattgaggccaggcgtggtggctcatgcctgtaatcccagcactttgggaggccgaggtgggcggatcatgaggtcaagagatcgagaccatcctgaccaacatggtgaaaccccatctctactaaaaatacaaaaagttagctgggcgtggtggtgcgcgcctgtagtcctagctactcgggagactgaggcaggagaat

SEQ ID NO: 106702 - DNA, 1098 bp, Homo sapiens
acctgggaggtggaggttgcagtaagctgagatcgcgccactgcactccagcatggtgacagagcgagactcggtctcaaaaaaaaaaaaatcatccttgatatctgcatgtgtgatgactgagtttttgtcaattttagaaagcctacatatgaaatgaatttgagttagattgaggagaaaggatgaaaggatgaatgaggtatatagataggttgtcccaaacaggggtgctctacaaacaggttcattgtcacaggtttttttcttttttctttttttttgcggcattgtctccctttgtcactcaggctggggtgcaccggcaggatcatggctcactgcagcctcgacctgctgggcttaagtgatccctcccgcttcggcttcccaaactggtggattataggtgtgagtctctgtggttctgggcctgcttttttcattaaataagctgaaagcatcaatgatagcctcttatgtcctgcccacccattatcattgtatctcagaaaactcatgctaattgcatttttaattaaaactgtttcagtcatcttcggggtccttttgaagtacagagaaggtttcattattttgcttagaggctgaaataatgggcaccctgcaaggtgtggttttccttatgtaacagctctcattgtggttgcatttttatttgaaaacgtaggttttaaaagggaaactacacatttcatatttaaaagaaggcattgacccattttctctagtgattagaaccgtggaaattagacttaatgtagtttgacatgtactatagaattttagtctttcggctgaaaggaaacaatggaatacagcaactaactcaaagttacttgcttgccaccgtgacaatgttgagagatgtagttgagattcctgccctcatagagcagttgaggccagcggaaaagcaatacattgatttcatctcatgtgctcctgacaaatgaggtcatccagtttctgttgaaacaatggtaccagttcaatatctgaaaaactttctttaagttcattcttatattcttgttgcctcaagttctcagagcaagtgcaatcagtgctagttaa

SEQ ID NO: 106703 - DNA, 1318 bp, Homo sapiens
actatatttagtgtaactttggagtttcaaggagtatctatcctaatctagccaattgtagctagcctccaagacccctcctctcctcccaataattttcacctccatatattcatggccttgtatggactcctcctaagctgagtaggactgacattcaagccaacagtatgtggtagaaatggcacagtattgttcccaaggctaggtcgtaacagaattgtggcttctgccttgctttcttggatctgtcactctggggaaggctagctgctatagtatgaggacagacaagcaaccaatgagaaaggtccacgtagcatggaaccagggtctctcatcagcagccatattagtgaaccattttagaagcagaagcagatccctcagccccagtcaagccttcagatgagtgcagccctgaccaatattttgattgcaaccacatgagatcctgagccacgaactaaactgttccttacttgtagaaactctgtgagataataaatgcttattgttttaggccactgcacttcagccattttgcattctctctggactccaaggctaagatatggcttttgtcttcaagtggattaatattgagtttagtcctggaacaggttctttcagccatacacacttaaacaaaatacttattgaaacaagtataactgtaagcttccctgaatgcctgattttcaatggagcatttggtcttaggtgctgcctagaggcagatggtattctctttcatatcaagatttaaactttgaaaagataggactgttaagtaaatgtagtctggtatagagtaatgtagcatcatactttatttaaacataattatgaatcagctttggttgcaagtaatagcctaagcaggaaggataatttattatctagagacggcaaagtctcatggaacccaaggggaaggatggagagggcctcatgaaggatcttctttcctctgattatgtttctttctatagatgggctttctctgattttccatctacgaggtggaatttggaagcccctttggctctcttattatatgatggctttagtcacagagagtttctgtggtttagcttcctggaaagagagaatttcataggtagagcttcaattaggtgccgatgcctaaggcaatcagccattgctggggtgggtggaactctagggctgcccggagcttttttctgttgatggtatatatatgttcgggatggtgggaatgctgaaggggattgtgttccaaagaagaaacctagggggcagacacatacctcaaagttacctgctatgggag

SEQ ID NO: 106704 - DNA, 1168 bp, Homo sapiens
gaggtagtagactctacctcttttttctttgagacagaattgcgctctattgcccactctggagtgcagtagcagcctcatggctcactgcagcctcaacctcctgggctcaagcgatccttccatctcagcctcccgagtagctaggaccacaggcacataccaccacagtcagctaattaaaacattttttttggtagagatgggttctcacttttttgcccaggctgatcatgaactcctgcccacctcggccttccaaagtgaaccaccatgcctgacctctacctcttgatggagtttgctgcagagaattcaatctacaaaaccattcttcttattcattccacatgcccccttttgttcaacattgtaatcactaaacctctttcagttctttaaactcaccttgttctccagcttttggcctgaaaacatgtgtttctctccacctgaaatattctttcttgcctgttttttctagctgactgctatacatagtttaggttttagcttcaatgtcatttactaaggatattcttcctttccaaacaccctagatttggggaactgtaacctctcttctttgatcgaatagttccctatgctttccttgtcataatagcactaatcattcctttactggaatgtttactttttgtttttgttttgtctttcctgataaaggcaggactggtatctgtgttgttctttactgtgtttgtaccaaccacagtggcttactatagataggattaaataaatacttgtgcaatgcagattaaattggtgcagattacttattgatgtttgctcacaagaggatttcaatgttcccctttggaatgtcccaccacaacctccccttaaaaaaaaaaaaaaacaacaactttttcttctcagcccacaatctggcaccattaaatggcccaatataagagggactcggttttataattaggttgggagcctttttcttaaatgtactgcaccacaatctggcaccattaaatggcccaatataagagggactcggttttataattaggttgggagcctttttcttaaatgtactgcaccattagtcctgttaaatcacttgctaacatcaaatgaatgtttggaaaaagtcctacttgtagtctataaaatagatggttaaagatgc

SEQ ID NO: 106705 - DNA, 1023 bp, Homo sapiens
atttgggctggagtaatcatctaacagaacaatgtcccttaggcaaaatcttacttaattttggtgtagtttcattacttatctctttccctttttttggtgtcaaaccttactgtctgcagtggctcttctgcttgtcagaagttaattaagttgtaactaaaaaaaccccaaaaaacccacaaaataaaagaagtggcttaaaaattctatttagcaggttaggcatagccagttgtgcttgtgcttatccaaagcaagccacctagcaaacacacatgcaccctgatggcttcacaccgcagaggctgccggtgcctgtggtcagaccatcatccacaaattgcttcaccaggggagtgctctcagcccctgacacaacctctctctttctctgtgggcctgtgggccacctccaggaaaaacctgacttctaaacaatttcctggtgagccagctggggaaggagaggatttccgtagctgaacactgagcacggccattcaaaacagacaaagctagcaagcgttggaaatctgaggcaaaagggcaagggagaagtgtcagggtggggctggctgaggtctgcaaataggctgcaagagttttcaaggtgtttgtcaggctgccattcttttgacagctcttcaaaatctcaaacagtaataacttgctattggaattcagatttcagaacataggcctccttgtctattgctagtttatttccctgatgagattctcttcctgggacagtgggtgtggtgtagggtttgctcttggtaagctatacaaaattgttaatcatcaggaggagatactgtctgtggagaaaattaggtagagattaaaacaaccaccaccaccaccatcaccaccaccaccaccatcaccaccaccaccaccatcaccatcaccaccaccatcaccaccaccaccaccaacaacaacaacaacaactttgaacctgagctcagtggcgcacacctgtagccccagctactcaggaggctgaggtgggag

SEQ ID NO: 106706 - DNA, 1010 bp, Homo sapiens
ataagtgactcagtctatgatatttcgttatagcaacatgaacggactaaaacatcccctaatttcttgtgagagtgtggcatacagagtaaattctttgagcagccattcctagtattgctttccctaagcgctctctgctttgcttggaataagaggtaggagggtttggagaacactcccctgggtgttattctagtgcttcactgctttccctcttaaagggcggcctagcctagctcctggcacatgtttgccagtgatgtagaaattctgtttctaaggattaaagaggtagggatgaaaataattaggcaacttgcagcctctgccacactcatatttcaagattcttctttgatttttttcattttagtcacttaatgattcttccttcttgttttattcttccttgatctccagggactgtaaaacaatccagaaacttagtaatattatgaacaagcatttatcagctggccacaatgtgcttattaatgttcaaatactatgaggaatgtcagctttgctccccaaaccttgttagactcaaaccctcatgagacttgataccatgactactaatgtccttttattccccaaatcgatttccctttcctttcttactgggttttagatgcagatgacacagtccagggaagatcggagggcctgtctgagtatggagaagtacgagctggtattttatatagcctatgacactcctacttaatgacttagatgggctcataatttcacattcaccattgaaatattttttctgaagttagaaaatgaaccatcgttagggctatttgacaatatttctttgggatacttttcctcattcagtttgtttatgagtaatttaagatccactgtcatcatctacatttagctgttggtaatttgtgcggagttcacattgagttattgattttaccccctacagtgtaaacatgaaagactatgaaataatgatcttgctggtgaaatgtttgtatattttt

SEQ ID NO: 106707 - DNA, 1027 bp, Homo sapiens
cctcagcctctcgagcagctaggactacaggcacgtaccccacatccatctcatttttttatttttattttttgtagagatagagtctcgctatgttgcccaggctggtcttgaactcctgggctcaagctgtcctgcctctgccttccaaagggctgggattacaggcctgagccattgcacctagctgagcactttcaatttctgctatcttgcctgcttaacaagtaacattcccttttaagggaaaaataatccagggtcactttttattaaattttactaagaaatggcaaaactgcttaatggagttgaaccaggattcttaaacagctacttgagttaggcacagagttaggcacttttagattcagtcagaaagaatgtttttttcctggaactcaacttttttcatttgagaaatatgaaaattggcccacaagctatatgatgctgccctgtcacagtggaggaaaacaatgcccagttcacaaataagttttgagttctgtagaatgaatatatttcttaattgcaggatatctaatgacttgtactgttgttaaggtgtacaaagtaaggctttctcaaactttcttgaacatgaaactctttaatatgttgtgatactgcttctctacagaatattcttcttggaatactcatctaaagcagtgtttttcaaattgtaggacaagattagtgactgtagtgaaatctgtactgtggattacaaaccagaatctatatacacacatatatatatacacacacacacacacaatcacacacacaattagtgcatcacatatagtagggtattgtttcctgagaagttttttttttttttgagatggagtctcgcactgtcacctgggctggagtgcagtgatgatcttggctcactgcaagctccgcctcccgggttcaagcgattctcctgcctcagcctcccgactagccgggattacaggcgcctgccaccacgcccagctaattttttgtatttttagtagagacagggttt

SEQ ID NO: 106708 - DNA, 2921 bp, Homo sapiens
aaattagctgggcatgatggtgcatgcctgtggtaccagctactcaggaggctgatgtgggaggctcgcttgagcctaggagatccaagctgcagtgagctgtgattgcacttctgtactccagtctgggtaacagaccgagaccccgtctcagaaaaacaaaccaaaaaactgatattgctgattaaagctttcacttgaaagcctcaacagttaatcagaaacgtacaatttataattagtgtaaattgagcataataattttattatagcttatctcagtgtattcatttgatgatttaaaaatataaatataggagttttcatcccttaaatttatgtcagaatttagagacatgttgtattattctttgtgttcctccattttaggttgattgtataatttttccaggttttaaatatatttaggagatatttataccttacatatgctgtttggggtattacaaattctaatcccagaattactatagataaaaccataaatataaaatgataggggcctattatcttagcattttgttagtctgcttttaggaaccatttgctatggcttaccaatacaattttctttcaacattaggatcctctttccttgaagaactacaggaaacacaagctcgggagttattttacataacaatgaggatgagatgttatttgtttataagttattcagtgtctaaaagccttagggtaccaaacataacacaagatagaaaagaaacaaatttgccttgacatttagctgtaaattgaaattaattcatataaaatactgaggtgaaacacttcagttgtagagttttgcatactgcttagctttcatgattttgtcactttagattttagttcaaaagtgtgcttttaaactgtataaactcattagctgcataaaattctccagctatccactttttcctatattttcttactctgcaggtgaaaacagcatttttaatatttaacattcttaagtgatctgtttcatgtggattgtttttcgttttcttgtccctggccctacctcttctggagtcagcgcaggctggtgggtgcgctgccagatctgggtgtgcgtgtgtggtgtcaggataccattattgggaaatggatgactgcaaaacagtgaggcctacttgtaggcagatgacataaccagcagctcactgaatgccattgccaagacaaataggtttgagctctcccctcttggtggctgttctcgtccatgctgaaagtcattgccacccttggctctgcttttctctaacctggaggaggttgctgaaatttctgcccaacggaaaaaaaaaccaaagggaccaaaacaggatgtaagcaaagttttaatattccaaaccaggaaataaatgatgaaatgcagaaaaggcagggaggaaattctaactggcaccaagttgggaggtcagcgtcaatagcccacaagacgctgacgaggacttgtagttcccgaaagttctttaacttgtgtttcttgtgagttgaagtaacacattttttattccttcttcatcaccaccctttctaattcccagtcatcacccttagtgccctgggagggcatgcaggaatggcaggaagtgccaggacctcacttggacagataccctcggtggccacccccttccagtgtccatgctgtaggcggaccctagggccaggcccagagagctttctaaggtgcatttcctcttaagtaaaacataaattagagagcaggaaaatgttggctcttgattttttttcagggaatttatttaataaatactattttaatactaaagatttttaaaagaatgattaccactttattgcttgcctctcaagtgtgcctttagccactgctctgtctctagcacctagaacagggattggcagtgttagaagaacaacttcagccaaattaaatttaaagaagtttaagtgagcaacgaatgattcacgaattgggtagtccccagaatcacagcagattcacagagactccagggatgccctgtggtcagaataaatttataggcaagaaaagagaaatgacatacagaaatcggaagtgagatacagaaatagctggatgggttacaccttggcatttgccttatttggaaaagagttgaacactcagcagtgtatgactggttgaagcatggctactgggattggccaagactcagctattgttacagctgcatactcctaaattagtttttcacccttgtctacctattagacaaggttggtccacaaggactcaaatataaaagtacagagtccttctcaggctatacttagtttgctttcacagcagatactacatacccattaagttttcatgaaatgaatgtgtggtccccagatcatcagcctcagaatctcctaggtggtcattacaaaataactattgggtactaagtttagtacctgggtgatgaaataatctgtacatcaaaccctcatgacacgagtttatccatataacaaacctgcacatgtatccctgaacctaaagtaaaagttaaaaacaacaacaaaaaaaccaaatgcagtttcttgagtccaccctggcccttcaaaatcaggatgtttgggagagagcccacagactctgcattttaaaaagggcttccccaccagatccattggtgctcccagatttgagcactcttgccctacggacacaccacttgtttccaatttccttgttgcttttcatatatgttgtaacgtgatggatgaatttggttcccgtcctctatttcatgccccatcacagcaatattatgtaatggatatcctcaatataatgaatgaatgctaatattacataatgaatatttgcctggttgttatattttaatgctgtcggacaaaattga

SEQ ID NO: 106709 - DNA, 1068 bp, Homo sapiens
tctagaatatagggacacaaatgttggacacagcttgcacaggtttattatgcaggtgatgggaaggtttctgatatgacacgtgctctggaccaagggccttgcattttaataagtggagtgaataaaaatttatagccaaatgtcatgttggcagcaatggaagtgtgctccggaggtgacaaatgctttgaggaatatagagtgtctgacagcacaatgtgaagaaatgacagctgccatctttgcctgtctttttctctgtgctgcatttgctttgctcttgtcacctttcttaggctggttactgggcagttggaagagactgtggagaattcaattcagttgtttggcttagggacataaaattgaactgcataattcatggataggtatctgcagcatcgtcttcgtgccctgtagaatgggttgactgccaaaggattttacgattctaaaatcctaacagattttaacagttgcttaaatattatttcttggcatatatagctttttaagtctgtgggtcaaagatagatgtactcatttgagacttagtgatttgttttataagtatgttgaataagttgagccagtttgaattgtgtccttctcttttaaagaaaagatttcccaaatttaaacctggatttagatgttttttgggttaaccctactgaactttccaaaattttcaggcttctgggcctaactcaaactgtaatttcatgaggccggccaagtgatttttaatctcatttaaaagttaccataagctctacttgaaccatttgggttttagtataataaaagggcacatgtattgggttttttatttaggctattgcaataaagagaactttcattaatgaagaaagtctcaaagaaaaggcagaaaatttggggttttatgaaacaagggagtcatttaggaaggctggagatatatcttataatattccagggcagagtgtccattgctgctagcagcaattatttttaaaaagatactgccaggctgggtgcagtggctcatgcctgtaatcccagccctttgggaggctgagg

SEQ ID NO: 106710 - DNA, 2135 bp, Homo sapiens
ttcagtggttggcattttactttcggtgctacagagtggcagcaagctacactgtttctgtgctgaggttgttgtctgagagagatttatctggccctgtgagccccgcacagcagggagacaaaccttgatttgttcagtggaggaaagaatgtggccttgtacacctgcctccctggatacacctgtagggctggtttccctgctgaaacctccctgtggagctcttgacactggtgcaattggctcagccctggcaacagtgtcaacagaaactgggctcggagggacccaggtttccgtgtccttctcttgctggttaaatcccaagtatgtgtgtaatcgctctcaggctggggaggtgaagttgaaacctggcttatcactgggcctagattctcctgtagcatattttagataagagtggaaaaaatgccaggcccagcattagctgccctgagactgaggagctttgtttttcctcatgaaggcctttggtttcgtctggaaatctgcctgtgaataggccagaaggtataaaggcagctgtccttacttatctagttttaatttttcagcaagtgatttggaagcaagaatgaagatttgatcagaacctttgctcacttgcaatgagtagagtcttgttgcttgttttcgtttggcattgccctccctttgagaacaccataggcagctgctctctgttggaattccaattctgtgaccttgggcaaattacttaacctttccctgagcctcagttgtctcatctgtaaaagggggataataatagtacttgactcataggttgtattagggattgcagagttagtatttgtagtccttagaacagtatctgcacatggtaagtgttatgaaagtgtttgtcaagacaaacaacaggaaatactttgtacagttaattatatgaagtgccagtgatatttatgtggctttttgttgttgtttgtttgtttttgagatgaagtctcgctctgtcgccgaggctggagtgcagtggcatgatcttggctcactgcaagctccacctcctgggttcacgccattctcctgcctcagcctcccgagtagctgggactacaggcgcccgccaccacgcttggctaattttttgtatctttagtagagatggggttttactgttttagccaggatgatcttgatctcctgatctcgtgatccacccgcctcggcctcccaaagtgttgggattacaggcgcgagccaccgtgcccggccttatgtggtctttctggttggtaaatattctaacacacacaaattaatcattagatcaaaagaattgtgttttggtacgtagttaaggtgctcttttcttttaaatatacactccttgctgttcttcctgttccctttgcagagcaaaagtatcggaaaaaaacaagtgcaagcacttccttctaatattggtttagttgtggtcaaaaacaggaattatgagtcatgaacaccaaattgacaggaatgagccaaggcaaaattacatcctaaggatgggggtcatctttgacaaacagacacacagattcatcaggcattaaaacagcattcttaaccttggaatccacgggtccccaaaaagtctgtcagagaaataggggatctgcaaatttgggtgggctaagagttatctatctacactttcactaacccctaactgaatttgagcatttccttgaattatgaatgtaggcaacaaaccacagtgacagaagcaatacttatgactttgtcgtcagtaggaatctcagatattttaatatcacattgcaatctcatttactcttatcactacagtagctaatagattcaccattatttatttattgttcttcagtgccttaagaaaaagcatgattatttaagaatattttgctcactacagttcagtataattaggttcctttggactcttacatattttattcatttataaacattattctgaggtaataatagtcatcaccagactgccaaagaactccatgcgtaaaaatgattaaggagttttaaagttgaaggcttaagctgattggaatctctagagctgttctgtccaatagaaatataatgcgaaccacttgtaattt

SEQ ID NO: 106711 - DNA, 1315 bp, Homo sapiens
cagccaccacacctggccaaggttattttttattagcttaaaaagttatttacctctaacgtgttttcttcgcttcccccctcctccctgtctctgtgtttctccccatctctcattctctctttctgtctctgtctctctctttcgggaagttaagtaagggaagaaagaccagatgagagaggttaaaactgctgggctctgatttcacaaacaggtagtcttttgctaactgcatgattttgagcaaattccttcatttttctaagtctcaattctttcatctctcagtggaggtaacagttgtacctcttttgttatgagggttatgttcagaatgacaaatgtcagaatttgcacaaatagcaacagctgcccttacctggcacttcctcagtgccaggcactgttctgagtacctgcttggtatatatcccagcagccctgggggttggggcctgtggtttataggtgaagaaactgaggcagagagtgtttaagaaacttgacttaagattcctccagcaacaagtggcagaactgagattggagtgcgaggctgtgtagtccagagtcgaggtcctctgtcgcagcactgccatttccccgccgtgccgcctgacaacacaccccgcccctcctccttctctctgtagataactatttcagtttggcataacttcctttgtaatttgtagcaacaaacctggggtcagacactccactgcctgtgcatcttgcctgtttccggatccgccgtgtcacagacattttctatgtcagtgcctatggctctacccaggtaaaaaattaaccaccttggcaagcgctgcccatgtcgctcctgcttgccggggctggctttctttcagagcaaccccgttctagctggcctgctgcctaggccctggctttctttcccacaaaatagcttctgaaaaaaactgtgggaaacaaatggcttcagaggtttttagaaacagaagtgcaaactctaacaaatttcatctggcccaaaaatgttattacccaaaatcttgaaaatattttcttataggattattcccccaaggttgttaatctgagaacgatccaggcctaataggcctgactttttgccccctgatgttggagtcttgagtagttgagtgccggagtatggggggttggggtaaaaatattcctctggaggaaatgaagtcattttatttaacattatagctaccactgggactctatcattttagaaagggaatgccagttcacacagccaaatgaagcttttaaattagtccaagaaaccttttaaaaggta

SEQ ID NO: 106712 - DNA, 1055 bp, Homo sapiens
tttagagccagaaactctgaatgagtttagctttaaccctggttgaagggctactaggtgatcatttgaatccttaactgaaggtggggccattttgttagacttcaccctacagaatctcacacaccaaggtccaaatgccggtggcaggctatgtaaacctacatagttatttacctctttgagactcagtctccttatctgcaaagggatgtcattttaaattcctcaccgagttggtatgaagagcatcagtcattccaccaaaaagcacttagttcctggcccatagttattatcaaacagtgagtcacaggaagatgcggctagctacattgctgtagaatactcttatatttattttagtttatctatttttaggggaaacaaagttatttcacccagagcattagacgtcaaaagtcgatatatcctttctggaactgccttgtttgtttgatgtcctggtgttttgaaggctggcatgtttatggccgggcagaaccataaacactccttcggcccagggctgccctggatttgtgtatatttcatacatgggcagtggagaaggaaatcatcttcagcttgtgttttgacacagagaagttttgcttttcgtttatctactctctgcatcctccaccgaaaacaaacagaacactctggcatgggtaaatattgtgactggcggcctcagtggtgttgtttttccctttgctacaattgctgagagactgatggtggcattgtagaagatccatggttgtcattctgatacttcagccagaaccatagcagttctggaaatgaaaaagtgaagtaaagaaaaataagaattacaagacaattttttttttccaagggaaattgtaaggcatttcaaggatggaaaggcaaaaatgttatatggttttgcatttcttctcctagcagcgatattcatcatgccaccactcctgagccttagaatagatagactcttcaaagacagctgagcttcatttcaggtgggttccctccgagccttctcctgcttcatttgccctgcttag

SEQ ID NO: 106713 - DNA, 1117 bp, Homo sapiens
tacagatagattcactcagtatggattcttttatacctgacttcatttcctcaacattgtattgagatttgtccatgtcgcatgtagctgtagttcattcctttttcttttctttttcttttttttttttttgagatgaagtcttgctctgtggccaaggctagagtgcattggtgcaatcatggcttattgcagcctccacctcccaggctcaagcgatcttcccacctcagcgccgcgggtagctgggactacaggcatgtgccaccatcctcagctaaattttttttttttttttttttgtagagacagggttttgccatgttatccaggcaggtcttgaactcctggcctcaagtgatctacccatcgacgcctcccaaagtactgtattatagatgtgagctagtgtgcccagcccattttgacttctgtataatactatagcatgcatatatctacatttactcatgtgtcctacttttgatgagatttgtgttgcttgtagtttggactattacaaattattatactgtcattatgccttttggtatatatgtattttcatttctctagggtatgcctcagagtggacttgtaggattgggttagactatgcatttttctaatcccaataacataattttttttgagaaggattctcactctgtcacccaggctggagtgcagtgacgtgatcttggctcactgcagcttctccctccacggttcaagtgattctcctgtctcagccacccaagtagctgggattacaggtgtgtgccaccatgccaggctaatttttttgcattttttatatagagatggggtctcatcatgttggccaggctgttcttgaacttctgacctcaagtggtcctcccgcctcagcctcctgaagtgctgagattacaggtgtgagccaccatgccctgccttcaataggtaattttaagcagtgttccagctcttctagtttatgttaccacgagtagtctatgggtttccattatttaacgtccttgtcggcgcttggtattgatgatcttttaattttagccacctgaaagtatgcctactttgaattttttaaatttctgtgtttcactgtaaagaa

SEQ ID NO: 106714 - DNA, 3556 bp, Homo sapiens
ctagacctttaaaaacaagtcattagtttctccaagagggcttcattttaatattattttctaagataccctgcatagcatatttaagggtctttctatgttgaatgcacaaatgatttttcagtggatttttggggggtttttacatgttttccttaatttacatgaggactctttattatactgatcatctatttagttaacagtgtacagttcagttatgcattttgcagtgttgcataaggaactggagttgaaaataacagttgtagttaccacccaggaagggaggggctgaataactgaatgaatttaaagaggtgaggggaaatgcattatgggtagatagtaccaagctcaaggtgacttctgtagatttgtgttgactaattcttcgactggacagagaccagttcgtttcctagctgtctgtcctacctttaatgcattgcagtaagtggtaatagcctgttgcaggggtacaccaaatggacacaggaatgcccccttctgccttcccctcttatccctagatgaatggtgtcatggaaattcaaaggttattccgggatttcatgttagttgaaagcaagttttcttatttctcatttggcatatcaatttttgcaggcctgccatttcaggctggcccatgctctgtactgcctatagcatagaaaagacagatgaacttatagcttagagccaaggtacagaaagtaaataagagtgatgtcttcttaatagacaaggaaggaatctatttaactggggtatttcaactcttttctcagaattttctttgtggccatataggagcaaggatggtgaagttatatggaaacaaaggtggggaaattacagacagaaatggaagagttgaaaggaaggaaggataacaagagcccacctccctgcagtctgctcaagggaaatcttgtacaatttgtgtggacaatgaaatttataattttggcttcaagcttgggtgactttctcctctctgattataggaaaaaatattataattaaattaggattacgcactttttcccctcttcagtgtccttacataggacagacatccttcttgtttggtgaccacagggaccagtgacatcctagttttcttggaattgtttgtacttattgctttattagaaaccgccctatagtcagatgtcttgcccacccttcttcagttcttttcccccaagatgtcaaaaccctggtgaggaatctgtgaaatgtgaactatgatttggttgtatgaggttcagtgaaacagctggaggttttcccagcagaaggctaacgcagaattgtctagacatcacttttttcttatctagtcaagcttttctgggagcttttccacatgaggaatctaggctcaaaggaaaatcagtttgactggctaaaagctcatctggcaagtttaaatcactccggaaacatacagagctgcagtcattggtttgacaagaacagaaagatacttgtctctgttgttgctagtattaaaagagaatttattggccgggcgcggtggctcacacctgtaatctcaactctttgggaggctgaggcaggcggatcatgaggtcaggaggtcgagaccatcctggctaacacggtaaaaccctgtctctactaaaaaatacaaaaaaattagctgggcgtgatggcgggctcctgtaatcacagctactctggaggctgaggcaggagaatggtgtgaacccgggaggtggagcttgcagtgagccgagtttgcgccactgcactccagcctgggcgacagagtgagactctgtctcaaaaaaaaaaaaaaaaaaaaaaaaagagagaatttatttatttgtccattaagacattaggatgggcgtggtgccttacacctgtaatcccagcactttgggaggctgagatgggaggatcacttgagtccaggagtttgagaccagcctgggaaacatagggagaccttgtctcaataataataataataataataataataataataataataataataaaaatgctgggatggtggcccatgtctgtagtcccagctacttagtaggctaaggtgggaggatcttgaacccaggaagtagaggctacactgagctatgatcacaccactgcactccagaccctgtctcaaaaaaggaaaaaccaaaataacaaaaagagcatcactcacttactgtgcacagacatagtgccttgccctggggaatcagtgatgggtagaatagtgatgttctttgtactgaattaaatcattgtatagctaagaggataaagacaacttgagtaaagggcaagtaggaaaggaataatgtcttaagggagtagaagacaaaggatgcagtagagaggaaggagaaatcagagaacgtttgaatgcagtaagcttgaggtgagcctgagatatttttggaatttaaccaaaggaaggggctgtcaaacaaagctagttcagagtcccaggatttgtatcttttggagtgactgtgccctcagaaacttccagagacttttagaactcattcaggctttggctttggcagttgtaagaagcaccacaattctttctactctggacaaggggcaaaatgtggttttttttgttgttttttttttttgagttacagtctcactcagttggccaagctggagtgcagtggcacgatctcagctcactgtatcctctgccttcggggttcaaacgattctcgtgcctcaacctccccaggagctgggattacaggcacacgccactgtgcccagctaatttttgtatttttaatatagacagggtttcaccatgttggctaggctggtctcgaactcttggcctcaagtgatcctcctgctttgacctcccaaagtgctgggattataggcctgagctcccccgcctggctaaatgtgtatttttgctcacaagcaccatgggcatcagctttaaacctccgatatatgggccatattacccggaactctgttgtcttctgtacgacttttggaagttaagtctacccatgcagataaggatatttaattccacactaacctcagcttctcttaggaaccactgcagagaatgcccagtttttacccagtctaaggctattttcggtcaaggcatgaaatgactttgtcattgcagtaaaccctagtcactgtgcaggtaagcctcttcttgagatggattgcatgcatacctttttgatgatacaataagcaggtctttattggatgtgaacagagtttaaaatgttgctgagttgaacattggagggtgaagggatttctccatagagttgttcctgcatgttaagaatattgagctaaatttagaatgtcttacactgtacctattttttcctgtgtaagtctcaaaaacttgatttagacttgaaggttttatgaatgtccctacttttttgttttaagagggaggaagagggaaggagagggaggtcatttgattgagaagggcataaatcgcagtggatgagttaccacaaagtcagtccat

SEQ ID NO: 106715 - DNA, 1051 bp, Homo sapiens
atagttgccctttctctttttgtcagtcgcaagatgcagaaatttcaggattctataaggtggcagagatttctgtgattgaataaaacaaataggtagacgcacctaactattatttattattattattattttggtgtaacttttagctattgaaaagtcagtcttgcagaagagagaacaccttgctgttttttgtagtttggtaaaatactgtcccttccattagtatttccaattcagagggcttttgctgtatgggctttaactgacttagctgaataggaattaccatggggtattttggcagtgccatcattggtcacctgtttagcttctgagatgctagcaaattactcttagtttgttgtccaaaatattttgtgggaagaaggttagaaaatagaaataagtatactactgactctatctcatacatggaagttttgaggacaaaccacactccagttggtcatttaccctagattgtggcattgataccgtcttctatctctgagaagtaacccatagtaagcagtataaagaggagggtgactggtggggcgtgatggctcacatctgtaatcccagcactttgggaggtggaggcaggcggatcacttgaggtcagagttcgagaccagcccagccaacatggcgaaatcccatctcttaaaaatacagaatattagctgggcatggtggtgcattctactaggcagactgaagcaggagtgttgcttgaacttgggagatggaggttgaagtgagccactgcactccaggctgggcgaccgagtaagactccgtctcaaaaacaaacaaacaaaaccaaaaagaaaaaaaaaaagggtgaaacagagtcctcagattttgtcttctcacttgagttcctgcttcagttcaaattcattcctttcctcctcttccattaatcctttctcagttcttgagattacatcaagtaagtctctatcaggtgttaatatgtcttcagcaccccctaacatttgctaattttccttcctaattgagagaccataccttttaa

SEQ ID NO: 106716 - DNA, 2071 bp, Homo sapiens
caatcataataaaaaagggtatagagtgaaaagtctctaatatcctgacttctccagtttcttgtcctagaattgtttatacgtatacaagtatacttgtttcccctcctttctcttgctcgcctttaaaaaaatataatatatatatattatatagagaatctgtgtgcatatacacacacaccttattttaaaaatgatatgtgtatatgagtttctgctccttgtttttttccacttcacgtttacagctacattttagagctctttttccatcagcaccaagatggattccattcttttcaatgacttggagtttacctttgaatcagtgttctgtatgtaattcattaagcctgtcctctgctgatgagcattaaggttcttttcagacttttgtttttacaaacaatgctggaatcagtaatatatcgttgtattttgatctttatgcacatataattgcatttgtaaaataaaatcccagtagtggactttcctggttcaaaaggtggacacatttcatgtttttgttcgatattgccaaattgctctttcaaaaagatgcatcatttttcacttttgccaactgtataagaacatgcctaaaatttaattccctttcttaccatatttttctttccatttctgtctctcatttacttgcttcccttagacctagtctagaagctgtcaggctttcagttcaagggtttatctcattacattccgtacagcaccagtcataggagcatttgtgaaagacataacctgtctcctttgagagcactgcctcagtttcctccttgacccccaggtgtgggcattaccgctgcagactcacgcctcctcccctttaatcgctggctcagcttcacctggatgaaatccccttcctcactcttccttcccttccatcccctgggaggtcttcaagagctggtactcatctatagagcctgagaagttgaaatctgttaacttgccttgggtgcttgccagtacttaaagacaggcctggttggaccactgcattctttgtctttgtaggagaagccatatttgtttgcatgtacagcgtcaagaaacgtttcctgtcgactgctttggcctggcatttccattaacactttcaattgggagatggtttctctagcttagctggcagaggacccagttttacagcccatctgcttctctctgtttctcagccattggccccagttggggcaacctgtaactggaatctgtggcctatagattttaactgggttactttttggaggggaggcaggtcggggtggggaaatcctttcatcctgacattattggcgtaaccttttttttcagtacgcttccatctttgaggaggagatgacactctgggctcttccttgctctcctcccgatgttttcttatgaaaaattttaaacatacagcaacgttgaaagaattttttagcaaacacctgtatgcccgctacttagattctgccactgacattttaccatgctgttttatcacatagctgtccaactgtctatcactctgtctacctttttgggctttttcagtgatgtttctccagcatttcaaaggcaccatggtatgggtagttaggaatatgtgctgtggtgccagactgtctgggtttgaatcctggtctactgtccactaactctgtgactctgggcaagttgctgagcctctttgtgcctcagtattgtcatctgtataatggaaatcgcggtagtgctaacttcatagagttttgtgagattaaatgtattaatacatgtacgacacttaaaacaacggttactgtctattaaccatttggtatatgaaagagagtaagtgctaaagtaatgttcatttcatggatttaaaaaagactaattcagtaggtgtcatggattttagggagaagcaactgtgtgcctggtactgtgccagacattttatgtacattgcctcatttggtcttcaaaaccaccttaagcagattatccccacttgcagatgaacaagctgatgcctcgtaattagcagcaatggggtttgatcaca

SEQ ID NO: 106717 - DNA, 1151 bp, Homo sapiens
tgggtggaaccatctgagttggtttaatgacttttgccaaccaagaccctgagcccaatcctattcattcctttattcagcaagtacttattaagcccccatggtatgctggcaactgttctaaaggagcttaaatgctctcagtacttagagctgtgctgttaggtggtcgagggttacatgtgtctatttaaatttaattaatgaaagtcaaataaaaaattttaaaatgcagttcttcgataataggagctgtatttcaggtgcttaatagccccatatggctagtggctgctgttttggacagcacatgatggatatcttcttgcagaaagttgtgttggacagtactgacttagagggtttagggaaagccctatagcagtggtaaagagcaacaactccttaaaccacaagcttatgaaggggtcaccttgtgagtgcaagcgtgctctagttattcagccacatttgagccaaaagctaggcagtcagcgtccttccccagcacttgggaaggtgaatgagcaagcagttcagtttctcccaggtcagtggcaattttatcccctagggagcacttggcaatatctggagatatttttggttattgcaactacgaggagggggaatggaggccagggatgctgataaacattctacaatgcacaggacagccaccccccagcccctaacacagaaccataccagccaaaatgccagtacttccaaacttgagaaataactccgctcccggtgaaatggttacagataacagctaggaactgtgagagcaatgttttgtggcatgtggaagaagctactattgtacagtgagaggaaatgaagtcatgaagatggagagactccccacggtgttcaagtcttcacttcccttgttctccagaccagcctcaattcttcccttgggttctatgaaggacctcagtatgataataactttactctttcgcttgaattactctgagctgagtgttagccttttgctaaatgttcctaatacagcaaattacgtagtccttcttttgattgtatcccatgtaaaacttggtctacaaatatgctctctgactaccttggatttaaggtcgtctcatcaaatgtttagcatacgataagcatttaattgc

SEQ ID NO: 106718 - DNA, 3020 bp, Homo sapiens
gtagaaaataccaggttagagaacttaacaaaaatttactttatctcataacattttggtgactgttaggaaagggggctgagatgagtgagaatagggggcacctgttctgctgagaggagaacaaattgccttttatttattttattttatattttattttattttattattttttgagacagggtctcactgtgtcacccagctggagtgtagtggcatgatcatagctcactgcagcctccaactcctgggcccaagtgatcatcccatctcagcctcccaagtagctgggactacaggtgtgagccaccacacctggactgccttacttttcatctgagtaaaagtgtagttggtaaccaccaggaggtagtatactagtgaagtggttgggagaacaagacttgattgattggctctggctttcataggagcaccgctgtctttcatatgtttaactttcatcaacttgctggaactcatttgagcttattttccatatataaaataagaataaaacaaacatgtttttgtgttgttctgaggattaagtgtatgcgtatatgtgcctaataaatgtggaccgtgaatagttgagtatctgactgcttctcttgatgtttttccccttgttgttcttcatcgttattcttattgttagcagctgatctcacccagtcctagcccttcaggggggatcataatgattttagcaaaaatacatgatattttggactgaatagaaactgcaaataaaaggaagtgaaatggctctggccgagtaaagatcatatagtgcctactgcccagaagttgtttacataatagaaacaaagttaaaaggaatacctaattaattaatttattataattttaataaaggaagaaacatgtatatgtcacaggcatatgtcttagacataggaacctgactgcatcagaaaatatttaaaactaccaagatgtagtcaattaaccagcaaaatttcttctgctggacattttctaaaatatattctctgctcctttctcgcaatagttaacaatttgaattagcaacaatggctttatgttataaacctctttccacggtcttctctccttcaccttcttttctgctgctagtgtgtgtggacttcttgtctgctgtcttctgtccctgtcagtttttcaaatgagagataagaactgctttgcaatgtgaggtggcagaattagggaccagtcaggctgccaggctggaggaaggtgggcctgagcaagccttgcccaagcacctcctttcttatttcctagaatagtctgttgccctttgctagttctctcatccctggctaacagcttgtcctatttgcctttggattttattatctgctccttcttgctgaggtacgacatgattattaagtgtgcccaagaggaaactccattgagctcttggggtgaagcagcgtaagaagtttgctccttaggaaaaataaaaatcttaactggttctggtccttggtcactggtacagaggtggagagaagtagagctggttaaagtccagggaagtgtgtcaggcaggaagctgggagggcttctcccagcagggtgcaggaaggcttctgtgtcttgtggaagtgatgatgtgcccgagtctgcttcacgagtctttgtagatgataacagggctcctgtgagccctcaggttgttcacagtttgttttctttgaattgcgtgaaaacatgtgcttgacttggatgtagattttatttcctttcagggtggagggttgcagacagtagaagatgttggctgccagcttggagtgactgccagggacagctgaaaggggaaatttaacgagaatgttgaggcctgaagtgcttcagggagcatttcaaattgcatctctttagaatcagatggtctccagagatcataatgggttatgagaggtgccagggtttgttttcttcaggctcaacatcacttaagaccataatccatagactcttaaggaatgaagcacagttctacattggacccaccttcttcaaggatctgaggcttagtggaccttttaaataatgattcatcaaatgtcatagttcatggttttatttatgtatttttgagacggagtctcgctctgtttccaggctggagtgcagtggcacaatcttggctaactgcagcctctacctcctgggttcaagtgattctcctgcctcagcctcccgagtagctgggactacaggcgcccgccaccatgcctggctaatttttgtatttttagtagagatggggtttcaccatgttggccatgatggtctcaatctcttgtacccgtgatccgcccacctcggcctcccaaagtgctgggattacaggcatgagccaccgtgcccagcctatttatttattttttaaaactgatctatctgtagttttagaatgcagctgatccttagccacactgtggcaagtattcattattctttcaatgttctcttggtggcaaagccatgaccattgagacttaatgtatctgactcttgctataaacatgctgtgtaacaaacttccctggaacccataacctgcaacagcaaggatctcattctctcagtcatagctttgtagggtagctttacttagggtgtgggttggctggtgttggctccagagtgtggggttgggttcaggtttgttccatttatttctggagtatagggatgctgtaaagaattgtgagcaatggttcagtccaccataccatattaagctttcttgattctttttttttttttttaacaaaattgtaaagtatacctgacacaaaatttacccttttagccacttttgcatgtacacttctgtggcattagttatgtttatattgttgtgcagtcgtcaccaccattcctctccacaactttttcatcttcccaaactgaaactctttatcgattacatattaagtccccacttcctggtacccccgatccctggcaaccaacattgtatt

SEQ ID NO: 106719 - DNA, 3991 bp, Homo sapiens
cccctggccttctcttccaagcattctaggctcctggagattcagcagtgagcaagacagagcaggtctctgctcttgtgggaaggaggcagaatttcctacttatcagtgtggattctagagccacaaacttccagacttggatcccagctttaccatttagtggttgtgtgtcttggacaagttacttaacctctttgtgctttagttttctcatttgtaagaggaggataatattcttacttgccttataggcttgtgagaaactgaagtgcttagaactgagcctgtcacatagtaaattttccatacagtgtaagctttagctttgatcagctgctattattataaagcttaccatcttgtgtgcacacatatggcacgtaataggcatgtgagtgaataaatgcggaaaaaaataacagctagttttgagagataatgggtaatgcaataggtgttagatgcactggtcagggaaggcctctctggaagttagaaacttgagacaggacctggattttgagtaggagttggtctcctggtgatctgggggcagaggacagcgggcagagggagcagtgccaacaattcaccgaggcggcaaagaacgtggcaggtttgaggaagaactagcagatgaatgtggctcaagtcgggcacaaacaggagatggaggcctgtagggcctttcaggtcatggagatgaggtttcttttttttttttatttggtagtggcaggaggatggagtctcactctatcatccaggctggagtgcagtggtgtgatctcggctcactgcaacctctgccacccgggttcaagtgattcttgtgcctcagcctcctgagtatctgggactacaggtgtgtgccaccatgcccagctcatttttgtatttttagtagagacgaggtttcactatgttggccgggttggtggtgaacttgtggcctcaggtgatccacctgccttggcctcccaaagtgctgggattacaggcatgaaccaccgcgcccggccgagttttgattttattataagggtggcaggtccagctgagcggtggcgtgatctggtttcgaatacgctgttctgggacactgaaagcatacttacctgtacctaagtgtgttttcaggatgaagtcaagtggagtcctcgtaggttgagggtgacagtgacaacaaagtgatgatgttgacaacctttcacatatgccactgcgggatggtggtggggccaaaggattagactccatgatgacctatggtctcctttccaatgttgagatgcctaaagcacaagttagatggaaagaaaacctataacatcacaatcatttataagtaggtattgagcatcactaaaaagcccagggtgctttaattgacattttggtttcctggaattgggatttgaaagattacctgctgagatggtttccatttcttgttaacttgtaatatgtgcacaatttctgcttgaaaatacctgtaagagacaccactgagagtgaagctgtcatttgaggatgccttctacctgttgtaccttttgaacaaagcaagtgtgaaagcatgtaatttgaattagggcaggtaataaagcttctgctaatttacgatgacactgcacagcttctaagtcttcttcatggtttacctgtgccttaagctaagtgtgtttcgattaattcttgtatgtaattgagtttggttcaaagtcaaacgtgagggtaattaactccagaacatgatcaaaatattttttagccatcgacaaactcattagtgagaaaggtcttttttttgtttgtttgagacagagtcccagtctgtcacccaggctggagtgcagtggtgccatcttggctcactgcaacctctgcctcccaggttcaagtgattctcgtgttgcagcctcctgagtagctgggattacaggagcacaccaccacacctggctaattttttgtatttttagtagagacaggattttgccatgttggccaggctggtcttgaactcttgtcctcaagtgatccaccctcctccgtctccccacagtgctgggattacaggcatgagccaccatgcctggcccaaaaaagatcttttaaataaattttgtatggcctacatcttagcatccctcatcccactccgtttaaaaaatggctatatataagtaattacatcatttaaggtattggtgatggtttgcttaattcgtgaatatcttatgacttttacaatatcatcttatgtcacataggggttgtctagggaggagcagcaaaaagtcaccaccagtgcagagagacatagccgagttcaccaaatgttcctggcttcttggcactcagagtagaactgggatgaaacacttgcaaaggacaactttgaaggcaccaacctaggatgaagccataaataaagactgtcctttggaatggagattctccatcattcagtagcaactgacttcagcctggtatttgtttctcttgaatttccagctcaaaaatataatttgaagtattttgtattagtacatgccagccactgccaccatccctcagaagcatcttacataaggaagaatgtgcaaaataaggatactcaggcttgatacggtcagagaagagcttgagagagtcaacagctgtcagttatgacttaatcttagtccaagtctgagtgacatttcattgcaaaggaaaaactagagagaaatcagtgtaaagatttggtgatgcaaaaatcatctttctttattattttattttatttttaatttttatctatttattattttgagattgggttatgagactgtctaatttttgtatttttggtagagaggggattttgccatgttgcccaggctggtcttgaactcctaggctcgaacgatccgcccacctccaccttccaaagtgctgggattacaggcttgagccactgtgcccggcctaaaaaccatctttcaattcagacttgggtaataaggcattctagaaagtattttcttaaattttatgccttatataaaatgtcgaagaccccagcatttcaatatgctggtatgaagactagaaatgacagattattttgtggtctaaattctttttcctttaagtttggcctgtgctccataaagagacagacataattttggaaattcgctttcttggcactgatgtgtttgctgagtcaagtcttgaatttttagaatgaaaacgaactattgccatgagttgaaagttgggcaggaagaacatttcaatcatttttgggttaggaagaaaatccaagttgacatttctcatggatatttactgtttttttttttttaaatagctatttcccttttaatctttgcaacataatatgaatgatttgaataagtttttgcagctgtacaaaaataaccctgcctatggtactatgttaatttgttactggctttgcaatttagaagatttgattatttcaaactccacagcctctatgatgtcctccaatgatccctgccttcttgtatttacaccttcgtgcagtctgttcccaggtctgtgagaccaatagcctaatgatggcgtttcacttccaggataaggttataaaaatctgccttctgtcctagtcatcctttctatttccctctctcttggatctcttgctctgggagaagctatgctgtgagcagtgctgtggagaggcgcacacagtgaggaactgaagccccctgctgacagccatgcgaatgagcttggaagagtatcctttggaccagtcaagctgtagatgactgcagccccactaacactgcagaggtgtgagagatgttgagccagaaccacccagctaggccagtcttggattcctgacccacagaaactgtcagataataaatgcttattgtttgaagccaataagactggggttacttgttacacagcaataaataactgatacaaactg

SEQ ID NO: 106720 - DNA, 1051 bp, Homo sapiens
tggattgcaagccatcaagtttatctacctatcgactctttgcagaggtgtcacatggttcccagtttctgatcctgacctgcattctgaaaacaaaatgaggaacaaagaaagagaaaggatattcatttctttgggtacttcaaggttctaatgaatgaaacagaaatgctgccattaaaattccctgaagcaagacaacagtgagttttactagcacatcaccaaagaagttaatcaggtttccttggggttgctgggctacgttgctttgaagaaaaatagcacttccctgaagagtaagaatagctgaaaccacatgtcccagcgagctttcagccaactgctcctgaaggaaacggaatttaactgcgagaatggtttttgttggatgacgttttgattaagcaacaggctacttttccaccccgggaatgtgatcatttgaagatagatatattatgacccaaatagaagctggagtagaaggaagggcttgtaggctgaggttatgccttatttggtaaattactataagaaaattgaactgggtgagtttaatattcagtccttattttctgttccagacatcttgatatctctgtgagtagctgtggggggtggcggggggggggaagaaaagaaaaaaactttggctgttctttctaacttgacttctttttccagaattttaaaaaaacgtgagtgagatggatagttgggctcagtgaatgaaggaagagatgctttctgagtcctcgaaattattgctttgtgaatgaagaaattaagagctgagccaggcgtggtggctcacacctgtaatcccagcactttggtaggctgaggagggcagatcacttgaggtcaggagtttgagaccagcctggccaacatgatgagaccccgtctgtactaaaaatacaaaattaactgggcgtggtggcgcatgcctgtaatcccagctactcaggacgcaaggctggaaaattgcttgaacctgggaggcggaggttgcagtgagctgagattgcaccattgcactccagcc

SEQ ID NO: 106721 - DNA, 2279 bp, Homo sapiens
gagctggatttactctaacaagtgcctgcacctcttggtcgagttccctgagcatcggccctctcctgtggctttgggaagaggtcttgacttaggaagaaggcttccatgatcctctcagcctgagactggcctggggttttaattcccaccctctgcttatctcttggccgacatttgggcatgccacatgccccttctttggtgcaaggtctatcatctgcaaggtgcattttacagaaaaaaaggcagagtcctgctcttgacctttctccttctcaccagggaaatgcttcatgccatccaccctgagcagaagtccagagacacctgggcaacttccatggtgcatttaaaaagggaagaaatgccagaatacagctgtaaaaatgatggtatattttaaatatcaatacctaataaatcaatgcttttaatgcctacataatatgccacgtggagtgactgccattacgagacaattatggtctcataaaaaatattaattatcagtgtcttgtattgtagagtgtgtggtctggtaatagggctcatgtgtaacatcgtaatgattgtattgtcatttcagtcaccattatagtgactgtatatctaagctcagtaggcaccagtgccaaaaatctacatttgaagccctttgtgactgatgcatcccaggtactaaaagctctcatgagaggtcctgagagcacaagtcctggcttacttcaaaaaatatatatttttgtttgtttgtttcttaacagtaaggaaaatgattttttatttttttatttttctaaagacaggctctccctccgtcacctaggctacagtacagtggcacaatcatagctcactgcaacctccaactcctgggctcaagggatccttctgcagcagccttttgaacagctgggaccacaggctcatgctgccatgcccaggttatttttgtttttgttgaaatggggtcttgctttgttgcccaggctgggaaaatgaatattttaatgcaaggggtttctcagaatagaggaaaagttcaagacacatcataaagtaaaacttgtttgccttctgacataaatatttgcttttctttatatgtgcatataatttatttctctggtcttgccttctgcttcagtagttactgatttatgaaccaatgtttagtagtgctctcctttgaagctggggaaaattaagtgaagttcttttatgtgaataatgtggagtacaatgagactctccgaggcctctctgtgaaatgactttaaaaccactggtgagcatttcaactctggacttttctgtcttttaaaattcactcacatagtttggatgaaaagaatttcaacagacaatgagatttagatagcctgattctaagtttcggtgctcttctccaaatacagtttctttttaggtgaatattatgttttaaaattttttaaaaatgaaattagagtttgatagcagtcttttaaataagtcatttccccacccctccttatctctctctccctcccaattattctgtcacttattcactgatgccctggctaacacagtcactcagcactcctcctagagagaacattagttgacaatggccgcttccagggtgggtaactttgccaaattacttaacttctttatgtttcagttttttatatttgtaaaatgggaatagtgatggtactcaccccataaggtgattataatagtacagtttataagttggtgggaggtttgaatgagttaatgcatctaaagtacttgaagtcgtacctagcacccaggaagtactcatgttgtcatattttactcatcaaatagtaattgagtgccttcttaaaaggtagtgtaggccgggcacaatggctcatgcctgtaattcccaacactttgggaggctaaggcgggtggatcacctgaggtcaggagttcaagaccagcttggccaagatggtgaaaccccatctctactaaaaatacaaaaattagccaagcatggtggcaggaacctgtaatcccagctacttgggaggctgaggcaggaaaatcacttgaagccaggaggcagaggttgcagtgagccaagattgtgccattgcactccagcctgcgtgacagagtgagacaccatctaaaaactatataaatagtgtgttgggtactaggaatctggtggttagtagaaagatgcggttttgcattcatggatcctcaaacacaccatttatttattaaaaattctgttgatactggga

SEQ ID NO: 106722 - DNA, 1291 bp, Homo sapiens
agtgttacgatcaccactcactgcagcttcagcctccccagcttaagtgatcctcccacttcagccttactctcgggagtagctgggaccacaggcatgcaccaccatgccttgctaatttttttttctttttttttttttttttagagataggagtctcactatgttgcccagggtggtcttgaacttctgggcccaagtgattctccagcctcaacgtcccaaagtgttaggatttacaggtgtgaaccaccatgcctggcacaaaataccatttcattctcagattaattttgtaccatggagacaaggggaagttttctcttttctttgtagatgaagcaacttgaggacagatatttggaggtcttgtctgaggttcatttaaaatggggcagaggccccaggccttctaactctccatccagttctctgtagtagcccttcctaccccagctttggtactgatgtcaaccccagtgtttcctcatttactgagcatgtgtgactttcaaaaggctctgttactctcttgatttctgtgaggagcgagatagccatgactttaccctgaccatgtgactggaaacatactgaatattattggatggagaagttcacagtgtttcacaaacacatgacaagttattgttaacattatatgaatgggaggtggcaggtcaagtaaggccagagaagcattcaagctgacaccttgttcatgaatttaatctcttatgagaacagctagaatgatcatagtggccagtttggtagcctgatcattttggtcatatgcagaaatgttctcaatggactttgagagttagaattagttggtatacaggctcctccttggaaatgtacacaccaagcaattgagaaaagctggaaatgcacctgtctcaagtctcattgaaaattcctttaggtatcatactccaaaagattacatggaattgaacatttttgaaataaggacaggactaatagactttcttaagtggaaatctctcgtctttttttcccctggtactttgaaaacttaaaataaacatcgtttccagtatttgatggtttatttactaactacctgtttggaggaaatgtcatattgtctcagaacaatggaagctctgctcacaagagagcaaggagagggggtggttttcagtagtcagttgggatagacccagtttggctcacattttttgcatctctgagttcagatgaaaaggatagtgagtggcactgcagaaaacccaagaaaactggaaatagaaaatggcaa

SEQ ID NO: 106723 - DNA, 1824 bp, Homo sapiens
ccatccttgataaatgacattgtttttttctgttgatgtagtcccaattttacccatattaacttttaaaaaaaaagattgtcttatcttagtagaaatatctaagctcagctgaagaaatagattctataaatacccttacaacctaaacgctaattttatccctagatgagttgagatgtgcacctgaatttgtctcttgcatctgaatcagggccaattgctaagctctattaacagaagtatgtaattaagataaagggcaggagcaggacagccagtcctaaaattagctcttgccttgatgttccccaggtgcaagtgcacacagccttggtcctttcattctggatgcacccgatttccttttcaagatgtgtgcaggccttaccaggatttccaaaagcttggttctggctcaggttgggaagctgagattgttttctcctgtgggttgttattcgtgtttgaaatgtcgtctggcaccttagaagctttttgcgtaaatattctttaagataggtgtcacattatttatgtttagcttgtgatagtccaacggtcttcttacaagctgtttctggactggtactttgagaataatgtaatttttatcagctgtccattctttacaatgaaggtaagtagtgcaattaaggaagggattttttttttttttttttgagacagagtctaactctgttgcccaggctggagtacagtggcatgatctcagttcactgtaacctccacttcccaggttcaagtgattttcctgcctcagtttccagagtagctgggactacaggtatacgccaccatgttcggctaaatttttacatttttagtagagacggggttttgccatgttggccagactggtctcgaactcctgacctcaagtgatccgcctcgatctcccaaagtgctgggattacaggcgtgagctaccgcgcctggcctaaagaagggattttaagcctacctgtcaagggataccagtatagctacacatttcactcatgtgactttgggagggaagagcttgaactctgctattcctaatgtgcatccttgggcaaggcatgcaccttgtcatgtgctctagtatcctagatgaaatggagatggcatcagtaccgacccctcagggttggtataaggattaaatcaaagacataacagacatttgtaagtcaacgaacacagtgcttggcatatgaagctaagatgtaggtaactgcacattagaggtgggaggccagggtaggaactagggtgaggcaggcgagccacttaccttgggtgcaaaatttaagaggcaccaaaaccctcaagaattaagaattaatgcaatactttcacttcttccttcctgcctgcctgcttttctttcctttcttttttaaggcagagtcttactctgtcacccaggctggagtgcaatggcatgatccccacacactgcaacctctgcctcctgggcccaagcaattcgggactacaggtgagtaccaccatgcccagctaattttgcattttttgtagggatggggtttccccacattgcccaggctagtctcaaactcttgggctcaagcaatctgcctgccttggcctcccaatgtattgagattacagtcatgagccactgctcccgactacagtacttttaaaaataaaaattagtgtggtaaagtccatcacgaattacatatcaaaactgtaaataaattcaaggactgcccctgcacttgcatgcccctgcctcctagtgttataaggacaaaataagaccatgaatctgaaaacgggttgaagata

SEQ ID NO: 106724 - DNA, 1397 bp, Homo sapiens
caaattcatctcacgtaccactcctggctcatgtactgtttatactaatctttgacctatagcagtggttctccacagtagcattatattagactcatgtgggaagatataaaaaaataccaatgcctcatgcttcactgattaaatcaaaatttatgggaatggagtacagaacttctaaaaagttcattggacaagtctagcgtgcagccagaatttaaaaacactgagctgagaatgtggtcaaatatccttcccatcttcactctctacctgtttgaatgtatgttttacattatttctatataaatcctcttaaaatcttccatgtttgaggcttactggttatataaaggcagtgacagtgctttgaatagtgtctgcataggaagcattttaaatgtgtaattttgtgatggagcgttggtataaaactgagcaaacctaggttcttggctctgtccttcgacttattaacttgaggattacaggcagttgtctgcatctttctgagccttagttaagtcagctgtcagatggggagactaatccttaccaggcatatctcccagaattgagtaagggtcgaatgagaaaatatatttttaaaatggtctgttaactgtcttcagggaatcagggcataaaaatattgttaataagtcagtgggtgggggtggtgataaaaaatagaataggaaaagtttgaggacaaaatatttcatattaggtgtgataattcttaaaaatgagttctttctaattataatgatagaagctgtgccatgtttttgctcttggactgttgattgtcctcagaatgagacagctgggctcatcttagtgcttgaactgaacaacagctgctaattacaactcaaggaaaaactacaggctgatctgattatggtttctagaggttagactccctttcactgtatctcattgtgttctttgttgtgtttctgctatggtaggttaactctggttttgccctcatttgtaggtagattcctggaagtggcacatctctacgttgttagtagaaatcttgccttgcagccgctgatggctcatctggagtgatgtgactgaggagagacctccaccctcccaatctgccactgtacttaggggtattgtctgcataacccccttcactggggccagtcgccaacattgtcaacagcacagttatgcctgctttaactttcacctcaaaaatagctgaccactctggcttctgtgttgaatgaaaaaaaataggatgtcaccaacacaaatggatatcctgaatttcgggacaagtgtagatttgagtaacttgtaggggtccctgaatgtttcctggtacttactgactttgttttcatacttgattggaatgtcttgagccc

SEQ ID NO: 106725 - DNA, 1053 bp, Homo sapiens
ttttcccaaaatatgatttaccattatttatttctgtatctgtatatataccacctaagttcttctgcacaatggcctatatatttgaagatgactaagtttttatagtcagcattctctttctgagcaggtccagtttacaacacttggcctttaggaatgttacgttatactgggttcaggctcatcatagttactctgtgctaagaggcaaaccggctcaaaggaacatcatgccatagcaggaactgaaatctgaagaatgaatcttgaagcatgtgcttgagaatggcctgacagctatgctcatctggtgttagaagcttcggctaaacaaggagagtctcccttaccagagggtcattctttggtaggcggtactcatcctaagagacttgtaaatcttccgttagggaacaagcctgagcggttgatttagatgttggtcttccctcagtaacctccctaatctttaacttttccatttttgccagtggtggaatgctgaccgagaacctgcctggtatttatagtacttggagcaagatactgaacttgagttcatgatcccgcaccttgccgtggtgacttgtattacctctttctttccctcccctgcctcacgttaatctcactcaggtcttgccagctcttcctcctgtgtctgctacttcctctttatttcctcacaagataatcctcttcattatcatcatcatcatcatcagatctctagactttagtcattcttgaactactttcttaatttcttcatatctgtgtaccacctgaaccagttttatttatatttttctttcaatcaaattacttcttaaactttagtctgtaaaaactgtaaaatcataggttttatatgacagctaactttccccaaatattcagtaaaatgaacacaacaactgtataacattaaaaaattatgtctgggtcaggtgcagtggctcatgcctgttaatcccagcactttgggaagctgaggtgggcgggtcacttgaggccaggagttcgagaccagcctggccaatgtggcaa

SEQ ID NO: 106726 - DNA, 1681 bp, Homo sapiens
tggtaaaaccatgtaaagcaaaaaaaagaaaatgagtaatctgtcatttataagcagctccatgtggcctgctgtgatggctctcagttaaatgggatgctcttagacatttcatttgcatatgaagcatctggaaataaagctgtaatgaagccaggtgcatgtagtcccagcactttgggaggctgaggcaagaggatcgcttgagcacaggagttctagaccaccctgggcaatatagtgagaccctgcctctactaaaaataattaaaaaaaacatagccaggcatgatggcgtgtgcctgtagtcccatctactcaggaggctgaggcgggaggatcttttgacccaggagattgaggctgcagtgagccatgatcatgccacttcactccagcctaggtgagagagtgaaaccctacaataacaacaacaacaataaaaataaagccgaaatgatgcccagattcttggaaagagaaaggaatttctgataaagtctctgccccttgttcccttgttgtctttcctggatctggaaggcgttggtggtattgagggttttattactcaaaatatggtccatgtgccaactagcagctttcacatctcccgagagcttgttaaatacagaattttggttgccctcccagatgtattagatgataatctgcattttaacaagatccccttggaagggtccttggaaagctttggttagacagtcctggtattgaagggaagcagagtgttggaaatcaagggaaaggtactgctttctggcaggcaagacatagctaccacagttcactgttttttgctcaggttttcttcaatgcaaactgcactcagtccatgttatttcaccacagacaataaaggctagtactcaaggatctggaggagtagaggaaatacttgtactaaataatctatggaaggactgtctttgtcaagatataggtgagtcactgtttccttagatgtgcaactgtgtgggttattcaagaaagggagagctgacatttatgaagtgcctattatatgccagttagtgtatgaggtaccttctgtgcattttttcatctgattctcctacaacttcttgaggatgttatggttttgtgaggttaacttacccatgaccaaactccgactttctctggcacccaaacccttccatgccatcatcttgcatgcttgtttctcatggcattcggatttatgtatttttatttttatttatttattttgagatggagttctgctcttgtcacccaggctggagtgcagtggtgcgatctcggctcactgcaacctctgcctcctgggttcaggcaattctcctgcctcagcctcccgagtagctggcattacaggtgcctgctgtcatgcccagctaacttttgtatttttagtagagatggggtttcaccatgttggccaggctggtctcaaactcctgacctcaggtgatccacccacctcggcctctcaaagtgctgggattacaatcacgagccaccgtgcctggcctggatttattttttaaactgataccaccgtgtgatttagggaagagtctaagcaagaaagatatctagatcaaaactcatatttggtcagtcagagcaaagtcttaaaatgttgtagtgtttgttaagtattagaatttcattg

SEQ ID NO: 106727 - DNA, 1084 bp, Homo sapiens
tgtcattttctctccttccctgacaatagtttgaataggatttgaatttaccatttggggcctcgtgatacatttaggatctgatctctttctcaaaaaaaaaaccctttaagggagccgtatatccttatggggaaatggatgaaaaggatgtgtcctcttgtctgtatcacctctactctttgaaaaatatttaaatttcttattaacttgagctttcagtgggattgaattgacctgtcttattatttcttggctctcctgcattgggacggtgtgagccactcacctactaatgactcattgtaattattggctattgctgaactcctctggacagcaccattgtgtaacaagtccatctctagaccatattgcatttgttatttatgtttttgcttatctcagcacctttatggaaatgtgtttcttgttgtctgtcttcaccagggagaagccaaggctgagtgactcatcagaggatcacggttccttccgagttttctagagcctgcagtatgggcaagagttgagggtcagtggggaacagacaatgtttttgtccccgagaaacttatatgtggatggaggagctttctgtctaagaactccatgcccctcaggtttagcacctgaccacttaaccctttgtttctttcccatggttaagggaaacaatgagttaatttcctctctgcaaatgactggtctttgtggaggacagaggaaagaggaatggagccagtgattgaagtttgttcattcattgatgtgtgtaagttacagtcagctgttggctagatagcctcagtgaaacccacttcatgtgcctagagagtcccctcctgttgaaggtacacagggcttgtgcaccactttaagagtgtggtagaagtgatgatactgtgattccagctaagcaatttgagccagcacccagctgtctgagccattctagctgggaccccagatggttcaccccaacagatagctcagggagctgagacagaagatactgcattccctgttcacattctaaatgcacagagttgtaagagagatgaaatggtggttggttgttcta

SEQ ID NO: 106728 - DNA, 1680 bp, Homo sapiens
acacaaaagcaatagttgaacaagagaattttagatggtgggtaggttgacttggtacagaactccatgaaatttcatcatggatatgatattttctttttgagacggagtcttgctctgtcgcccaggctggagtgcagtggcgcgatctcggctcactgcaacctccgcctcccaggttcatgccattctcctgcctcagcctcccgagtagctgggactacaggcacccgctaccacgcctggctaattttttgtatatttagtagagatggggtttcaccatgttggccaggaaggtcttgatctcttgacctcgtgatccacctgcctcagcctcccaaagtgctgggattacaggcgtgagccaccgcgcctggctgatattatttttactgagttctgtgaggccgatattcttttctttgtagcatgacattgcaatcattttataaatcttggcaaatctgaattttggtctgtggataagttggtggaggttttagtggtttggatcttgtataaggtcttgcacagtgctgctggtggtcagggtatgtgaggaggtgctgccagaccacttccactgaggtagggtgggtacatagatgcatttttaagtactccctacaacaaaaaccattccctggggaatgtaaagtgctggaggcaaaataatctgcagaagaaaatctaaagaaccatatatatcccaattaaatttctgcctctgctaagcaaattgagaaaatcagcagtctggttccttttcagctgtgagaaaattgggaatagaatacctgacaaggtgtgtgttggagatgacgtcattcgtgtatgacaaccacaagagttgcttgttaagaagcaagtatgctagtcatttgatgacttaatcttttatcttggccgcccggggccttcagttcagggtgttgatttcatcagaactaacctagaaagaatgatatgaaacttcgtgagtgcccggccctccgatggtcccagctgtcccagcacaagctggagtgtctattgctttacctggcagagagctccgggctcagaacaggaaatgtgggagttctccacccaactttgacagacgggagtggaaaggagtgaagcgagcggaagtctgacttcatttttggttttcagactgtcagactggaagggtaactttaagtgggggctcgcttccccccccccccccttagtttttcatttatagttatcactaaatatattccaatgatggaaaattacggctttttacttgccatttggcagctgtgcctgtatctcttttttagtttttggtgtgtattttaaatttagttaggattgaatggggtggaattatgagatttaaaaaaaaatgaagtgttgcactgttaatttagggttaggtgcagtataaaaagacaagttataatagtagctggcaattattgagagcttattgtgttctgtgttgcaggtgaagaccttgaaatacatggtatcattttttttatcctccttaacattctaggaggtaggtgctgtaattattttcatattctagatgaggaaactgaggctcagagaagttcaatagttgcccagttgcgaagttcagtagtgttacctaactaatgaatggtgggtcgtagattccaatttaatttgtaggtt

SEQ ID NO: 106729 - DNA, 1050 bp, Homo sapiens
atgtgccttaaaagttcatagcctcatttttatgagcttcaaggctttttgcattagatgaaaggaatagtaccctgtaaaaattggtatcttatgggcttgaagctttcaccagcattttaggaaaggaaagggtaaaaaaaaagaaaaaccccccaaaaaaaccatcaaatggtttcagagtataatctacaaatgggataagtgatcattatcttttggctctagtcaaataaggaaggcctaacagattagtcttggtctcttaaatcttaacctctaaatatgtaatttttattaaaggagtatattctagagtaaaaactaggcttaatacttgatttgttgcagaattgtcacaattaatgggtttttgcaagtgctaacaagttgagtcttttcatttgttacttcagcaaatgtttattgagagcttgctgtatcactcatttcttggcacgaaaaagctatgtaacaaactaccctaaactgtgtggcattcagcatgaagtattctcacactcaggggtctgcaagttgactgggaaactgtgctgtatgtgtctcattctgcagcctggtcctgggactgacatgacacactgtcatttcagcacatacccagagcaagtcagggaagtatagtcttcccatgaaggctgggggaggaggagggagagaatatttgccaaaaaaaataacggaatccaccacaactactgtttgttttttttttttttttcccgagacagagtctagctctgtcgcccaggctggagtgcaatggcgcaatcttggctcactgcaacctctgcctcccgggttcaagcgtttctccagcctcatcctcctgagtagctggggtttccccctgttggtcaggctggtcttgaactcctgacctcaagtgatacacccaccttggcctctcaaactgctgggattacaggcaggagccaccacacccagccaacaactactattttgccttgtcttgtgagactagagttggcgaacagtccttgctctcatgggtcttaggttcctggt

SEQ ID NO: 106730 - DNA, 3307 bp, Homo sapiens
cagcatcaagtcatttcagaaaagacagagatcttcaccaccaccccccaccccatgaaatgtccctaattcctacctaagagctagatccttacaaataaaattggaaatggtagtattgtgttctgtatgtttgcattaaaaggaaacaaaatgtcaagtgattaaaattggtacctcagggaattatttattatagaaacatttaatgcagtgagatctcccctccccatccagacgtgtttttttcttttctgcaaatttgcccagtgtttctgaaaatgcgaatttaaaatgccttatttctaagctaaatattgaagttaatccttacctgaggagaactaatgcaggcccctttattgccaagagatttttgtgcttggcatttgtttttgtttatgagactcaatctatgaaattgaggcaggaagcctgtcaagtggcttcagaaggtctgagcacactggggcttataagacttgaggcgggaagtggttgatcaaacctgagcttgctttgggaacaagtactgaggcaaggggaaggtttggaccttgctagtgatcatataggatcacttttgtttaatatatgtgagagctttcagcttccgtgtttttctaaaggctttaacagcttggcctgtggacaagcaattatttaattaaaattggcacagatgtccaaaattttccattgttcttcagactacttgttttttgttaggtagacacattgttatgaactggacaggaagcaaaattggaagggcaggtaggagcagctgttaaggccacggacatgtaagtttctgcattatatagggttggggtctgcttatttgtcatgtgattttaagccatgttatgtaacctgtctgagcctcagtttccccctgtataaaacagggataattatcggacctgcctcctccagttgtgaggattcagagggatcttgtctgtcaagtgtttacattttagatttttattgagtcctgtgaggctgatactcttttctttctagcatgacattgcagtcgttttataaatcttggcatatctgaactttggtctgtggataagttggtggaggttttagtggtttggatctagcataatcataataatttttagatattatatatcttttttgaatattcaaagtttattttaaaattttctttttgaaaacctcactgaggtgagttctttactcctgggaggtcttcatcccccttcacctattccatcctaatcgaaccaattcctacttgttcttcaagactgagctcaaataccatggccttgagatcctccacccccaaatacttaggggccttctctgggcaccctgaatttgtttcttctaactacattctattattttctaaagacctttctgtctcccctatttgatagcaggtcccttgaagagaataatttcatcttttccattttgctatgtatctccagcaccaggacaagacatctttataatatcttaatacatgccgactgcaacttttggagcttcaatttcctaattgttcactgggtcattgggatgactaaatgaaataatggctgtgaagcactttagacagggcctggcctgccatgggttttcattaaaattggtgggctgagaggataataattgctgcccttctgtaaaagcctgatatgaaaggtttagcctgtgatgcaggatgttgccctgccatggacaggaagtaaacacccattaactgcccatgttgggccaagccccttgtgctgagtcctgccccaccatgggggctgagcagagctctctggctcacctgcttcctggttgaaatactccagtgtggaatacctttcatcatgtctggtgcctttggacagttttagcttttatttcccacaaggcccatcttgtgccattatttacccttggtaagtaatcaaggtagaagcatcacagtatatgtgttgggattatttttgccttagtcgtattaggtttaaaaatttttttttttaaaccctgcgtttatttcaataagaaaatttaattggggtaggaagaaagagatggagaaatagagattaaaacagaacatcacctcccagcctggtttcttgagcccaattggaggccttaaaaggcatctggggaaggaatgtcaagctgttttatcattaaaagggaacaagggctgggcgcggtggcttgagcctgtaatctgggcactttgggaggccgaggcgggcagatcacgaggtcaggagatcgagaccgttctggctaacacggtgaaaccctgtctctactaaaaatacaaaaagaaaattagccgggcatggtagcgggcgcctgtagtcccagctgctcgggaggctgaggcaggagaatggcgtggacccgggaggtggagcttgcaatgagcctagttcgcgccactgcactccagcctgggggacagagcgagactccgtatcaaaaaaaaaaaaaaaaaagcgtggggggaacaagacctgattaaccagagtacattttctcaagatatggttacctagtttaactaaaatgtcaagtttctttacttttaggtagagtaaggttaactctgtgtggttacagtggctctctcgggggcagataggttacttattagttcgaaagcacaattggggaacacagacttctcgaactgggctgtatttgcaaaacatgatgcaactagttcttaatggcaaaacgattgtggagcattggtgtgtcctattgtggcttaaaagggaacttagcaatcagataataaagaaaggaataaaccaacattaataccatgtgtagaaagtgatttgagatggagaaaacgattaacttcccaaggtggtctgaaagtatatgttaaaatagacttgttttattcatggaatatttcaccatatatttgccataaggcctgaagactctgttaggtgcttttcccatttttttcccctcacacttgaggggtaaagaaagatatcggtaggtcataatcatttatacatgtgaaattttgatattgcatatgcttggcacattgaaagtaagcatatcagtaccatagatgaggaagcatattgctcccagattttattgattctttctcatttctgcctgtctttcctctccttatccccctaaattataatttcattgaaaaagggcttcttttcaacacacactggtgcctgtcagggagtgcggggttgtgcggaggagagcatcaggaaaaatagctaatgcatgctgggcttaataccta

SEQ ID NO: 106731 - DNA, 1053 bp, Homo sapiens
gaggttgcagtgagccaagatcacaccattgcattccagtctgggcaacagagtgagacgaggtttcaccatgttgggccaggctggtctcgaactcctaaccttgtgatccacccaccttggcctcccaaagtgttgggattacaggcatgagccaccgtgcatgtcctgcctctcctctttaaccttgaatcaacaagccaaatctccactctccattactctgtggctgaattgcagttgctgtggtgtgtccttgtctccacatggggaggtggtggcgaatggctggtaagaaggagagggaaggagggaagagtttgtattagggtttatggctgcccctgtgactctgctgttcaaggggaaagggctttgtagttttgcaccaactgccctgttcatcttcacagtcttacaggtatcaaagttatctcttcttctttcatatgttcagggcagatggatcaaagcagttcaaagggaagttttgcctaaatacatgactatagatctaatactccctgggactgtgtatatgtgtgtgtatgtagtggttgttgttaattccagctctgtactattaataattctcctgttagtgtcaatcattaggtgcaatttacctgtctggacaaatggcccttactatgcttgttgtacctgaaaataccaggaaggccacctttgaagtgcagtgaatcagaagcactatttttgaaaaataggccaggtgcagtggctcatgcctgtaatcccagcactttgggaggctgaggtgggcagatcacctgaggtcaggagtgcgagaccagcctgaccaacatggagaaaccctgtctctaccaaaaatacaaaaaattagctgcgtgtggtggcgggtgcctgtgatcccagctactcgggaggctcaggcaggagaatccctctaccagggaggtggaggctgcagtgagtcgagatcgcgccactgtactccagcctgggaagagagtgagagtctgtccccaaaaaacaaaaaaagaaaagaaaaatagtctatgtgggacaggt

SEQ ID NO: 106732 - DNA, 2479 bp, Homo sapiens
ctatgattgagctactacattccagactgggtgagagagtgatactgcatctctaataaacaaaacaaaacaaaacaaaacaaaacaaaacaaaaccatgttcttcaaagagaggaccgctaaaccaagaaaaaactgaaacaaaaatttaaaactcataatcccattcccctgttttatttatgtgtctgtgtgttgatatgtttttatgtcatactttctttaaacgacagtattatatgtgacatcattagaaacctccttaaagttctggtaccataggatgatcagagtctaaacagatgaaaaagctttacttcagcattgcctagggtttgacatatgctgaaaataaaccattctagtttgtcttactcatatgtatatgtatagacacatatacatacccatacacacatatatacatatatacctacacataaacacatatacatgtatacctatatgtgtgtatatatgtgtcacaagtgaaaagttacttgtttgactttaggagaagcttttaagactttaacatttgaaataaaatgctgggcaactttctgtctttagaaggtgggatttcattttttgtcgtatccaatactggcagtaatagtttttcagcctctcatgagttaattcacatttgctgacattattcatatagcagccagccacacaagtgcttccatactggttgctggttcctgtctggtggacagctaaatcctcatgagcaatagacaataagggctaaatgaatgtgatagatttctgtttacttggctgtgtctggtagtggtaaagtcacaaatttcagtgatgggaagaattgagttgtcacttaacaaattactgatctctctaaatataattttttatcagctcaacataacccaagtaaatccagagttttgaagtgactgactcgaggcccagtgtgtcattcaaagaaatccagtccaggaaccaaccctagaagtgattgcaatcttattggaagtcaggtgattcccttttgcagcccttcctaagtgccctttccctctctgtttatttgtcatcattccatctctagattcctggtagatccatgggagatgcatggaagatctctttgtggtatgtttcttgtcctctaccaaatctctccctggcatggtgctgccattcctttttgtgtcatcttctttccttgtctttgtccttcagctattttcttctctccctttgatttccccccttccactcacacacactgatggcctcaatatgtatagtaagacacaaggggaaggcgtgggagatttaggaatggggttagtgctgagtgggaagtgctaaagattttcttagtgggtgaggagaggcaaagaggctgtgaatattgattttgaacagctgaggatgaggctgttacttataagatgaggatattatcctgatgggaatggtgttcctgcttagtgatgtaaccagaagtctgaaaggtgggcctattttgtccttaaaacataggaagagcctgtagtatcatttttaggttgagacaaaagaaaatcaagatatgggccactcattgcagatgatcttctctgcctccccatctcctgcttggcccaaaagcagcctgctgggagatgcagcattattgaagactgtggtctcccttgcaacacattcaaagatctgtaggtcacattgattcttagttaaacctaacccacagctttgcatatgggactgctttaaaacagctgccctctgtgatccattaaaaataaaaaagccatttaacatggcaaattcatagtttcatagattttatcttgatgtcatctgaactttggaattataattcagcagatgttttaatactcttgtacattaaatcagatgtcaatgggatacagaaggaaccaagctgcaataaaacagcaaaggtatatacaataatatatgttgaggacccttctaattgttgccaggagtagtgtttgtaatcatggcttcaaaggcaccttggtgggcttctgtggctaaaaccccattcttctagctctctcctgtgatcttttgcctgtcagagtttgctttaaatctgcgatagtcgaagatgcctgagactcagaatttttggacttaccttgttcatgggatttcatctatcagtggtttgtctgcaatggcagattgcatttttttcccaaagttggtggcaaaaaatagctcccatgccagatacaatgtgaacttgactgtgcttccatgggagtggggaaggtgatgtctatataccatccttttaaacctggacagacctttgtgattatctggaccaacagagtatgacagaaagtcacaccatgtgactcttgaggcaggaccgtaaaaatgccatgtgcttctgccttgctatcttgggatgcttgttcctggatcccagccaccatgctatgaggaagcccagactaag

SEQ ID NO: 106733 - DNA, 1030 bp, Homo sapiens
tgcttaaagcctctcagggcttctctctgttcttaggatcaaagtatttagagctacaagagccctcatggtctggcccctgccccccggccagcttcattgtacatgtggtgttctcttgtcgttcctgtaatgtggtatgccatggggtctttgcacaagcctttcctctttggctggacactgttccctgcccccccatactcttcctacttaatatgtagtcatcctgcagatttcaattctaacatcattttctccagggatcctggcctgacagaatctcatcttgtttaatgctctcataagaccacttgtttcccttttgcagcacttgccactcagttgtatctttatgtgcgtttgtggttgtatgggttgtgtctgttccccagaatgcccagctctgagctgcgtgagggtcaagggcattgctgtgcctgccaggtatagtgcctacatgtggtgggtgctcatgttttagagactaaatggaggaggagatgaggaaaagattgaaatctctcggttcaccagatggtgtagggcccagcattgtaaattcacacgttgactgtgcttgtgaattatctggggatgcaggtcctgattcagtaggcccaggttgggcatctctaacaaactcccacgtgatgctgatgctggtcctatgaactatactaaatagtaagaatctatggagccaggctgggcatggtggctcacacctatgatcccagcactttgggaggctgaggcaggctgatcacctggagtcaggatttcaagactagcgtggccaacatggtggaaccccatctgtactaaaaatacacaaattagctgggcatggtggcacatgcctgtagtcccagctacttgggaggctgaagcaagagaatcgcttgaacctgggaggcggaggttgcagtgagccgagatcaggccactgtattccaaccagggtgacagagtgagactctatgtccaaaaaaaaaaaaaaaaaaaaaatctatggagccagataagc

SEQ ID NO: 106734 - DNA, 1062 bp, Homo sapiens
ttgaaggaattgggctggaggagaagttaggctgtgaagtcgtctcaaccaaggcccagccgacctgcaggaagctctgacattgagatggttcttcagtattgtcctgggttgggatgatagggcaaggcttgtataccctcaagtcaacaaggattggaggcggctgttctgggaaggctatgtgacctcagggaaggtgactctctgcagccaacacaagtcttggagggggatcctggaggcgggtggcatagtacagcatagtgttcactgcatgtgggcatatgacataggggtgtatgtttgtgtgtgtgtaattggcttaataagcaccaccttcttcagtaacatgaccaagaacacacatctgggaagtgggtgtgcttggatttgagctcatgtttgactagctttcaaacctatcttttcgtcgctctaggactgttgcaacgtttgttgtcgagaaaagaatacttgggccgttccctttcattttccctttggcgcatttatgtgtgctgccatgtggggacacccttgaagttagctgaattggcttcctctggtatctccaaccttttgtcacagagagttgaaaggaaaggtaaattcttttgtcctaaatgaatcatcagctggaagaaaagtctgaactctagccctctattatattccccagccagggatgactttgggcaaattggtgtccctccagttccctgggaaggcacttgactcaacaggcctctttccatttaaataccacaggtaacacttggcttcctctgagaaagctttcaagtcctgcccctttgcttacagctggctggcattctgtgtacccactacggcactaggatgagaccggccataaaatatttgctctatgcttttatcactgcctggaaatcctgagggcaaaggtgctttgtaaacaccaagttggtagtgagtggtgtgcagaaaatttggaaataaacacagttcagttcatgtaggggttatgggacttctccaaataccacaaactggaaattctgaaaagaaagttagatttta

SEQ ID NO: 106735 - DNA, 1050 bp, Homo sapiens
gctcactgcaacctctgccacctgggtacaagtgattctcctgcctcagcctcctaagtagctgggattacaggcatgtgccaccatgcctggctaattttgtatttttagtagagatggggtttctccatgttggtcaggctggtctcaaactcctgacctcaggtaatccacccgcctcggcctcccaaagtgctgggattgcaggcgtgagccgctgtgcccagccagaattgaagttcttctttgggaaaacagcacacctttttaaaaaatttaaaactgtgaccctccccacccctgggttcctcaaacataaatttagacacaataggagttaaaatgattaaatgagctacatgcaaactattgacctagagtgggcttcagagttggctaggttcctcttttctttgcttcccagtaaaaccctagaggaaatggggatgggtgggaaagagctgcagttaaaaaatagcagtgattcagatttaccggacattacaggggcacttctgatgtgccaggcactgtgctagatgatttcacatctgtccccttatttattcttttttttttttttttgagatggagtctcaccctattgcccaggctggagtgcagtagcacgatcttggcttactgcagcctctgcttcccaggttcaagttgttctcctgcctcagcctcccaagtagctgggattacagatgtgtaccaccatacccagctaatttttgtatttttagtagagatggggtttcgccatgttggccaggctggtctcaaactcctggtctcaagtgatccactcgcctcaggctcccaaatggttgtctgtttttatctctcatccatttctacctctgcttttctgaaattagctagttattactgagtcttaatattttttttttgtttcaaggtaagactggtgatatggaacttttaatactacctcttctcatatttatatttataggaaaaacttggaatgaatgtttactgcataaagtatagtttgtattattcatgttgagtggatcatgg

SEQ ID NO: 106736 - DNA, 1422 bp, Homo sapiens
ggtggaatgttattctaagtggaggcaacagtgggagcaaaggcctggaggcaggaaaattccaagtgtaccatggacccagagtgtcttaagttaacatttaagaaaatgacggaatgagatagcatgtgtcctttaccagcctggcagaatttcacaagtgtttattaactcttggtcttgaaatgatttgataaggcctctttggagagtattgagaagaacctattaaaaatggtaacattttgacctagcctttctaccactagaaacctattctttggaaatactcaaactcataaaagatatatgtggggctgtgttctctatatagcattgcttgtaaagacaaaaatttcaagttggcttatatgtgttgtgggtggttgaaaaattatatggtatctccctacagtggcttattctgtagtcagttaaaaaagtgaggtggatctctgtcctgacatgtaaacagatgatgatatattaaataaaaaagtaagagacagcatctataggatgatcccattgttatatcacagctactgctgacctggttgggtatgcttgtgtgtgccttaaaaataaaaaaagatctggaacaacaaggatatgttccctgtggctacctctgagaagggtgaccatatgtctcggtttgtttgggaaatatctggtttacacctgttgttctggtataattattaatagtaccctctttcagtgtttggtgaactgctttggatggtgaattatgtgtttaccctaccttcctctgaggattggaattggggcaagagaaatgggaaatgggctgtgacataggtgactcgttggtgtagtttacagcaagcaggtattatttttatgagggaaattgaggaagatggccctgatacattatgtagtggttcactgcggagccaccattgcatggtctttatcaggggagaagttaccttttttcttttcgtcaggtgtatgagtatctccgttttacttaaataagtcttcagtcaaatcattgacgatgttttcattgtctgagaaaagtgggtagcattggccctaacatgctttttcaaatacctagtggggatgtttgcatttctttctttcttttttttttttttttgagacagagtctcactctgttgccctggctggagtgcagtggtgcgatctcagctcactgcaagcctcacgtcctgggttcaagccattctcctgcttcagtctcccgagtagctgggactacaggtgcccgccaccacgaccagctaattttttgtatttttagtagagacggagtttcactgtgttagccaggatggtctcggtctcctgatctcgtgatccgcccaccttggcctcccaaagtgctgggattacaggcttgagccaccgagtctggcctctatc

SEQ ID NO: 106737 - DNA, 1059 bp, Homo sapiens
cctgacctcctccattctgcttttctttcttgctcagttttgcctgactttccctgggtctctccggagcaccacttacccaaagtctccagctccggtgctggggcacatattgccagagtagagccttgccagcaacgtgtcctcgtcgcttctttgcaaagggtgtgtgtattggtcagctgttcttcggtcccgccatcagctttgacccagtcgacccttccacctttctggcttggaggctgtatgctcagtaattatgtgcacaggatttgaatttcatgtagtccgggttcaaatctggtcctgctgcttccttgctatgtggccttgggtacatgtttttacttctgtgaagtagcagtaataagagcacatatcttatatgattgctacagggattcaatgaaatgatgcagtcaactctcggcatggaacacagagcaaaggcaacactgaatgactgatagttattaccatattaattttgtcagttttcctcctttgaatctgatcacttgattctaggcttgtggaggcgctgaatagacttcgtaattgactcaaaacacttctgttttaacactctgggtttttatcttctttcctggcaccactacctcctttgagattttatagagctgaatttgttggaccaaattatatggagcatatttgatagaaacacattctaagtatactgtctttatgtcctcatgttatttcctttcgatttcttgaagtctcaatttagtcaccactctgtaggaagctacaaatgatgatagagcaattaagtgatccctgagtctttagtgttctagaatgattgatgtacagatagaaagagagaaaatgcgtatagacattttccaataaactttatgtcagggtagtttcctggtttggtcaatttttctttctgttgattattccagtgtagatgggataaaaattaagctactagacatttattgcttataaactttttggcatatttaaaaaatatcatctaattgttattttaaggcagtagctatagaatatctagcatat

SEQ ID NO: 106738 - DNA, 1023 bp, Homo sapiens
gagtagacctatacggatgataacaatagtggagcttgatttagtgcctctctactcaggctttgcactgagggccacacgtgcaccatccttcatccttagcacgtgctgtgaagtgtgtgtaccatcctctccagtttagcggtcagaaccctgagccttggaagttgttacttgtctgagattaggtgacagcagattaggtgacagcggtgggtttcctctagcttggtgttcgtcaggaggctgcattgttgcctggtgacaggtggcaggatccccttcagggtgtgatgtaccattgtgtgaattaagggtaggtgaccccctggagtttgatctgaagaaagctgaggccaggcacccttccttgcaccctccgttgggagggagacgttggtgccttggcgatggtttcactgcgagcctggctcattgcagcgcggagcttcccggtttttccatctgcagccgcgccctgcgcgtgttgagacacaagtgcttgcgtcttcccgcactgactaactcctactttctccttggggttcccggcagtgcaacttggcacttcatgaacgtagcaaggttctatgagacttaaacaaaattgtggtaaaatatacgtaacataacataaaattaaccattttaattatacaattaagtggcattaagtatattcaggttattatgcagttattaccaccatccatctccagaactttttcatcttctcctactgtgcctattaccaactccccattcccctttcccctggcccctggtgacctctaaatttctttctctgtgaatttgactactccagatacctcataaaagtgaaatcgtacagtgtttacccttttgcgactggcttatctcaattagtgtaatgtcctcaagattcatccacgctgcagcgtgtcagaatttccttccttctaaagtctgaataatattccattgtgtatgtaccccattttgctcacccttcatctgttgatggagattgggttgtttcca

SEQ ID NO: 106739 - DNA, 1483 bp, Homo sapiens
tacagctcccatttattgatcatttgttacctgagctcttgtcaaactctccacagacactatcttattattattatttttgcaacaactttgcaagtagataaaatttaacccattttagtgatgaagaaaccaagtcttagagaggtgaagtaatttgctttaacttaacagctagtaaactgcaattctaatctggttctaattgcagagcctgtgctgttaaatagtattcaagatcagtggttttcaactgaggtaatgttgcctttccagggaacatttggcaatgtctgaagacagttttgattgttacatctgggaagtgccactggtatatagaggggtaggggtcggggtactgtaaacatcctttaatgcaccagagagcccactgccaacaaagatttatctggcccaaatgccaatagcagcaagattgggaaaccctgccttctagttctcacagaattccccatagattcactcaccatctcctgagctcactttattttcttcttagctctcatcaccatctgaagttagcctgcctattatctgttccactggagtgtaatcacttgagagcaggaatctgatccataatccatgtattctactctccttatggccaggcagtacctggcagctgagcagcataaacatttgtggaatgaatgagtgaatgaatgaaccaatcaagatggcatccttcttggtgtgggtaggtaccttccaattggatatggctcagggaagatacgagaatttaccggaagccttgaacagttctggggaacaatggagacacactgtggcttcccaaagggaagagcgagaggtgatcagacagccagttctcattcttgcaaaacttgacaagcaatgacttgaaagaggaggatgggaggtaagtaatgagaccaacccatgctgtgctgagtgaggtgagagtcagagctcaggtggctgattaagaccccgagcactcagaatgcagaaggctgcaaagagggtcaccagcccatcagcggccaccaaaggctgtaccaagtccacctggaacctagccacaagggatggtgatcatgatccatgtgaggcaagatagtttactggttacagtggtcactggcctattttcaattccttcaccggcccttaccggctgtgtgaccttgatcacttgcttaacctctctgtgcctcagtttctgcatctattaaaaaaaaaatgcctggctctttgtgcctggctggaggccacttagcctagaattttggaatcccagggtttaactcctggcactgaatacccttgttggaaggtagagaatgggatgtcacctctggggtactagagtatggccaaatgctgttaaccaggcagtcagtctttggaagaaaatactctgcttttacatcccctggtggtagcagaaagttacacgtgtgaaaatatgcaggggctgctcctgtgtgtg

SEQ ID NO: 106740 - DNA, 3344 bp, Homo sapiens
ccggtgtttctagtgtagatttttcaggttttcaagagaaccagaagcctgttctttttttttttttttttttttttaatgaactttgccagttttaaagcactggttcaaagttttcttttttttaaaaaaagggtgaaccaaacaaaacacatctgggagccatatttggtcctcagatgacaagcttgcaatgccttgtttatatatttgtctctcacttggtttctctcatacttcatctctccaaaagcagtaattgcattactctttctgtattctcagggcccaggatactgaccaactcacaaaaagggtcaggaaatgtgtgttgaaatgaatagtacattttggaagtggtctactttggcattatagtccatgtaggtttatttgaggcccagctggtgacagctttccaattcaagttatgaagagctggggagagagcatattttgacagctgatcataattcttggaatattttgtcccagggccctggtctgccgggtcttagaactgggtgcaaagtcacatcttgaaattgatgttcacgtgaatttgagttcttagtacaggaatagaatctattctctgccctgaagtgatttgattgtgaaatgtgtagctttaccaacaagaacgaatgaagtttatgtataccatttagggaggttttaaatttggcaggaaagttcctaataatacaacttgtttggacttttctatagataaattgggaccctaacctttaccccaggagtggacagtgtcagaacatgattaacctctaagaccggtagtcatctgtttttcagtgccagcattacatggtagaattttgttttttgttttttgcaaaccagtgtagcccttcttgctttcctgcctgcataatggattgttctgcattgcataattcatgtcgggcaccaggtttgctgcactaggatgaggaaagggattcaggtaattcagatgagaaatttagtcagtgcagttttttttctatcaaggagccaagaaaggtcctctattaaattaaaactataaaattgtcagcaaaagtccaatgcagggttaaaatcttacttggtttggacttgtactgtgtgtcttttctctccttctctagtcccctttccccctccatttccatatcagaatggaacattccaatagactgtctaggaattcaaattttagataggatattctatatgtaatccagaacttctgatgtgagatgcaacttaggagagttttcaagtttagactactgtatgccccgatccacttccttcattgtggtcactgcttttggagcacccagaagtcccctagcttggcgtgaagtttgacttctttctgctactataaaatgctcaaggataatgtggcacaaaaagcttatatttcatggtgtttcaggctgggcgatcccaggttaaatttctgtgctttcgtctttgttaaagagtttagccatgtcacagtgcaaatgcacagttaagttcctccacagtgtatatgaaacctgttttatttcagttaggattagcagagcactctagctgaccctaagtgaactctaggtacatatgtgataaatgcatattgctatatgccactgaggtttcgtgattgttaattatatggcattataatggcaataggtaacagagacaatgagattccatgttcgaatggctgacacgtgtccaaaagctatgggttaatttgggactttgaatcttgagtttaggcaaagatggaaaaaaatccccagtaattgttcattccagtgtaaggacagcagatgagactgttgtttcggatacctacatccaaggaaatgtcctggcttctgcctatttgaatctatgagccacatttattaaccctataaatttatttttcttttaaaattaaaaagagaaaacttttgaagacacaaagtgttatctcaatattgatatattatacatgtgtcattatttataagagaaaaatcgggaaaataggatgcccagcaaaggaaaaattcatgtagctgttgcctaggtatgtctcttcaactccgtgggaaaatactgccatagggaagaaaggccctggctttcttaagcaatgtgaatttgtttctgcgacattttagctaaaaatgtaagctcaagatattctgtgtgaaataaattatcccaaagaaagataattgtgagaagaagccattaatgggaataagacagctggttgtaaggattggaggcttttttttggtggaaggagcttatccatggggtttaatacaacatggtgagtcaccctgttgcctgaattccagaggggaaagagacattcgggaaaaggctgcgggggaaatttgcagtcctgtgcacctgttaccaggcacttatattcacctgatggctgctaacagattgcaggcacagcttcttgaagaaaatcatcaactttgaacacagtaccccacacattggatttgggtgaatggaaagtatatcagaattacctgggagagttttcaagttatagtcaccggggcgtggctttattagtgattctgactcatgtctccctgctcagcacagtcctgatactccacctccaaagagtggtccacagaacagccacttacatagaatcaggcagggtgtttgttaaatatggggattactagaccccatcccagacctacgggatcagaatcctgggggtgtggactctgtgaatccagtgtttaaaggtgctctggctgaatgtggcaagtccagcgtgtgatgctccaggctctaaaatattggcctttcttccagttatctaacaagtgatggtaacagaccccactgtacactcgaatgaacactgattgtgggaggcagtcaagaatagaaagacaaattgagttatttgagctgcaagttcttctagggggcaaatgctaggtgtgtgcatatgtgtttgtggaagttcattttcttgcttcagggttttagtaatttagagggaccttttcctctgtaccatgcttgcccttttaaggcagaaagggaactccggtggaaagacagcattgactaatagaactttctgtgatgatggaatattctttatctacactgtgcaatattttattccctagccacatgtggcaattgtgtacctgtaatgtggctgaggaactgaattttacattgtactgacacacagtttaaatctatctgcttgtggctagtgtctaccgtattgaatggcacagaagacagtgcctccacaaatagtgaggacagttacagatctttggtgtcacatccagctgctc

SEQ ID NO: 106741 - DNA, 2558 bp, Homo sapiens
ttctcctgcctcagcctctcgagtagctgagactacaggcacccgccaccacgcctggctattttttgtatttttagtagagatggggtttcaccgtgttagccaggatgatctcgatctcctgaccttgtgatccgcccgcctcggcctcccaaagtgctgggattacaagtgtgagccaccgcgcccagccggtcctctctttttttaagaaaaagaagaaaaaaaaaagaaaaaagaaagaaatgtgtctaccccatagcctggagccctcatgtcaatgtagagacaccggtcttaggctggcccttttgctgccagagagacatgcttggtgaccccacggaagatagtccgataaataaaaaatggtttcccaaagtgtttcctgccaaaaaacggtgtgctgctatatattttcaagcaattctgcttaattgccgccatctcctcttctctctgatcagtctcaccaacactgtccattctttcctcccgtgtgccctctctctatcctccatgcacttcattatttcaaagagtcacaatggtgccttgtaactatagttttgcccaactgtctcccatactagattatgtgtttcttgaaggcaacatccttattttatggatctttgtagtctctgccctctgtaggtactcaggaatatctgttgaattgaattctttttgagggtaatgagtaggcaaaattaaaaaaaaaattgtctgagatcttgttggctagaaaatccatgtcttatttttaaagcatattaaatatacttagccatatgtctgacttttccgtgatgatttaagatggttgtctgccagttgttgtagcattttgaactatagagaaaaatattgaattaattatgttgaaggtcttagagggcctttattctggccagatgtgtgcatctgcttgcgcctgttgcttatgtaatgtggccgtggaaggtaccaccttggcctggtttaaatagtattttaccacctggattcttggccaagcgttagaatttacatctgatagggagagcatgttcatttcctcctccatctatcagcctgtttaagtctgtgtgagttagttaagaattcagaactcaagatcaagttgttaaaaaaaaaaaagctttctccggtgttgcagcatgtgtttttttaacattttattttataaaaagcgtaggcatctagattttggtttctaatcttttaaaaacttaaatagtatcgtgaccttatatgactatcaatcactatctaaaattggtctgtgattccacagcttatgtattttcctggtgaaatttaaattttttctcatttaaacaatgtatacaatacagaaatatgttaatatggcagaaaaatatgtccgaattgcccgtaatcccaccccagagaaatacatgtgttaacactatttttatccagacgtacacatacacacacacagacacacacacatacacaaacagaaacacaaacatatacttttgaagatgggggggctttttcttatgaaaataagactgtacagtacatgctgtttgggtgggagttttcttcatgcctaacagcatatcatggactttttttgtttgtttgtttttttgtttttttgtttttgagacagagccttacttctctgtcgcctaggctggagtgtagtggcacggtcttggctcacctgtatctcctgggctcaagcgatcttcccatcccagcctactgactagctgggaccacaggtgggtgccaccgtgcccaaataattaatttttttttgggtagagacagggtttcactgtcttgctcaggctggtctcagaatcctgggctcaagcaatccacccaccttggcctcccaaagtgctgggattacaggcgtgggccactgtgcctggccaatcatggactttaaaaaaatactatatgtagatcaagttgactatttcagtgactgcaaaatttatttttggttactttataatataataagctctactttaaggttgaacatttagagtgttttcagttctcttttatataacatattgatgactaccctcatacatacattttagcgaacatcttcagatattttctttggatagctatctagaaataaagctgttggctcacatgaattatttctttttaaggcttttggtatccatcatcattttacccccccagagaatatattaactaatatcccttctggctgtatatcgagagtcctgtaatttttcacttatctcacttgtaaagataataccttctactggaattgtttatttatggtggtcttcacaagtcagaaactgagtagttttttgtttgtttgtttgttttggaaacggagtctcactcttgttgcccaggctggagtgcaatgatgcgatcttggctcactgcaacctccgcctcctgggttcaggcaattctcctgcttcagcctcccgagtagctgggattacaggcatgcaccaccacacccagctaattttgtatttttattagagacagggtttcaccat

SEQ ID NO: 106742 - DNA, 1051 bp, Homo sapiens
gctccccatttgaaagcccttgggagagaagaaagaatctcttgagagatggagattgcagtgtacagttctctggagagcttttcaagtctagaaaaaaaacactcttttttctgcttgattcagatgctgcctttttgaaaggctgagactggattagttcagacaagtaggaaggaagcctccggacctcacggaggtttgagttgcccgagtttctcccacattgtcctcggtgaggaattgcttttaatgattgttcgcaggtcgcaggttgtggtagtgtggagggagggcgagttcttgcgtgttcaggcaggcttttaccatcaacgatgattcttgagaatgggactctgtggtcctctcatcttcctggtaccacgtctgggctcctacatcaggaatggctggggaagcagtggggcttagtggtcataagggtttggagtcagaccgcctgggttcaaatccaggctctcgcacttcccagctgagagaccagggacaggttagcctcccagaacatcagttctcccagttgaaaatgagaatgttacctgtgtcataaagtggttgtaaggattaaatgagataatgtatgtaaaacttgtactaccctgcctggctcttaagtggtgctcattgaagtacctaccctacaagcagctgtgatcttttcttttcttgatctcagctcactgcaacacccacctcctgggctcaagcgatcctcctacctcagcctcctgagtggctgggactgcaggcatgcacccaccacacctggctatttgtttgtttgtagagatggggtttcactacattgctcaggctggtctcgagctcctgggctcaagcgatctgcctgccttggcctcccaaagtgctgggattacaggcatgagccttcgtgcctggccagctgtgatattttcagctgagaaatggaggtacgtcagttagtgcctctgaatcagtggttctcagctgggggcaagtttgttccccaggggacatttggcaacgtctggagccatttttggttgtc

SEQ ID NO: 106743 - DNA, 2104 bp, Homo sapiens
acactgagaataaaggctgtcaaattcgttaagggctgacattcacatcctaaaaaagtaggttactgcatgcctgcctgtctttttgcagctcatatgtgagatctgtaaccttgaaaaatccctagtacacactggtgcattgctagacttctcccctatggaggtcggcatcgatgtagtatttcttatgaattcattttgttgtttcaacagatgtcaaggttggtcctatcatattgactctgctttctagttaagtgtcctgtggagggtctaatgtgttctggatgtcaacttttccgaaggcatgtagcaaaattagaaaatgtaatttgagcagtgtcttttatgattaaatagaaatcttctctttttatggctcagtaattacataatggaataatccattattaatcatttctgtagtctctgtatctgagtgaaagccgaagtccttatagtgacttccaaggctgcccgtgacctgtcctaaggatattacttctctttctctgtcctgcctgctagtgcccacctgatcatcttacaggcttgctatctcttgagcttcaagtctttctgaaatgtcacctgcccagtgaggcctcttgtgagcacattattgaaaaccataactccactgccacgtgtcattccctgttccccctctcagctttattttactccatagtatgtagatcgcttcaccacaagtaaatttcttattttacctctttctctagaatgtaagctctgagatggcaggaatgttgtcttgttctcccacagtatccccagtagcaaaaacagtgcatggtgcctagtacttgcttgggtatttgttaaatgtttacagtcaagtttagaactagaataaatctcttctgaggtcagttacctctgaaaatgtagatatatagaagtccctgaaaatttaggtgactgatgatggatcacattaaagttggttagagtttaacatttacagtcaatggctggggctaaaatagagcttagccgattgatccaggaatattcttaaagtcagtgaacattgctggcctgcttcagttggtcttagtattatgggtttacaagtaagaacatgtgggtccttggtttcttgtcaagaaggggagggaagagtccactggagtctccttggagtcagagataaggtcacatttccaattttaggtttccctgcatggaagaggtccttgactttaaaattaattgagtgtcctgattttcagaggttactttgatttgggaaatgacggtaacaaggggtaccaggtggctgatccaaacaggagagctgaggctactagagtcaccatgaagatcttgtcgagttagggataggtctgtgcacagcatcccttacttagccaagtcattggcctcagtccactttcagtcctgtgtgctccccaccaacatgaatccctagaaggcaactctaggtcaggatttgaatgcacagggcttatctgggaggtgctcccaggaagttccagtagggcaaggaagaggtgagaccagtgagtcaagaaggccaatggagatgctttaaagagcaagtcaccactgtgtgtctaaggcagccccatgctgagtgtgtcatggaactttgcagactctctcacccctaaacagactgagaggttcttctggctgtgtgtatagactttttctgttaccatctccagtgtcatgaagatgagttccataagataattacattctcatggctaaggtatcaaccccaccattactgtggatggaggcatttgtgtgtctgtttaatgggccacagttatgcttcttacaataaggataatctttactcctttatgagacaagactcgaggctctctttatggacaggggcatgatggtgcaattaaaaggcgatcgtgccctgattataagccatgtttcaaaattactgctatatatagtgtcatcaggaccgtagtactgctcataaaatgatccacaaatagcaatttactgatgtgtcatagagtcagattttggacccaaggttggcttgggtgaagaggcaggctttacactttatgagctgggtgtt

SEQ ID NO: 106744 - DNA, 5214 bp, Homo sapiens
tactacatgcccggctctgtgtaaaatactttacttgcactatctcactccgattcacaacagttctaagaacgagttgttcttatttatataccccaaattagagataaggaaactgggattgatactggttaagtgacttgctcaaggtcacacagttgccaaaagcgagggtttgagcccttgctgcagagccttaagtatggaggaggaaggagtggggggatgaccctaccgcactgaaggggctgattcctgaggagggagtggaagcaaattcctctctcagaaatctgtagaggccttttaaaagatgcatttgctggctgctggtgatgtaggtcccttacatctcactttggtacagacaaggggctgtcctcatgtcaacccaatggagaccagctgaggcccttaaagggctcccttgtgcaagcaagtgccatgacgcaggttctccccagtgaaagcaccgaaggaagtcgtgaagttgaacatggtgaaaagttcccatgtgtttccataaggacaggcagcagctggaggaatgtgtcaaaggaagggctgggcctagctggtcctctcttggaaacaggcgtgctccagatgaaatggaggagggggcggccgactcgcctggccttttagcagctttgggagctgaggagctgacacttagctatggaaagctccttgtatttatgacttcattctccactgggatacctcctccaagaagccctccagaatcctgctaggatgcacaaattcttcctcctttgggctcctttaatgtctactttgtggcttttttacttactctgaactctgagttaggtcctcatttccatacaaggtagtgagctcattaaagggagagattgtgcctcattcctggcatacctctccaggttttgcttgaggttcaaaacctttcctggcctgacaatgcgtcttcctcacactggctttcctgtgggtattacataagctaacacgtggaaagtgcacccaacagtgcctgtacatagtaagtgctccataaagattagctatttatgtttgaattgattttagcagctatttatttctgaaactagtttttagtgtcaggaacctggataattatgacttgatagggctgtagagaaaatactgtgtgaaggcataggatgggagcagctgcaggtctcagttcaggaccattttggagaaagggtggaggaaggacaggcaagggtacctgcccaactagggggatgcctcgcagtgtctaacgggtcctgaataggggctggcttgcagtgtttgcagtgtgcaagatgctgcatgggcttgtgtctcttccttccactagttgccaaatttctgggaggcgatgtcccagggctctctcatcatggagtttaggaaggcttggtgagataatcaagtgggtttggaaacagacacctctgagttgaaaggaaactgtagtgtctccaggtgttagctctcttcaccccttgtgcacagattgttcacagcaggggcgagtgtgtgggtatgtttctgtgtgtgtgtgtatatgtatgtatggatggatgtacgtgaatctacttgtaatgggatagaaatatgatactgattgggaaacctgaatggcctggaattcattgcagtctgaaagtgactatttcatgtaataattacacaggcacagttggatcttctgacgtcttcattaccagtaatgatggccctagaaaccatttcaccagttttctgctccctcttccatgttgagaatatgatttagattgtatgacagaattgctcttaatgtgtcttcattactgtgccttttaaagtcatatcaagcaggctcatacttggtatatggtaaagaaaaatactacttttgtgttgtttgcatcccaagttagccacttccagggacacagatcactctggatactgtctacatggtgggagaaaattctgtttttctacttcatggcagttctctggaaagatacatggaccaaaactgtctgtgacaggactggattgtgcaggaatcaaactcaatggatctgccaggttggacttggttcattttaaatggagaagacagtcctttgtcaggttggagttggttcattttaagtggggaagacagtactttgtcataaaatgcctttacaaagttatatataattatgtgtattcaggtatcatttacctatagtaaaatgcatatcttagatatataatttgatgagttttaagcgatgtatgcactcatgttaatcactcaaatgaagatagagaacattttcatcaccccagaaatttttctcatgttcctgtccagttaattcccccctccccctgcaccatagatctaccatagaataattttgtcttcaacttcataaaaatgaactaatgcagtatgtactcttttgtgtttggcttttgttactcaacaaaatattttggagatttcgttttgttgcatgtgtacttcatttggttctttttttattgctaagtaatattccattgtatacacataccagtttgtccttttgcttgtttatggacatttggagtatttaccattttttactattacgaataaagctgttattaatgtttcagttgctctacatctttggccatctttgattttgtttgtcttttgaattttagccgtcctagtatatgcttcggaaaaatgtaattaaggaaactttgatacaggatataagatgtcgctagtatgtattaagatcttgccttagaatataataggtgcttggctaagctgatgcttcgtgggcattctctttttcagtccttacaattggactcagatgttagaagctgaggttcagagaatttgggtaacttttccaagggtcataccacagtggcagtagagctgcaacccagctctgtctgattccaaagcctgtgctcccaattcctgggacagtaggtctccaagtgaggtcctcagaccagtggcattagtatagtaacctgggaactggttagaaatccagattcctgggccccaccttagttctaccaattcagaagctttgcgggggatggggttggggttggggggtggggtaacaaccatggggtgttttaataaaccctcaagggattctgatgggcttattaagggattcaagggttcagttttaagaactactgtactagggtatagaccaaaattgagaagatgacatcagatgagacaggtgacctgggttctagaataagctctgccagtcacattcttggagcctacatttctctatgccaaaaataagtgggtgagcctcttcaggttatttgtgctcgtgaaatcctttgtttccatgaatcacccagactccaaaggtttaaaatggtatgattgtagtttcccaaagtggtgtattacaggtcatgcttacatatttttgcaggtgaattttgtggtttttcaaattacccaggaactgtaactatccctctactttttgtgtatgtgtggcagtgtggagataataaaagagatacaatttaaaagccaaaccaaaccaccaccagacccttcccctcactgtaatgagggaaattgtgatcacatatggttgaatatagttctttgtgtggttttttgttttggtattgttttgattcattggaatgtatgacaataactctcattttaaaacacagggccttgtctttcagagttgtttggtttctcatgaatctctggtcttgcttctttctcctcagtgacctccttctggtgtgctgtaaaatgcttaacaaccagtgctagtagtgggtagaccctgatttatagcatagctggagttgggaagagacgcgtatacttgctgttcccaagccaatgtgagctggcccccacacaccactgactgcatataagatagtgcccttgtggtggctcacctgtaatcccagcaccttgggaggccaaggtgggtggatcacttgagctcaggagtttaagaccagcctgggcaacatggtgaagtctctaccaaaaaatacataaactagctgggcgtggtggcgaacttctgtagtcccagctactcgggaggcagagtgggagaatcgcttgagaccaggaggcagaggttgcagtgagccaagattgtaccactgcactccagcctgggtgacagagtgagacccccatctcacacacacacacaaaagatagctccctgagtaaagtgccattccctcaccctgtttgttccttcatagccttgacacaatctcgtattatcttctgttgttgttgttgttgttttttttttttttttttttgagatggagtttcgctctgttgcccaggctggagtgcagtggtgcgatctcggctcactgcaacctttgcctcccgggttcaagcaattctgatgcttagcctcccgagtagctggcattataggcatgtaccaccatgcctggctaattttttgtattttagtacaggtggggtttcgccatgttgcccaggctggtctcttgagctcaggcaatctgcctgccgccttggcctcccgaagtgctaggattgtaggcgtgagccaccgcaacgggccctgtttcttctttattgtctgtttcccctcccatgagaatagaagttccatgaaaacaagaagcttgtctctcttgttcactgctgtatttctcagtgtctaaaaaagacccagcagggccaggcgtggtggctcatgcctgtaatcccagcactttgggaggccgaggtgggtggatcacaaggtcaggagttcaagaccagcctggccaagatggtgaaaccctgtctctactaaaaaaaaaaaaaaaacaaaaaaattagccgggcgtggtggtgggcgcctgtaatcccagccactagggaggctgaggcagagaattgcttgaacccgggaggctgaggttgcagtgagctgagatcgcgccactgcactccagcctgggtgacagagtgagactcatctcaaaaaaaagacccagcaaataataggtgctcactaaaattggttggatgcctgaatgactattccattgtttcggaaggtaagtgcaactaggccacttgcaacatctttcctccctttctctcgatttgtcttttacttcttgtttaggatccagaggtcttcactttctcgt

SEQ ID NO: 106745 - DNA, 1651 bp, Homo sapiens
gggaggcggcgagcgccccggggcgggtctcgggggtttcagtgggacctgcggcaaggggggcggcgaaccagccgggctgggtgaccgacagcctggccagccactggccgagggcggttaggaggcttagggccggcgcgagtgcgtgcgcgtgtgcgtgagtgtgagcgccagggtgagtgtggcagcctccccaacccccacctgtttgaaatggttttcaaatgccaaagccagattgcccgggtttcaaaagttgcaaacagttggagtaaaacacgtgtgcggccctccagccccaaaggaatccgcggagtccagggcactgaaagaaaaggagagaggataggggttcaggaagggttgggggggagttgccttctcccggcaggtcggttttaggacccatcgggaagcacgttggaatctctcccttcggggaggaggggaggggtgggccggccggctggcggccgcggggcgcatgcgcgcgcgtctcctgtcgccggccgctgcgctccgcggcgcggaatagaatgaactgtaacaaaacaagccgagcctttgtatctgcttaaaggggccgcgagcacttacctcccgccctgctccccgccgccccgccaccgcgtcttcagggctcccggcaactggctggaagggcttccctcaccctcagtaacagcctgccagcgaggagaggcgagccgggcgggaggcaaagaggaggcaccgcatttgtaaaaggcaagagagaaaggaaggaaggaaaaaaaaataacccgagcggcgcagagtggactctggtccgggagagcacgggcgggcgccggaacgtggacccagaggcaccggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagagatgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggtaaggcagggcgcgcctttggggggcgccccgagaaaaggagggtggtctgtgggctgccccttattctcgatttcctgcttccctcctcggagcgcagtgaagagaagttgaggccgtgcgccctgtggtggcggtgaaatacacaaagttgttgcgaggttgagggttgtttgcccacctgcgtttcgaagagggggctgggtttgcgcaaggtagcggggggacgtttctcaggcct

SEQ ID NO: 106746 - DNA, 1087 bp, Homo sapiens
ggatgattcttaaattcagacaagtttgagaacctctgaactagggaattgcaaagaaacatgtcacaaagtccctatcttttggtcaccattttttatggtgtctctacactcattcttctaaagatccttttatcttacatattgcatagaaagattattttgggaagatgtacaattagctgtagtgcgtaggttacatagtgatgtcattaagatcacaggttttacattcttccctcgggagtttacatatataatgtggttttgaattattagtattatttttgccatccatgaaacttcagtgaatgggagatgctagggaaaagtcagagtaccagggttcaaaaatagccttgttttactgccaagtttgaaagaattggacttttgtgtgtggtgtcttttttcttttgctattggttacggttttaatctaagtacagaacttcactgtagttgatcatcagtggatgtggatgtttttgtaaacctatgctgcaggagtgaggggttggggtggggctagagggaaacaaagatggaaagaggtgaagagaagaccatgtttaggagccttagtccctattttgaagggaatgtagagaaagcatagctttttttttttttaaagagccagaaggaactataggcatcagctagcccagcccctattctttgctttaacttgttcagcccccaacttggaacctgactgtactgacatttgcagttagtagaggccttcttggatgccacctggagggtggagggaggtttggaacttatattcttaaagaaccttttatgttacaaaagaagccataaagtcagatgaagttgaggtggttaaccatgaaatggaggaagttttaccactgtctctctcccttttcttgggggttaggagggtaggatgtagagtggcagaacttaacagctgaatgcaattagaggtattatagctgcacatttattaagtgggctgaagtgggaaaaatcacatgaagaaacacaaatgggaatagacttgtgttaaccaggtaaaactacctgaactggtcattattcattcatggacaga

SEQ ID NO: 106747 - DNA, 1034 bp, Homo sapiens
ccatttcaccccaaccctccccactcctaggcaaccactggtctactttctatctctatgaatttgcctattttggacatttgatataaatggaatcctacaatatgtggtcttttgttactgacttttttcagctagtgtagtgttttccaggttcatccgtgttgtagcatctgttagtagttggtttctttttaaaattaatttaggtgattatgtcctgacacacagtctcgttacatgcagttagtctggagtatgtatacttacatttgttggtacattgttgagagcaagcaacaaaaaaagaacctggccacttcatttcacctggggccatcttgcctgaaagttattttgccatgttgaagggcaggctttcctcagtttataaactttcagtccaaaaaaatagaaagtgatataataggtagggcatatagtagctattagatttctcatgttaatcatacatctttttatttgtagaaagtcgtttatattctgatgctcctagtatctgtaactaatatttttaaaaaattggagccttggaaaaggctctaagtttctaagatttacaaatattatgtcataacatttgatatgtggactgttaggcatgggaggtggggtaggtagattttagaattaggaaacaagtatccatgagactggagatacaacagataaggacattcttacctacattgtgtcttttgggggttctgtggtccctgagctggtaaggccaattatcaaacacctatttatagttgctatggagctgggctcttggtaatttgcccatgttggcttcagactcttggcctcaagagatcctcagtagctgagactactggtgtgcgccaccaggcctggcaattcctagagaatctttgtttttattttgtttaagacggagtcttgctctttcgcccatgctggagtgcagtggcgcgatctcggctcactgcaacctctgcctcccaggttcacgccattctcttgcctcagcctcccgagtcgctggg

SEQ ID NO: 106748 - DNA, 1709 bp, Homo sapiens
caatgtgggatacgtatagatagtaaaatggttgccacagtgaagtaagtcaacatatccatcatttaacataattagtctttttgttttgtgtttgtggcagggcagctaaaatctgatttagcaggagtctcagttatagtacaattttattatcttgcatttagaataggatggtttgttaggtgggtgggtgcaaggaggggtgttagagttctgaaaagaccttgttaggtagttttaagttccatatgtttggagcacagtatgatagggtcaccctgaggcgaagcaggggctgagagctatagggccttgcctgctatagtaaggagttgggacttttttgatcagacttgtaattttaagaaagtcccctggcagctgtgtggagataaggagactattaaaggaatccccaggagagaaccacagctggggcagagggatgcagagggagagagtgagttcaagagatgttaaagaggtagagctggtggaaagatgatcattctttcaggagcccttccagcgacatccttcagtgcgtttttcatcatggatgccttttagtttgttgtgtctatgtgtgttgtgcacctacttgaattctccaatggagtctaccgagctaagttgaataagcatgccccatcttgccagtgggcccagccatctgagtctgagctaacacgcagagagggaaagaagacgaaagagagagagggtcagaacgggagggtcagggcttcccctggcttggcattatctgtgtgtggttatgaccttgcttgtagttattcatctatagtacaggcatgaatgtgctgaagagatttatcagtgaggcctgtagaaaggaacattgtaccccatctgcatcctcacccccagtttctcgatgagttccttttctaacatatttcagattgttttctgttgtatggattttctttttctaatatagtatgcagtgttagttcagatggtattgattcatgacctgggagagtatatttcattgatttttttatttagttagtggacaaaaaggaagggaagctctgttaactttttatttaagagctgcatgagtttatagaacacaattaagttgagctttataggcacagtatgattttcatataggttgatgaagttgaagaaacgattctgagccacaggagtgtaacttggtcagttattgccactgcattgtaaatggaaagactgaatactactctcaaaggaccaaaataccaaaggaggttaggattggccacttccaagcgagcctgaactctgtcagtgacaaacctttatttcctaaaatattgccttgttaagattagggttcttgaattaaatgcaactgtcacttatttgctttggtttgtgattgtgtgcttttcaatatttgagttgtatagctaatactattaataggtgctaagagacaccgaataagaaatttgatccccgtttttgaggagcatataagtaagttggatccatctgttaaataactagggagtatttgaggatgtctgtagggaggtagcaaggtatggaccatgggctgtcaagttacacagatcggggtcagatttgtgacttgtccacttatttgtctgtaggccatttacttgccttcactgaaatgctcttttcctcatcttgaaaaaataggattaatgccatcccagtca

SEQ ID NO: 106749 - DNA, 1077 bp, Homo sapiens
tattcacatccaagaaaaagttactttctagttttatagccatatattcatttcttgactggacatagccccttacctgtcccccagacttcaactcagccttgcctagtctgaacttacctcccttcttccctggactgctaatctcatgttttgggaccaccatatgcctattatccaaaccagaaacagaagcatcttactgtctccctacttcttcactccttaacctcctgtcagtgaccaggtccggtgcattttactcctttttcctcagatttgaccttctctgagccatattcatttccagatgtcttttatagaactgctatagcagtctcgtaacccatcttttgccttctggctcgtggtccccctttgcttcttgccttcctccccaccctccagctgtcctgtgcattgcagccagagtgatctccctaagcacacgtcattcctctgcttcagctttttcaagtgttcccactgactatggaatgaagtttcagccccttagcatggtatacagggccttgtctgtccagtcttacttgtcattactcctgaccttgcacttgctgctttggtaatacggaatggtgtgggcagctgccagctttggaatactgtgttggtgggactgccgctgattcccctgaacaccctgcttttgtatttatgtacttccttttattgttcattcttcccactgtgccctttccacctttcttgccagctcattccggctcatccagaaggttctataatggtgtaatcttgggcagtttctctgaatctgggggttggactaaatacccctcctccacatttcccataatctttgtccatgcgccccaccccccttttggccatgttttattgaaattatttatatgtatttgcgggttctttgaagccagggcatcatcttagtcttctttatcatggagtggcttgtgtggtatctggctccatatgtatttcttgaactgaattagataagtttgaagggagactgggtggaaaaatatgttggcccaagttacagacagctttatacataagaagcattcaaat

SEQ ID NO: 106750 - DNA, 1024 bp, Homo sapiens
tcagcttgcctctacggatgtatgcattacttccagtaaagcagaggttcctctggttcatttttcatcacacatgtttgaaatgtcatgtgccagttgcagttctgggcgttggggattcgaaatgagtaaatgtgcttcttgccgttgggaggcttgtagacagatgttcttggaacatctggcgggaggtggcaggatctatataggacaagccaggaaaggttctgggctgacaaaacaatgtacatgctttaagggtccaagagttttaggttaaaaaaaaaaaaagaaactttttgacatcttgcagtaagcctacatattatacctttttactacaatttttgcttaccaaaaaatttcaatttttatagcagttatttactttttaggatataatcaaatttgtcttttaggttgcctgcctgattcgagttccatctgaagtggttaagcagagggcacaggtatctgcttctacaagaacatttcagattttctctaacatcttatatgaagaggtgagatgggttttttaagctcttcttttctttattaagattttatagtagctaatacgaacactgtggatttcatcctaagagccttagagaaaactttagagctaaatttaatgtccagttatagtaaatttttgctaagattatctttgccttttattggtttttgaatattttcatttacatgtttttcaaatttctgagcataacattgagtgtcctgaattgtaatcttcctgcagttcttctggaatcagatgtgaaacaaattttaaatatgtaaaatgaagaaagatattatattaaaacatcagtatagtattttaggtccatggaagagatttagtactggactgataacagtgaccaatgtcataacgtttataccaaaatgtagcttcttttacagatgtatttgaagctgtcagtcagaaattattcttcctgaccatgtgactagagagcatttagctgctttcctttatagtttttatggaagc

SEQ ID NO: 106751 - DNA, 1025 bp, Homo sapiens
ggttgtctggaaatactgaccactagtttgagagattatgaatgaatttctgatgtttgaggctataaatataattgtttttatacaaaaggataattggcatttgtaggcatttgcttttggaaatgtatttaaagcatctcaaatgttcttttcaagagaacacatgttagagcaattaagtactatataattaatatttagtagaataacagcaactaaaactaagtaaatatgtagtcagttttattgttagagatgttcctgtttcaaagagagctaatctgagctcccttaggagctagttatagaggtatataagttatataaggtatagttatgtaccttaggacagtttagaatcattaacctcttagagaagtgtggcaattgtgaatgttctagaactcaaacaagagcaggtagatctgctgtatacagaatgtccttcagaaatctctgccattctttctgaactctcggctgtgtgtttgtttcagggtatccaagggttgtatcgaggctataaaagcacagttttaagagaggtaagtcacttactttccaatattgaagtacgaaagaatgatgtcctttgttcagtaaatttatactacttaacaattagaaatatatttggagaaacttggtttaaaaaatcaaaaagggaaattatcgtcactcttctgttaaattttctgagtttttatatttaaaagaatgagtagaatgggtttgccggaagagcaatttcagtggtcagaatgacccatgttgttactgacttgttattctagggtggctaaatgtctcttatagttgaagtattttttgtttgtttttttgaaatgcagtctcgctctgtcacccaggctggcgtgcagtggcgcgatctcggctcactgcaacctccgcctcccaggttcacgccattctcctgcgtcagcctcccgagtagctgggaccacgggtgcccaccagcacgcccagttgattttttgtatttttagtagagatggggtttc

SEQ ID NO: 106752 - DNA, 1070 bp, Homo sapiens
atcccagctactcaggaggctgaggcaggagaatagcttgaacccgggaggcggaggttgcaatgagccgtgatcgcaccattgcactgcagcctgggtggcagagcaagactccgtcttggaaaataaaaaaaaaatttcttaaagaattggagccatcaaagttggcaagcattaagcatgctaattagttcaacatactgaccaattctctgaattattagttcaaagaagcatgtggacagggatgaaattaaatttgggaatttttcactctagttgttttaggatactcaggtttgctttgatctgtaaataacagatgcttttccatgcatggtttagagtacatcaaacatgttcaaaactttatctcagatacttaaaatcaagttattttattttcctgatatacatgcatttgctttatttttaaaaataaactgtcataaaatagttgtaaggccatacataaaatttactttattaattgctaaaatatattgcttatttaaataatcagttttaagagtaaaagctttggcaactatgaaagcatagggagtatgtgttcatatgtgaatgtattgtgtgtgtatgcatagtatacttttaggtatctaagtagtgaagataaatgtctgctttacttttattagctaaatattatatttaacttaataattatttaatcactagaatgaaaataaaactttgaacagaagcattgtttttaacttaagtttcatagtttactacctcttttggctcttaaccataattttagtactgggaagaatttttttaacgaatggcataaaatggattgcagatgggatgagaaaggtgcaggaccaagagggtaagaactgagaagtcctcgattctgttttccacactccctgaacagaaggcttgactggcgtaggccctgctccaacctagtgtaggctgcaggaagccatgtgacaagagtccagattgttgtccaatggtggaagcctcccatttataagtaataataagaataagaatgtttggcattgagcgaggtgcggtggctcacgcct

SEQ ID NO: 106753 - DNA, 1134 bp, Homo sapiens
gggattataagtgtgagccgatgtgcttggcaaacaaacttttgtatatataatcctttcatactaatatttaactacttgtaaaaactatgttaacccccagtcactaacacagttccgtagtccatatttattattgcttctttcacttttctcctttcttcatgcatgaaaatataatgtgatccaagggggtatgtgtgcatgaggtgtgtgtttatagagtaacagttaaatgtctcgaaataaactgatttggatttttaggttatagatgtttttgttttttattaaacgtcttgattgtttgactgtcatggttgtttgtataactccttgagaaacttccacatgcgggtagtttttgaaaaagaaaatatttatttgcttcagtttttcaggggatggtatcatactgctttttcacattttatgggtgacatatttggctatctctgggcaaaaatccagttaaaaataatagtatttaatatttaataaactaccaggcttttgagccatctggaactttattttctttgcacgcagcatctgagtttcagctgttagcgtttctcctttgctctgggaagggtcaattgcttttaaagtctttgaagcttgctgtgtcagcccttttcatattttcaaaatgcccgtgtaaaagggtttttcatccattcatgctgataagtcttttgaacttgaggtttgaaccaagctaatcaaatttaattatagcttaaatcccgttacagtgaactccagtggacttctaggctagggtttttttgttttgtttttttttttttttttggtgttatactggaatttagccattaccaatattacttgaagtgagcaggccattgactgcagtttgggagaccttttgtaatggtcagattttagttatagtgacattggcaatatgatttgaactttattcttttccaaaggaaataattgaattagccacaagtaaaatttcttgttctttgcatatatttcaaattaccttttcctatttgtcttaaacaattttgaacaattaaaatcttaaaagtactttcttaaagagtcctttggtggtggtgtcgctgatgctcgttttttgtttttaagatccataac

SEQ ID NO: 106754 - DNA, 1433 bp, Homo sapiens
atttaaaattctacttaaaaattacttgtttggatttctaagcagatttgggaattacggcattgaaaatactttgttgctttttatgtctcaataaagtctatgcatttttataatattggaccagtgtttgacctgccagaataaaatgatgatagaactcattgtgtcctcaaataattggattctgaaatggaagatagggttcatgaagaataaaaaatagtagatctcatgtaaaggtgaaaatttacttttctttttagtattcaactcaaaattgccagtttccctgaatttattatagcaatttctcttgttttaaaatgaagtgaaatgtgaagttaatttacatactagctgctttgaagtgtaattttgcttgccaagttgttacagatttttatacagactttttaaggaatttagtaataatgctgccacagtgtgtaggacaagttcatgccttgcatctttgatgggcgttagaattgtttgccacagttcccactctggttggagggcacaaccaattcgtctatgccttttgacttccatgccggagagtgtgacttctgcatctgtttgttagtatttttatgtaagcagaagccaagaatgtcattagaaagtaaaactttaacaagagggactgaatcctactaggccaacataatttatagagagcaggggctaacattttcatttgggaaaaatgcttccatttctatacgtgtttagacggagtaccttaagcattgttttagtcttttcctatctacatgttaccattcagaacttaggtggatgaaacacattttatatgtagttacagagagatacagaattaaaagcctacagatacaagcattagaattgtgacgggggtaattagaaacatggagtctgaaggtagcctatctggattcaaatcccagctccagtacttagccatgtggccttaggcaagttatttaaactgacttattttgttcctctgtaagatgagagtaacaataataccaacctcataaggttgttgggaaaattacatgtgttcctgcatatgaagtgcttaggacagtgcctgaaatacagtcctatataaatgttataatttatgattattgttgtgatgataatgatgataatatcactagcagctcctctgaaacttgttggcctcatccaaggcctatcacttagctttatccccagtgtctctaatactccatctgttgtgcagaagtatatcctgaaccttcctccctctgaatttgcccacttggcacctcttcatttgctcttacaatctctagaccataaatttcaaagacgtggcccaaaatgttggactcaaggtttttgcaaactacaagctaacatgttaaaattgagtggtttcatatacaactccagttatccaagttttc

SEQ ID NO: 106755 - DNA, 1030 bp, Homo sapiens
tctgagatgtttttgttttcacatttaggatacagcaaagtgtcttttaaggaaggaatcctttgttattaattcactagtttgatgcatgctttagatttttaaaatataggacacttttaccctgtgaagtttaaatatgtgactagttaaagatattaaagttttggcacacattttctcattaagcaatgagattcatattttctagtttatgggataaaaataaaaattcgatcagtggttgctacagtttcaatctcattacagctgcagtggagttttcttattaagacaaacctcttttcaaccacagatacactttttagcttaggcttcacaaagcctcataactgaggttgcattggcattgagtatcttgcctttaacagacttttaggactttatttgtttcccacaattttctgcatgtttgtctcaaatgaactataaaatgattcagtgacaacatgtggttttaataacaaacaagcatgggcaaatgaatgtagacttagaatttgaagttttgtacatatgccatggcttcaacttctaactgaatttatagctcagcactcagtcagtggtaaattatcagttgctagatggactttttcattctagacttcaattattttgagtgcctgatattgaagaccacagatcattgatataaagaattttctgcaagtttttaatagtatatttatagttaggttttgtgatcaagtgggagcaaatttcccccaatctgttttttaccttcttggtttttaattattacagtttatattgcatcaaaatgtaaatttcaagataagtaaggtattataaaactcatttctttacaaaggtttctattgaaaatgagtctttttgaagtaggaatgtactatagtagctgctctgagcattagaaataggcattgtggagatgcctctttcctctctgaggtggaagagcatgaggctactaatgtgtgtaaatgcggtctttccctcagattgggtggggcaatggaagggg

SEQ ID NO: 106756 - DNA, 1053 bp, Homo sapiens
tgagtacttcacagagagatggttcatctgattgaatgataaaattataggcagctgttgctttgtttttaaaaatatatgtgcaaaagctacacaatagcttgatcaactacagtatggaaagtatgtgcacgaaaatcattgtctcctgtctttaatctgttataaacttctggtggtaaactcacagcagtgagacctacccagaggatgatatcaagagcaagcctaggtttgaaaaaactaagcattatcctttccattatcttaaattttgtcatgtgatgttactaatttggaattgagtagatgattctgtgcacatacttattttactacatgtataaaaagcatatagtaaaatatcatcatcttgtagggttggaagccatataactgcttttgaatagagcagctaaagaagtcccaagttgtaagtatttgttcactggagccaaaacagttattttcagtgtgttattcataagacagtagtgcttatttgggtgggtcttttaaaagtgaaaaacaaagccttctcttcaggctatactttaaatagaagacacttggtctggggttggactcccagccacttcatagtattgtgcctggtgttggctttctggcctatgactactggtgctaatagctattatcttggggtgggggtcggggagccaaactacttcatgctattcttcctctgataggcctttagcattaagtgaagaatcacttgggaaattacaacctgattgtttttgtagtggtatcactgagtatcctaaagaataatacaaatactgttaatgtaaaaagtcaagctgatgtttaaaaattgcttacttttaaacaatagttattatggtgaaactcaactagggtctgtagcttagttaatagtgttgtaccaatctcagtcttgtgctttgatcattatactatggaagctgggtgaaggatatgtgggaactttattattattattttttgagatagggtcttgctctgtcacccaggctggattgcagtggtgtgatcgctgataac

SEQ ID NO: 106757 - DNA, 1001 bp, Homo sapiens
agacattccaggttgtttagatgaagagcgctccactagttgtttgagaaaagaacgtgtcttagaggggaaaaaaaaaaaaaaactgctaaaaaggtgtctgcctgaaagacaaccaatttgtttttgacaaatttttctttttctttttatctttattaaagccttcactcaggccctggaattaccttaaagatgatttataaagtcctctgtgggaagagacttgctgtgggtgcagggctcaccatgcagctgtctgccttgggcagtgcttagggggtttaagcgatttctgcagaaggccatgattcacggtttgtgtgacatgtttgacagcactgtagattaactagtgtcaggagagcagaggctcctccataacttactgaagggtaaactgttctgtgtaggaagtatggagatctacacatctgggcattttcgagacattaaagcaagagcgaggtgacaatatgcaataccgtgttatccatcactaagtcatatgaattttcaagtgaggctttaacgagaactcaaatgctttaaagagcttaataagtgatatgtttaaaagcctaagagagaagtatattttgttgttacaacgttaaattagaattatagttgaaatacaatggaaatttgccagaaaaggaaacttttagttgagatgtgaagccagtaggggaggtttagggtgttaactttattggaaaataattattttgcaatttgtttaatggtcatttttgttgttgttgtcgtgattgagaaaacaaaatgttcattttatagtactctttattaatagactcatttgacttgtagaattgataatcaacaataagaattttgcctgtagacatgaaaccaatccagattgattatgatgatgatcgtttccacatgacacatagtcattagctgtgttaaataagtaggtggtcttgattcattttccagaggtcaggagtcattattccccagtccctaag

SEQ ID NO: 106758 - DNA, 1105 bp, Homo sapiens
attagtaacaaattactttgaacataccatagtgcaggtgggatgactccactattagcatcaattgagaaccattgtgctacagaagtgcctcagacttctagcttcatgtcctaaaagctctctctgcaagattaaaacattgctttgacaccataaacttgtgaagccgcctgaatgttgagatcttacaggcatgtgaaatgatgatttttctcttagggaccatataccagggattttcttgcaagagcaaagcagtggcctccctttgcagagggtcggtcggcagctgcctggacttcgggcgtctcagctggcagtgccacctcctcatcctgatgccgagttggatcacttatgtgattgtagtttttgtgtacctttggcagttttaatctcagctatttgatgatctggaggacatgaagtaggtgagtcaggacccagttaaggtttttataggagagcagcacatcctagattgaaattttccagttggaagtttgaaaagtaggtgatattggatggttttgttgaatgtgacaactctgagggattgacgttgggggtgtgaagggtgtcacggttttgaaacaagaactggggcaaagccagaggaataattggctgttgacgtctagtgagagcgtgggaagggcctagtggggggcatgtgtgctgggagcctgccacttagggctgccatatcgtgaggggtgcttctatctgtggcacattaattctgctgccagttccacagcaaacaaaggaatggggtgagaaaaaatgagtcctgaagctacttagccagtagcaggtaaaaggtgcttaggggccgggtgcggggctcacacctgtaatcccagcactttgggaggctgaagcaggagggtcgctcgaagttaggagtttgagaccagcctgggcaatatggcaagactctgtctctaaaaaataaataaataaattagcctggtgtggtcgcacgcacctgtagtcgcagctactcaggaggctgagcaatcgcttgagcccgggaagtcgaggttatagtgagttacaactgtgccactgctctccagcctgggtgacagagcaagac

SEQ ID NO: 106759 - DNA, 1013 bp, Homo sapiens
tgctgccctctcggggtcaagtcaagtggcgaccacttttatctttccgtgtggtccacgcaggtgaagaccttgttctggcgcatatgggagtacacatataaacagaaatatattactaaacaaacaccgcgtgttcattcagccccgtagccaaaggcagatggggagcctgcccaccccggatggcccctttctggttttcttcactcatcagctggctttctgtttttgttgactgtgccctttatgtagtagctgccactgccgcgagcatccctttctgtctggcattgtaagtgcttacgtttgctctcatttaatctgtgggcactagaacacgctcctgctcaactcaaaagtcttcacctgcgagactggctggggccctcactgtacaaattactccacgttaaggccgtaattacgttaatagattcagtggtcatctgttgaaaccataaactgcttccatctgtgtcttgccaggagcagctgagcttgtgagtggcagaagctgaacaagacactggcgtttagaaataagtaaggtagtaaaggtgggagaactttgtggccagagtggtctcccacagctcggcatctgctggccgcctgtctagcactctttccttcgtaaggtaggagcagggaggctcatctgtctttcaggcaggaaggacatagtggtaatttataagtttctgtcctcaccacccaccctttgcatgatgctgattttttttttttttttaagcaagtgtagtttggttttcaatacaattttcatggttatttttggacaagtaatcgtggtccttaattttatgtgcagtattgtaatgatttaaacccatagctagctaactaaaaagggcccacaaaactcttcttaagtgtctcattttccttagaagtgccaagtgctgcaaacagagggaggctgctcagcctcccccaacagctcaaaggtgttgggagaaaggatgcagtcaggtgctgggagcagcctg

SEQ ID NO: 106760 - DNA, 1027 bp, Homo sapiens
cacagtggagctgagcagcctgtcctctgtgtggggacgaagactcccacagcagtgactctaacccatctttggcgctgtccttcagaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggtaacttttgactgtcttctaacaggtgggttgggagctgcttaaacggtcaagtgggggtctgacaggttcgttctttccttgtaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaa

SEQ ID NO: 106761 - DNA, 1037 bp, Homo sapiens
aagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacaggtcaggccctgccagcggagctgactttcaaggagggaggaatggcagtgatgctggggaactgggccgggttccagtggcttttgaaagaattgcactgtgttcagaactcctgagggtttagtcccactaattccattttaactttgaggaacttaaccttaaacaggaatactctcaaatttaaccttaaacaggaatactcacaaatacaagtaactgacgcaccatgcagttttccctctccttgctaactcagaggccgcctatgcacaggccctgctgccacgtagtaggttgttcctgaaacagtgcggtacttctgtgagccccggctttccatcactggtctccacttcttgtggcgtctggcatctgctggctgcgctcttcacgctgggtgtagagtaaagctgagcaggctctgggagggcctgttgcgtacatggactccatgtcatctctctgcacagcgctgatggtcgtcactgggaggatcccctttctgagcttgacagtgaacgtgtgtctgcatttcttgtcactgagaccctggtgttctatttgttctgtctccttgcagatgaaaccgtcgtgccaccagatgttccaagctacctctcttctcaggggaccctttctgaccgacaagaaaccgtggtcaggaccgagggtggccctcaggccaatgggcacattgagagcaatggtaaggcctcagtaactg

SEQ ID NO: 106762 - DNA, 1123 bp, Homo sapiens
ccttgttttgtccagttcttatcctctataagccaagagatctggcttccaaattccaaataccccttagcctggggaagctgctgttctttgagtagatggcacagcattggagtcagaggctagctactgctccagagactgtggagtgcaaggctggtgtgagccctggcctgaaagacacagtgtcctggcagttgacaggtttttactcattaaccagccttggagcttgtcaaggggaccatgtgttattgtgtgtttggaggaggggggtggggagtagatagcttgaagagtttactgtcccaccccagtaacctaatggggttatcctgattactaactctctagttaaaaagaattggcttgagaatcatcagaatggtggatctgctttgctctttaagcccccacagatcacagcgaaacaccttctttaccacactgtagtggggttgtcttggcttattccaagtcctcacagcttccgaaagactcagctgtttgttagactctccccaaaattgacgttgacaggaactctggtggtgcctgacacgtggctggatgcgtcccactctgtcaggacatcgatctttaggctgagcaagctagcaagctgaatgcttcctgcctgggtatacggcagtgggcaggaacagcctgggtgaacaaccatccaaatggatgagccatcccattcatcccatgaacacccatccaaacggatgagccatcccattgctctcccaaggtggaggcatgcccaccttccctctgtaattccatctccacagcctctctcttggtgggtaaagcaggcaagcatcaggcctacctagtgtggatgggcaccccctgcaactcccgtataggcactgccatgtagagtaaaagcctttgctttgaagggactatagccagcctagggtgtacaatgcaaggctgatgggatggaagtgttccaactgtggtgggagaagctgggggttcctgattcacaggtggcaggagtggtcctgggcagacattgggagaaaagaagtgaactggcactgggcacagtgacaggtaggtgtttgccagaggacttcctggttttgcatctagctgtcccgta

SEQ ID NO: 106763 - DNA, 1052 bp, Homo sapiens
ccgagctcaagcgatcctccttcttcggcctccccaagtactggatgggcataagccgccacacccagccctggttcacttttactcagccaaaaaagtcacttctaggaagctccctcttgccctatgaacactcgagtcggccttggcatgtgctgtcatccattttgatttgcctgtcttctcccagcccctactcacatgcacatgtgtgcgactagactccacagttctgtcgtgcactgttctagccttggtgtgaccgcagtgtcaggtacagcgtggctgctcatttgctgtctgtccagtgaagggagtgaaagctcctcttcatcctgtgcatggctgtcattgcaggcacctggagtacaacagcctggtagaagtgaacagcggctcgctctacggcctcacggccctgcatcagctccacctcagcaacaattccatcgctcgcattcaccgcaagggctggagcttctgccagaagctgcatgagttgtaagtgtcctcggctctgggctgtggcagtgtttttagacactgcttggaggtgaaagtgctaggcctggttcgttccaccacacagtggcctcggggagggctcagagacaggccagtagccctgttcccaaaccagccaggcccagggtggaaccctcagcgatttgagccccagtcccttcctcatctccccttcacttcctctgcatttggattagcaggggctccaggagtagcagctaggtccctgcagggagccttggcccccaaggtcctgttgggtttggagacagttccaggggtagaaagttcctggggaagggcagctatggcagagtgctcacaggagccattttgagagtgactgtgtgttaatggccacaccaaatagcatgtgcttcttcagtgagggggtcatttgggctcaaacagagacagtgaaacgctgactgtggatgaatttgtgtcctcggagtcgccaccttccttcctgtagatgagctgcccaggttcttggccccttccctttctctgttttgcaccgcagt

SEQ ID NO: 106764 - DNA, 1051 bp, Homo sapiens
cacccttgtctcccatctccacggctgcctcttctgccaaatggggaactttcccagcgggtgaaagagacttgtcttctgcacagggtcctttatgcagagtggggcccggattgtgtttgattcagcgaatgaaaagactgacaaggagcaaaaggtaccggaccacagacaaagactgaggagacagaggaggaggtggggagaggacagaactggcgtgggagagatgttgggcctgcagctgtcccacggcttcgcaatgtaaggcctcaccccctctttgtgcctttctgggccggtggcgcccggcccttctgtccagcacagacccttttcctggcgccctgataccacattcacagttcccggataagactcagctctgtcgcctttatttcttgtttcttttcttcccatactttacataataaaggttttcttttcttttttcctttggagccagaaaactgaggagactatctttattaaagaacttaataaagaactcaaaggaagtggctttgggggctggggaggagaggaagggaaagggtcctttcatgccggggaggttctgtgtgcagagttgcacccttggaaatggactttcgagttcagggcctgggagacgcatgaaaaaaacaaaggagtccacgagaagccccagagcttctgggaaagaggtccttgtttatgcctgttggaactgattcggtcaagtgtttgtttaaaggagatgccacttggtaagcgacgcctggcttacttgtgttgtgttcaagaatgctttgattggccagagatgctgacactgtttattcagaactggctcgagtgccagtgcctgcaacctagaggcccagcgccaccacccagcagattcctaagtgtctaatattggagtgagggctgcagtggtttgactctgccaggcggcgccaaacccacaacagggcggttagctacctctagccttggctagcattcgtctttctcttgacttataactgttgcttgtttatatagtgggtttgacagaaagtagatt

SEQ ID NO: 106765 - DNA, 1022 bp, Homo sapiens
tctgaaaatgtagccaactggggagagcttatcttgcctgctttccgcctttgaagactgattttatttttgaagcctttaacaggtgttggtttaatagacttctgctgtattaagttctcctcgctccagagggcagcccaaggggtaaactgacactgtggatggaggcgaatgccacgtgacctggccaccacacacttcccccggtccccataagtgcagaatcactggttttgtctggttgcagagaaaggctgcgctgttcctttgatgaggccaataagaactgttcctagcacaacactgtcctcttgccttgcaccatcctcacccttttttgtaaacttaagtggatccctttgcagcttaccttccctaacaataaagatactccttcctccctcgatggcagatctttcaagatctcaaagaaactgcccttttctttccatccagaacattcaaagtaaaaacttgagctttatctgccttatttgctgagattctgtcacatgaagtcctgtgcacatttgcttctcacacaggactctgggaagcttgtatgagagctgggccacctggccgaggccaagctacgtagaacaggctgagttgactgagaaatggccagctaatgttcagatttagccaagctttggaagtttatgggtggaatctgggccagtgcccttaaagttctgccaggagagcctctcggacgggctagatagggtcatgcttccctgggcttgcatcccggctcctcttgcttcccagctgtgtgaccttgggcaagctccagcagacttctgagcctcaatttcttcaattgcctaagtatagatgcttctcaactgacaatggagttatgtccagataaacccatcctaagttgaaaatatcattaagcaaaaaatgcatttaatacctctaacctcctgaataccacaacctagcctagtctaccttaaatgtgctcagaacactcatattagtccacagttgggcagaatcatcta

SEQ ID NO: 106766 - DNA, 1042 bp, Homo sapiens
gattattttgagtgcgtgctgtatgtgggtggtgacagtgagtgtgtgatgcagagccttggtaagaattccagtgcagcaccatgatgggcagagtgctgcagggtgtggagtttgatgaaacctgtctgccaggatcactttgttggggtaatgggggccgggggtgttagattttttttccccccagtctagggctagattatgtgaaacttattttctaaccggaggttcaggcgaagcaaagagctattatgtggatttcgcttattcattaagtaagacgtgttaagatttgatcttgaagtaaaactgtggtagatttgccatttcggtgagagtccacactcagatagttgactgtggactttgtgaatcactgtaattgtctggaagggcggaagggcacagcttcttagatcttagggatggagagctggccagcttcagtatgtttcagactaattggcggaactgaaacgaggaaggatataggatatacagtgtggatttctgtcttctgtaaagtaaccctgtttgcccatctatcttcactggctccagtaaggaacctggttgatctcttgaggaacataacagtggtagagagacttatgttccatttcactttctgaagaggtagaaaagacattggcagaaaagactgtgattagtgatgtctgacatgggcactggagggacaatgggaaagttttctctctgcagttaagaggtatttccttattttgcaggtggttaaacgaggtagagaaagagtgatttatacatggttccaaaattgcatgacagcaagaattagagtctgggtctctgcaccccaagaaacacaaactggttgccatagggttgacagggtcagcacaccacagacagtggtcccaatcctggcccactgcttgtttttgtaaataaagttttattggaacatagccacactcattcatttacatattgtctggctgcttttacattataacagcagaactgagtggtcatgacagagacagtatgacccacaaag

SEQ ID NO: 106767 - DNA, 1918 bp, Homo sapiens
ggccttaagggacactctcatcacctcattcttgatcgttgccatctcaccttttctgcttttcttgtccagaaacagttgctcagcccctggagtctggttgaatccatgtctctcattctgtgtcctggttttcttacctccttccctcaaggggcagagctgaacaggcagggacacatgtgccctgacaattgtaatgaagtatgtttagccttcttctcaaagggaaatcagaggggttcagttcagctgtgccgtacccgggatccacggttgtgccgggcttgctggctccacatgacacagcttgatagcccggtgctctgccaactttcagggtggggcctgtgctctacgagggctgagagcttgtggcggggtctcggtgtggtggagggaacaccatcagtgtgctggggtgtggggtagcaggtcaccagggaaaggaaaacaaagggggaagaaaatagggatgtattgatacatttgggggaaaacacagccctgagagagaagcaagtgtctatgttggccctgagcaaaagcgataaatacgtttggctcttctgacccagaggtgggcatatgtggctgggaattctggtggaagtggctcattgtccatctctggcccaacttgagcctggtttttcatctcttagcccaacctggtactgctttgccatgcccagatgccaagacagctgacctccgtgtggacatggaactaactcctcaagccccttagaagtcactgcccatgttaggatggcatagcctttctccctgggaatgtgatccatatgtggcttgtacagcttcctcgggtcagcagtgtccacgtggaactcccaggggaggcgtgtggatggggacctcaggcagggccgagctgtggctagaagtgagtgagggagagattgttggccagccttggataagcataattgtctcaacattgcaagccagtgagggccagtgtttggggttcaattgaatgtgggaaatgcgtaagtaacccccaccccgtgctatttgaaaatcgaaaatccatcgtattcgacatttgcttttaaataggtctgtcagcttccctaccttttttaaaaaagttaactccacgttgtgtcttaaatttttttctttttaaaagtttttaattggatggttggtcctgcctcagtgttttttttttgttgttgttgttgttgttttgttttgtttttcctgagtaatgttccttggttcaggtttgttgtggtgaatgtaagacattgaactaaagttgtaatttgtttgtttattcaacaaatattgattgagtaccttttaagttctaagcgttattctgggggctaaggctatagcagtcaatacgatagactaaaaattcctagccggtgtgcggtttatattctacccagtcgagactgcaggactacttaatactttaggaggttttgttttgttttgtttttaattaatggacttttatagcagttgtaagtttacagaaatggagtggaaagtacggagagttcccatatgcccccgccatctcttctctctccccctcacacacacacacacacacacacccaccctgtttcccctattgttaacatcttgcattagtgtggtacatttgttacaactgatgagtcaatatcgatccattattactaaagtttatagtttacattagagttcagtcttggttctgacaaatgtataatcacatgtgcccaccattacagtgtcatacagaatagcttcactgacctaaaaatctcctgtgctgaacctgctcatctctctctacccagcctctggcagttaaatattgttactgtctccatagttttgcctttctcagaatgtcatacatttggaatcatacaattggtagtctttt

SEQ ID NO: 106768 - DNA, 1042 bp, Homo sapiens
ggccctttctctctgtgtttcattttgcttatgcagaattgagccgacttccagacaccagagccctcccaagctgggtggcaccattgggagagcctcatgggaagaggcattgctctgcacctggctttttctgtcaggtcttcaaaagagacttccatagttttgggaactggagtcatagagcaaaatttcagttggttaatactttctgattaaaggaatctaattcagttaacatatttgtcaaagaacagatttatttgcattgtgttctgaggataatgccggagccatttgtccttaataaacagaaagcatagaactcaaggaaagctcttaataagaatgggttccggtgagggagctaatttcataaaatagtgccgagaaaaagaaacagacttttgttaaatgggggcagaagctgccagtggattttcacgtttgagatttctttcttttttaatttaaaatccaggacactcaagttacgattcccacagcaacagtaattttgtctgatgcatcaatgacatttctgttgaggaaaaatctctgtttttccggtggtgttgctgcacttgtactgtcgagaagattggtgacagtggaaatcgttgaatttttcagtcctgggagtaaaaatgtatgtggtatagttggtcttagcttttgtctcctgtgcatggactgtagcatattacccatagggttggccttgtctacctaacaacttctccagctggtttgttctagacttcatccctttatggtgccttgtcatttgctctcccacagcctgtgtcctcaaccaggaggaagacctaggcaaaacttaggggcacacaattaattgtgactttgtaatattgctattaaaattccttaggtttaggttgcatttgaaaacacattgaaatgccttttacttctaatcttgaaaaaatgtttttgaaaactattttttttaatgagataagataaatgtacccagggacatggggaggcagtgtggggctggtcaatgggtacaaaaaaa

SEQ ID NO: 106769 - DNA, 1073 bp, Homo sapiens
ttggcagcttccccagcagagcacctccctcttcacactgaatttcctgtttccactccaggctttcatagtttaattttattttgattttgctggttttataattagtttgctcacctatatgaatcttttctcaatactgaggctcggcaggctgagcagagaaactttgcaagaaggtgctattaataagagtgctggcatagcttacagatctcggatctttggctggcagcatgccctgtgttcaggaggtgctgtgtccctgtgaaacatggtcttgggtttaacccttttcatggcattgtgggattgcaggagagcgtggggggttagaattgcacttcactctgtgccctggacagatgacctagtctctctgaacctcgtttccctcatttacataatgcatttttgacccattttatacatgaggaaagtgaggcccgggggagtggaatgtatatgaagctcccagcattctgtgggagtgtttgacaaatggtggttactgtcattggctggtggctagttgtcacgtagctccttggatcttggcaggatctcacctttaaggccgcaggatttaagagtcagtctctgtttctgtgaagtgctggaaggaaggtttgtggccctttgttcccttgatgggtaaaggtctgactttattttgtacccacttggtttgtgggcccagcatctggaaggtgtttaatttttggcttaatcaatgagttcgtcttatgtgaggctgatagggatgtgataacctgttgtgtgtccataaagcaaagcacttgaagatgctaggagctccttgctgcttaaagcacaggtcatggaccatcagtattgagttagcttcgagcttgttagaaatgcagaacctcaggcttaatgccaacactactggatcagaagctccatttaacaagggccctggccgtttgtccacgagttcaagtttgagaaatgctgatgtaactgctcttgttcctcacatagtgaggaagctagggccacagagaatatctctgtgttgtcagagaggaaactgagcctccctggag

SEQ ID NO: 106770 - DNA, 1127 bp, Homo sapiens
agacattgccaagtgtcctctggggggcaaaatcatccctggttgagagccactggtttagacaatgaaggggttttttcccttttctcctttactgctgcttgatgttgatgctactaaaacattaatttaaaaaaatgccgttaagaatagccttgtacttgatagggtgcaaagcatttggaccaggacaccttaatgtaggtagggagctggtttaccttagaatttctttccaagttgttaaatagtgaaatgatactgatagaaattcgtttgggttttcatagagttgcttggagtgccttatttatggatgtaggtggggagggggtatgtctgtaaatctcagtatcaatacggttacttaatacatgatcatgggatgggggcttggatttgagggtgggggagccaggagaagagaagatttctgaattctgggtatgatgccaggttgttgattccgtttttttctctctctgtctttaccagaaacctgagttacaacaaactctctgagattgaccctgctggttttgaggacttgccgaacctacaggaagtgtgagtctccccctaaacctctggtggatggaaggatggagagctctttgggaaaatcctcttgtattgcagcatcgctcactcccctagatccgcagtgtaaacttgtaggaaggaacatttgtgtatggactgtgttgatgaattctactcctgcttatctctcccttactgtaggctcttgaagggtgtgttacaattcagtaggcatagagctcctggaaatcctgggcgcatggtgggtgtatagcagagtccctccattgtgggaagccttgtaactggagtgacacatcctgggctggtactttctcacagttcctgcaccaccacgcccagctaatttttgtatttttagtagagatgagattttgccgtgttggccaggctggtctcgaactctggcctcatgtgatctgcgcgccttggcctcccaatgtgctgggattacaggttaatcagcccactcaacagtggcatgtgagccaccaaacgtgtatttcccaggaagtgaagttatagaaggatggactatagaggcttacctgttcctctccacc

SEQ ID NO: 106771 - DNA, 2195 bp, Homo sapiens
attggaacagcttttatttactttgataatatttcaggactgagtgtggtggggagtaaggagaaaggaaagccagtttggggagacttagctggagtacaggttgcatctgatagctgagtgcctgccttttccagcaaactgctctcacccccaaccaccaccttttgtttggttccctatatctcagggcatagaacaaaacccacttaattttgttagtgtgcagtatgcagacgcaagtcattctccacccttctacctccctaccaatgatagcatgtttattggagggaagtcatgttggagtcacttgatttaggacaggctaggcagagactttgacaaacctcgatttgtcaaaggagtgattggtagaacctgggagattgtgtgttcgttatatagcaagtgttaggctaagtcctagctgttttcatagggcagctgcctcaatgtagctgatcttgtggatgtctcaatttggtatgaccagtgggcttggattttctgtttggatgtgaagatgctctgtgaattgaatggctcttgtctctctctagtgcacagagaggctgtggagtacctagaagtacacatggtgtttcttagatttctgcctgtaactgaaactccaaaaagagtttactgataattgacttttgacaaggctcttaaccacctttgctggtgattggctttaaaagaaagaactcatattccacaggtaccagtattcattatttggttaagatacagtttagcaagtggaatttgccgctagggtccaccctgtaagacacatcctttgtgagtaaatgacctggacctgcaaatgggagtgggatggttggggaggggacaggcgtgtggtggggtgatgcacccagccacattgaatgtagatggggccgggtgctgtggctgacacctgtaatcccagcactttgggaggccgaggcgggcggatcacctgaggtcaggagttcaagaccagcctggccaatgtggtgaaaccccgtttctactaaaaatacaagaattagctgggtgcagtggcgggcgcctgtaatcccagctattcaggaggctgagataggagcatcacttgaaccagggaggcagggtttgcagtgagctgagatcacaccattgcactccagcctgtgtggcaagagtgaaactccatttcaaaaaaaaaaaaaaagaacgtagatggaccttgtggaagaggtgaggcattgtttttagggactttggcgaatgatttaaaaaaaagaaataaaagtgtgttgtggcctagtcattttcacagccagttttccatttgacatagtaaaattttagtatgttcaaggatggaggtcgcatgcagcatctgctattttctgcttgtaatttcagtgaaaaggaagttccatgttttaatagcagcatagtctgtgtacaataatgcatgctgaaatactttgtggtttttgaatcttgacttcgtgtcttctcagccatttcaacaaccagaaccagggaaatcatcactgctccacgcctctaaacagggaaaatgatgtggtagatggtcttttaaatttagagtgtttcacgacgtcttagtactgcagaaagaaaaacttagccttttggctttagctaagcatttcatgacacacgtaaactttaagaagcccagtggaaaaagtgaacaggacgagatcccaagtcgataagctagctattaaagtcagtgacttcactgtgggccagacggctgaccttttaaaactgtgtgttttctttaaaatacttagctagagatagtcgcgtgcctccctgtaatacagcggatgtattcttgaaaagttgtgggtaaattcgcttttctaatttggctgatttaataccagggatctgctgtctgtatttgtatgatctgcattgttttgaggcagctgagaaagagaggataaacctagaaaataatattggaaggaaccttgtacttaatccatttgtaacgccgagcattgtggcaaatgcaagtaagcatggatttttatatgagctttatagattttggatgcttgggctttgcacaggcaccaggagacctcacagagatgttagtgagctgtgggtgtgatgtcacacagttgaaaaataaaggacgtgtgtaagttccagtggaggctgataga

SEQ ID NO: 106772 - DNA, 1355 bp, Homo sapiens
tgagaagcaacattaagcacaggagtttggataccgtggaatccagagggcaaatgacccgggtcgtggtgtgtctggctcaagaaataacattttgaagtgccacctggccctaatggcaacagcagccatcagttaaaaaaaccagctgttaagtaagagcaagaacaggagtgtttgtgcaaacaacctttaaattttctgatccttgatgaatgttagttggtttgtgaattattaacttcagcgtgtgtgaggaaatactggctgcttaagtatatttttatgtaagaaaaaaataaaactgaccacaccctcagctgctaccattttgggctcagttcttgcctgctctcactcaacagacgtatttaaagcagagataggaatgcctgctcctcacagaccacatgtgtgtcgtgcgtcacagtgcatcagttgccatcacaatttcactttgaagggaacggaagtgttttgcagcctgctgggatgtataagtaggatgatccctaccgggctgcacagaggatccagagtcctcatgaggattttggtatagataccagtgtagttgggaagaatcctgcgtatggaatcagaaaactaggtttagtgaattatagaaagctggcttgagaaatccatttaatgtcactcagccagcaacttttaaagagtgttttgaggcaggttctttaatgtgaccctggagagacagccatctttttctagtgctttgatttacacagcagtgtgtctcgcaggaagaggccagcagatttgactgaggaactgcagtgtggcatcttggaaaaaggggatttgaggactttgagagataggaagagacttggagaaatccatttgtgaacctggtttccacagctgtttttcagaggtctcttggacctcttaaagttgatactaatggactacttatttcttttgacttttacctgggaaagagaattgtgattaggcccttatctgggggagaggagaggctaagggaggaaggggtgaaggattaaggagttggagagaattggaactggccagacagggctatttgagcttcacatacctttgggtattggttgctgaattaatcctgcagtgtaagtcacacttagacatgcctaggtgtgactcttggggttcatttactttactacagggtttaatctctgcgcatttcgagtgaggaaaacatgcttgccatgggaaggaagaaagcaggtgctctgtctcccttccccacctcttcattgtcctcagttgcaatgccatttgatataggtagttctgaaatacattgtacgctttattcccaggctgcagggattattgct

SEQ ID NO: 106773 - DNA, 1901 bp, Homo sapiens
gtttcctggagaagctgtgtgcaccacgtggcacatccaccagcagggtatgaaggttcccatttctgcactacctcaccagcacttgctattatctgtctttttaaattttagccatcctagtgggtgtgttgtggtatcttgtgttgtggttttgatttgcatttccataatgactaatgacactgagcatcttttcatatgcttattgaccatgtgtatatcttctttggagaaatgtctattcagtttctttgcccgtattttaactgagtcctttgtctttttattgctcagtggtaagcagagcatgtttagaaagtacaatttcaagcagcttggggtattcccctggttggtagtgtgcttttctctatcttcctcaggcgagaagagtttttatttttaagactttgaagatctacaggtagaagtgtaatgcctcataacttgcccgtctgtttggaatctcaagggaaaaagaaaatgtggcaggaaagagcagtggttttccttgcagtgaatccagactacagacgctctaggggagcttattacatagtgtccctaggagaatgggagaatttgctctcctgtaacctaaggaaattggctgtgcatatgcatttatggaagagcctgaccgttttctctgcatttcctctgttccgaggcaggtctgcctttgccgacggagctttgcagctataaattagacagaagtgcagtattgaggctgtccaagtgcaggcagggtaattgctctggacaggtttacaatagggaggtgtgaagtgcttggtggagaccagaagctgggggaagggaggacgtattgaacttgggcggctgcagggtgatgggctgacagagctaattgaaaactatggccccggtggcttttaatgggaaagggagccgaggcctgcagtggtttcctttagagcaagaaaccagaaggaaaatggctcattgagctactcagggagttagtactaaatctctgcaggcctctgggggtagagggtcaggttttctgagttttgtttttaatttcttactccttagtcccattctagatgaactgacaggagggtggtggtgagcttgagaaaaggcctgcggggacatactggaaaaaaaagctgacccgtacagtggagacccttggagatccatgagttagggagatggtcagcgggctgaactgcctatagacaagtgagataataatgacatggtagcctctgttagtcctctagtcagagtttatggtgccagggcctgggaatctgcattgtaaacagctgttggaggaaattgctttggagtcttaaatgtgagggcagactccctgaaggcacagcctaccttattgacctgtgtggtcctcctggcacgcagcaggtgcttaataaacacctgtgtgcttatttccaaaccaactgtgagttaccgttgggttttctttcttgatagtatccaggacactgctttctcatgtccctgaaactcctgcctgcgcacacctgtcgagataaccatgggttggctgtcctacacatctgcccttaagttaactgttattttctgccccattggggttaactggttaccttttcaggaccacctacatgcactgaaattagttgtgtattaaaagcaaaaacgtagaaccaaaaactggatttatctccatttatttccaattccatggtagcaacgtgcagaaagtccttttcaaaggcggcaaataaacggtgtggagatggtggaggtgataggattttccttgagatgtgctgtggttaatgtgtaacctctttcataagacttatgtagatgttgatgcggccttgaagccattgcaggcccacaaactcaggctgtgtgtcgtgtgt

SEQ ID NO: 106774 - DNA, 1046 bp, Homo sapiens
aaattggagcacatgaatcccattgtttaaagctgttactgtccacctgcccctcatcgcgcttcttacctggccccacctgtcccagccaccacgtggggctttttaaaaagactttttaaataccaccatgtcccatgtccctcacccaccatttcctctgtctggagaatgggtcttccctcttcgccttgcagatttctgttcatctgtcttaaacgtttctccccatagaaaccatggctgacgttccctttaagttagattcccatcgtgaggattctgcagtgctatgtatagaagttttgtgtgaatgtttgattcgtttctgactaccccattagtctgtaagctccctgaatgcagtgactggctttgtttccaatccaccattgtattcccagaatctagtgtgaagcctgtgacacattaaatgctcgtgacagataccagtgtagatagagatagtggcattcattctgtagagtcctgtatgtcctgtggaaatacctctgccagatagaataattcagacctcccaggcttcatctgtgtatttcctgaatataccttgcttgtttagtagcttcctatacccctcaccaccctccaccaaagtctcttaagtgttgagaaacttagaagaatggaaagaaagaagaaacaaatagaaccgaagttgaaaagatgacaggctgtttacctgccacatttagaattggcggtctttttggtctctctgaattttggaaaagtcccatatgcaagaattgtcactgaagtggctttgtagttaaagcagtgcatgtgaactgtccccacatgaggtcctcgggcgcctcgtccctgctggattgctggtggctgtccttggcaggtgggccaggctcaggcgctctcctctgtgttgcgtttggcgagggagcccgcggtgcccttcccagctgttgacatggtctctcatctgctcttttgctggagccgcgttttggagcctgcttttccagagttgacactgcaggggagggtggcttcttccatagacc

SEQ ID NO: 106775 - DNA, 1047 bp, Homo sapiens
ttaagcgtttgtcttgagctctttaagttcaggtgccttgctaaccagtgaaaagcccagagcagtgcagtatttcagggtcttcaggggaagataatgttgtgtccttgtcttctcagagtcctgcattccaggcatctggttatgaggggccatggttgtggggatgcagcagctgtgcggttcatgacgcacggtggttaagaggcagctctggggcctggctgcctgggtgaccttggcaatttactccacttcagtttccttttctgtaaaatggggataattgtagtgccgacttccttaagcttgttataaggaaaaaaatgaaatatttaacacagggcctaacacacaagcagaagcttgaggaagggtagctataatgttattattataactgtcgcaataatagtgtacctttctgcagcaggatatatctgtgttaactgatcatcaccatcttaactctatgaaaaatattgtctctgttgtatacatgaggcccagagtagttgaatgacttgtttagagtctagcacttgccagttagaattcagacctgcgtgtacatgtttagaagaaaatacggtaagactagcactgccttctttctggcctccctttgacgtctctgaattcctggaggccgattggtctttggtggcttgaagcacctagtgtagttctggctgtacagctggtgctctatacatggtgtcttgaatgtgatcttgaagagcgtgtttctttgttggtaggcgtgtgtgtcagatccatttttggtttgcctgtttggtaaagggggtggtaacatgcacatatgttttgccatctgttgtttattgtttctgttaggttgtggtttgtgttcctgttccatgttcctttggtttctggagcaactgcgaatattatatgcttggggatcaaaaaaagtaaactatttataaacagtaaagtatccttgggtttggaaagtgtttttctcaaatgcgtgtatatttgttggctttatgatcatctcactgatgaatcgttagataa

SEQ ID NO: 106776 - DNA, 1070 bp, Homo sapiens
caaagatgacctttttccattgtgctttctgagctcaaaacaggccaaatgatgttcccacccttcttcgagcctcgtgtgtcagtgtcacacactctccctgttactcacttggtctcgttctggtgaatttattgttgacatctcgtcctttcccggaggaatctctgagtctatctgattaggtaactcttcacacatccctgtatgtgtgtatgtgtgtgtgtgtgtttctctccacttagacttgaaagcagcagggatcattcaatttcatgtacctaggagtcccttgataattatttgtttattgccttaccactttgtcttggagcttggtacattctttcagggcagaacggatcccccagtttcattgtttctctaaggggttctgaggtttacccctgaagtgtaatttttcctgattggcctgtgtggaggacttcataggagtgtttttagaatttaaatatcaggagtaaaaggccattttctttgtgctgagggtctgttttcccctctggagccagcggctaaatgcagaggctttcttcaattgctgttgcttcttgcagtgtggcccctcaatgagaagtcatagcttgtggtttgtctgattttatatgtcagaacttttagagagaatatttgacctaaaacaaaaattatggatagtcctctcttcctttcccatttctccttattttctactttctgcttgagaaccacttcaaagaatcagatgtgttggtgccagacgccgtggagttattgttagaagaatttggaaatataattgaaagcaaactttgttgagcaaagcagatctaggcaagtttttactttgagggcgaagggaattccaagtttttcctctatttggagctgatgtctcagaacacttgttctgtgagatgaatcatctgtgaattctacatctgggagttatatattgggaaatggcattctttttaaatgtagaagaaacacaaaagcgtaaagttacagtgtagttggaaaattctagtcagagtttaaaatactagcattgaggtgaaattggcaga

SEQ ID NO: 106777 - DNA, 1004 bp, Homo sapiens
ttaagtttcacgagcaagcctaactttcaattccttttgaatgagctatgtgacatttactcactgggtacgttccccctcctcagtgactgcaatttgaaaccctgggggtcttttaaaagcgaacagaactctgggccgtgttaatattcagagctgtttacaatggatgcagtttcaaaggctgatggcattgtcttgagacaggagggaggacgggtggaggaaaaattcccaggcagggaagggcaaatatctaaaaatctccagtgtttaccagcctgtgggaaatttagggaccgttactgttattttttatgacttaagcatgacactgagccactagggttcattctatctacctcatggcttcagttcttgtatgtcagttatgtggttatcttgtgcttttgtttcaagttaaagtgtggaaattggtaagaaactcagatcttatctcctctggaaagaaatagagcactttgaagaccagtggttaacatttttataatagtttacctctgggacctgcatttatgttttgctcaaagaatttgatatagctgcacagtttagaagagcagtcccgactgaccaattaattgtccaattatgactaggactgagaagttttttgctgaaatacttgatacatgaccattcttattaagcaaaatgaatggatcaataaagattgcagaaaaaatttgcagtttattgatggtctaatttctagttgaaagtcggcaatttgtgtctcttttttgtagggggtggtgggtatgcttgtgaacttttcttatacaaaggctttttgctttatatgttcttatattcttatattttgtataatttgttatcaatggtttttacctaagtactttatgcatagtcttttgaaacacaagttataacttcaatctgttcatagaagtccttcagttttttaagctgtttctccatttcactgggttttatacttttcatttcctgcctttagttct

SEQ ID NO: 106778 - DNA, 1021 bp, Homo sapiens
ttgtttggaatagggagcattttaaacacaggttaattgccaagaatacagtctgaaaggtgcaagtgctcttagagtttcagggaactttagcttgagctcagagtccttttcttttgcaacaagtgtcttccctcttgttgggggataacttgtctgttgatagctctctgacaactttttttgagtaaggtgagatttctggcaaataatattggttgtcgtgagaaaaaggcacactgtttaagtcttgctgatatgaaattgtggccgtaatatctattctttgagtactgctaaagtaggaagtgtccagagattcccagcgccccatgtaaattaactgtgtattggcacacaatgtccctcttgcctttaggacatgtcagaactgttcctgccccgcttttcaagggactgttttaaaaagtagtgtattgtctctttgcataattatatttggttactagattttacagactttggacttttgaacatattatcagcagtaattctcggaaccatcttcagaaagatgaagaaaaattaagtgtagtgtgatgagagctggttcctagtggatgtcctcatgtcccatctccccagctctgcaccgttagctgaaagctttcctccctccagtgttaattactttgcctgggttctccctgcagcttccctgagtccattgggacggcctctggctgacctttctctccctcagacaccatgatcacaatgaaagggcctctcccgcttctgcaggggtgtctccttggtgcaaagtcttcagcctcctctctttcagggtggacaggaatgcaggagagagcactggggttttgtgtgacttaacaatgcacctggcccagtgctgtgcacctgctaaagccctgaaggtctgttagataggaaggctgggtggaggttgtttaaaatagcctatagttatttaaaaagtggcatgcacaggagagggaaatctagaagagggattcattgaattgaaagttgttatatg

SEQ ID NO: 106779 - DNA, 1169 bp, Homo sapiens
ttacagagcagtgttctaagtgatttacatttattaacttatttaatccttccatcaccataggaggcaggtatcattattatcttcatttcataggagatgaagttacataggaattgtgcagctcactgtcatgaggacacacagactcagctggttagagcagaactggagttcaaattccaacggtctggtgccagaagctgagctttcagccacttggctaccctctccctcatggattatcattcttttcttactttgaatgtggatgataaattttttttttcagtttttgcatgaatgaaaatttgcatctatatgtgcaactacttcagccatattgaatagaatggtcaggcgattacgtcaacaggaccaggtatacagacataagaccacttaaaaagaaatgggcacacccattagcatgggtgttatccaaaaaatggaaaataacagtgttggtgggatatagataaattggaaccctggtgcattgcttgtgggaatgtaaaatggtgcagctgctatgaaaacaatttggcaattcctcaaaaagttaaacatagatttaccacatgagccagtgattccactcctaggtatatactcaaaagaactgaaagcaggaactccaatggattcttgtactgccatattcatagcagcattattcacaatagcaaaaaggtggacataacccaaatgcccaccgactgatgagtagataaacaaaatatagtttccatacagtggaatactattcagccacaagaataaatggaattcagacgcacactatgacatggatgaatcttgaaaatatatgccaagtgaaataagccagacacagaaagacaaatattgtatgattccatgtatctgaagggcccagaataggcaaattcatagagacagaaagccaggtgctaacaggaggagggagtggggaagaagggaattgtttaatgggtacagagtttctggatgggatgataaaaaattctagaaataggtaacggtgatggttgtacaacattctgaatgtacttaatgccatagactatatatttaaaaatggttaaaatgataaattttatgttatttatattttgccaccagtgaaaaagacaaaaaaaaagagaagtaagtggcaaagagagacc

SEQ ID NO: 106780 - DNA, 1048 bp, Homo sapiens
tttcttcctaccttctctcttcctcctcctcctcctcctttctactataaatgctgccatcatgaacatctttgtggcttaacatttacacatgtccctgatgacttctacagaatcaatttgcctctcactgctttggaaaccactcgctgtcacagaatttaaccaagaccacaggtccagcagcaaacacacagacatttcaagtggaaaaatgcgttttactccttctagtaacaccggtgggagagtaaggttgtaggagaagcaaggcaggatagccaattctcacttgagatgtggttttcacattgtctaaacctgtttgggcacatcagcctttagcagggagcaactttattgtctcttctgccagaggcttcccaaaattctcaacttcttttttagttcccagtgaagagtcttgacatttacagagagttaaagaagaaaacgatgtgcttgtggacaaattaaaatagacaatgccaactggccgggagtcatcatttctgtatatgagaggtggggagcccgatcaaagccctgagtaaacagcttacagacacaaaagacaaagtgttttgttttctgagcactggaaattcaggaacaacctgtgtcagattttgcaacctttgcaagagtttgggtatcataacatagcgatcttactcttggagccattacagagccaatcaccaaactaaccaggttctttaacctggaagctaaagatggctatggaaccggcccccccacatcagatatacatttggggcactggggagcaagtggggttggaatgaaggtgttggtgacaacatggtatatttgcaaaactaccaaagtcattccctctctcacctttgacaattgctgactgtatactgacattttgaacttgaagcattctccaggtgagcaaaggacaaagggagaaaagatatgctctagtcaaagaaggaacacaccttgtaaatgtgggaggtgacttctggcattgtattctcaagacataaggggctgagctgcaggaagaagccac

SEQ ID NO: 106781 - DNA, 1110 bp, Homo sapiens
aaggttttcataatccactggccaatttatagtggggttttagaattgatttagaattaaatttaaacttgacttctaccatgtagacaaaactcctgaaggatggaggtagcctggtataacagaatgaacacagatattcccgtcagaagacctgggtttgaatcttggttctgtcaatccagccatgtgacattaacccctagtaataatgtacattatcctatcttggagatatttctttttgtcagccaggacataattcaacctatcttgcatgaaataattaacttccatcagtactaatatgccaaccaatgcgggatttccacccagccgtcattgacactccctaaatagccccttaggaaaggactgtcaccattataatggtgataatatatcactgctagcgataatgtacctaacttgcttagcccagttattagcattatttataatcattactattgttattcatcttctcttccccttaatcaatacgatggagaacatgatgttgttctcccttaaatttgttgtgaggatttttaaattagataattaataggctacacatttggtgcttatgatgtgctaggcatagtctaagtatcttacatgcattaacttatttgatcttcacaacaccctgtgaggttctccccatttgacagatgaggaagctgaggctcagagatgaaaagcacattacccaaggtcacacagctattaaggggtgaaactggactattgtaggtgaagagctcagtctggtacctggcagacagtagatcttaatcatggacagcattcatggtgttttgtgtagagagaacctttcctaaggggctgtcttgggagtgtcaatgatggctgggtggaaacccacattggtaggcacatttgtactgatggaagttaattctttcatggaaggtgggttgagtgatgtcctggctgacaaaaaataaaaaaaatctccaagctatcagctgcaaatgagggtggacatatatttaaataggcgttggacccaattcatcccatgtggtccccaaattaataagatctatacataattgtcatacttagaaatgtttcctttta

SEQ ID NO: 106782 - DNA, 1116 bp, Homo sapiens
gggcggtccggcgggaccgggatggggaggctgggtacccgccggcgctgcgccccaggaggcagcgggaggcggcttgagggggcaccggcggccgccgttgttcgagcttccctcgtgaggctctgccctcggctctcggcggagtccgcgcagacgcctctcctgggctgcgagcgcgtttcctccgcgagcacgggtgccgggctcgccgggctccgcaggagcaggctggcctttgaacttgttccgccgatcgcgctccgccctctgtctcccagatccttaactcgcggtcccacgaggtcgtgcgtatatccacagacatttgtatatatcttgtagggggaaaaagcctagcaagcagacacacaaacagaaaaatcccgcgatgccgtaactggctcggcacttcttgtagttgtacgatttttctcctcctagatttaagtaagtcttccccaacaccgaatgggattccatcttcagacccagccagcgatgccatggaccccttccatgcttgcagtattcttaagcaactcaaaacaatgtacgatgaaggacagttgacagacattgtagtggaagtggatcacgggaaaacattttcctgtcatagaaacgttcttgctgcaatcagcccttacttcaggtatgatgatggtaggaacttctgttggtatctgcaccaagctccctttccccctcagtattgtccacttgatgtttatattgagatgcgataatgaaatgaaaccaatgactttgtttcttgagactagaaaacaagtcctctcttaactaagaccttcttttgacttgagggattcttctagatttcgggtgattgctttttaagttagtgggcctgtgtgtgtgtgtttgaggtaaatgaccagaaaatctagacttgtgctggtcagtatggaagccagtagccatgtgtggctgtttaaacttaaattataagttaaataaaataaaacatttagttccccaggtacactaaatactttttgagtgcttgctggtcacctgcagctagtggctgccatattgggcagcacagaaatacagcattttcatcattgacaattttattggacagtgctg

SEQ ID NO: 106783 - DNA, 1202 bp, Homo sapiens
tgcctacacttccagagttattcttacagaggccaatgttcaagccttgttcactgcagctagcatcttccagattccttccatccaagaccaatgtgctaagtatatgatcagtcatttggacccacagaattctattggggtctttatctttgctgatcattatggtcatcaggaactcggagatcgatcaaaagaatacattcgtaaaaagtttctgtgtgtcaccaaagaacaagagtttctccagttgacaaaagaccaactgataagtatactagacagtgacgatttaaatgtagaccgagaagagcatgtttatgaaagcattataaggtggtttgagcatgaacagaatgaaagagaagtgcaccttccagaaatttttgctaaatgcatacgttttcctctgatggaagatacctttatagagaaaattccacctcagtttgcacaggctatagccaaaagctgtgtagaaaagggaccatccaacaccaatggctgtacacagaggcttggaatgactgcttctgaaatgatcatatgttttgatgctgcccacaaacactcaggaaagaagcaaacagtgccttgtctagatatagtcacaggaagggtgtttaaactatgcaaaccaccaaatgacctgagagaagttgggattcttgtatcaccagataatgacatttacattgcaggagggtacaggccaagcagcagtgaggtctccatcgaccataaggcagaaaatgatttctggatgtatgatcattccaccaatagatggctatccaaaccatccttgcttcgagccagaataggctgcaaacttgtctattgctgtggtaaaatgtatgcaatcggaggtcgtgtttatgaaggtgatgggagaaactcactaaaatctgttgagtgctacgacagtagagagaattgttggacgactgtttgcgcgatgccagttgcaatggaatttcataatgctgtggagtacaaagagaagatctatgttttacagggtaggtgcctaagtgatttagtttttcatggaagggtaacacatcaagtggtggtttacttaattatactgaaacagttgtgttcccgttaattgaggaatacctccagcttccttatcaaactattggaacagtctgttctgtaaagagctataaagaaaataaactcttgaattaaaa

SEQ ID NO: 106784 - DNA, 1840 bp, Homo sapiens
tggctaatttttgtatttttaatggagatggggtttcaccatgttggccaggctggtctcaaactcctgacctcaagtaatccacccgtctcagcctcccaaagtgctgggattacaggcgtgagccactgtgcctggccagaatcaagctcttaacaattctgccatcaagcccaagtaactccttgtaccttcccaatacaaacctcccaattcaggttgattataatattatctgttatattgtgtcatggaatgacaaagttttaaggtattttgtaacccatatgaatgtatctctggagattataaaagaaatgttttagaaagtgaaatatatagcaaattatgccctttaatctttagaggttgtagttacaacatataaccaaaaaccaaacataaaaatttacatattcttgttttcttttttttttttttaggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttcagaaccagcagaaaaaattccctttaccaatatgatgacattgctgaccagtggatgaaagtgtatgagaccccagatcggctctgggaccttggccggcattttgaatgtgctgttgctaaactgtatcctcagtgtcttcagaaagtactctaaatgagtagcaggccttagtgcatcactggcatctcattcttaggaaacttgtctttgatacaaaagagtgctgacagtatttcagaaagctgagagagttttatacatggaaaatgggtatgcttaaagattgcagggtagggagggattttccttcatccttgtgacatttcatttcagtaaggaaaagataacaaagtgcaattatcagcatttttttttcctggcataaaattaatcatttcattttataattttgtgataaatagtaactgaggtaccagatgaatcaggacaactatgcactcttataagagcatttagggtattattgggtaaagacgtctaaacttgtttgatgtgacttttaattttaaatacgggtaacaatctgaggcaatatcactaggactttagctgtgacctctctaacacagagaagcactaacttagatcctcattcttaatatttatatgtatctatttttgtgtactgttttcaagtgtactgagatttaaatgtgttctattattagagtagatcgaagaaaaaattagtctcagaaagagcttttagtctgattgtttccatttcccatgtaattttaagttaagctaaagttttaaagtggcagttttctgtcgatgactttttcaagtgctaacactgtctcttttgtgaaaatctggaaaagtgctcatattcacaggtggctggtgctagtctaacttaattcatgtgtataactagatggatttaaatggtctgagcctatgcctatctttcaaattggtgtggatttcatggccatagtactttacctgttgaactcttgtgatttcacaagattctctacttatgtgataggagggtatggccagttattcatctaactggactcaatcttagaatagtaggaacattatacccag

SEQ ID NO: 106785 - DNA, 1513 bp, Homo sapiens
aacatgaaggataaaccaacttatttgtatacctaaggcaggcatttggatcagtaacatgttttactaagcctagagtaattcgtaaagggtataagcataggacagattttgccctcaatcacaatatttgtattcacttgaaagcaaactggcatggttcgtattttaaaaatcttgcacaaattgtaatgtgatactgtgaaacaaattgaaaacattgcctctttgcatcacatacctcgtttttcagaaactttccaaactgctttacatagacctctacaagtagggaatgttttctgaagcagaagttaaaatggacagcatttctagaattaacattttaaaatctagtcttagctagatatgtggtttcttcttattggtgttgatagtatgtctgtaatctctgtataaactttgtcaacatttttacctccccagttttatcttctgttttgtttttgtttttatcatcatgatgttttggagttattactgtgtattttagaaatcattctttacagttttgcattgctgaggagagagaaaaaacaatttttttgcaagagatgttcatgtaatttatttttgaaagctttgttgaataagatttcctgccgctttttgacaatcttgtgtatttagaaaaatgtattacttgaaaacatgacatagaacattgagttagcaatttacatgggctgtatgttatataagagaatgacatactgtggctaattcaacagtagatttattcttttagcctgcacaacagttgatcttttggctatgacaatttgtatggagggtacgatctaagttaagtgtgtcaaaagcaaggcttaggatttgttatgggagtagaatatatattgaattttgtatgaagaactatttgtttaaattatatagctgggatattttgccactgttaaaatggattcagaagaggtcctagaaaagtaagattagtgacatgtgtgggtttatatttagatatttaaggtgcattttcatagtgtggtaagaccttaagtaaaaggcacaatgggtactacagaattaaaatgtaggtctaacataatgccagttccactttaactttgtttttgcatttgaagaatgtatgtagcactttcctatatatttgtcacacattgaaaactggactgggtataactatgttataggaaagtagaaattgtattctttattttccatctttgttttctgttctacaaagttgatgcttaagcatcaagctgattttattggtcatgagaacaaatggatgtgatcatgaaggaatcagattccctatgtaaagcagtttaaaatggaattcaatgttcagtgctcaggtatgtagtaagtactgtagtcctgtgggggcaaatgtgtagatatttttaaacattttgccataattgcacaattttttgcatttttacctgatgtcattgtttcttataataaaaccttttctgattgaaaacttccagtgttg

SEQ ID NO: 106786 - DNA, 1043 bp, Homo sapiens
acttctagtaggtagaggccaaggatgctgctgaacattctacaacacagggtctgccctccacagcaaagaattattcaacccaaagtgtcaatagtgccaaggttgagacacactgattcaattatatgtattaatttactatagtaaatatgggtcattggtataataaagacaaaaattaccaaaagaaaaagcactgcataaagttaagtgagacaagagtatacttattagataaatatattaaatttaaaaagatacaaatgcttttacacatttctctgagatcttgaactaatttacaaatgttctatgattgtgaaaacttatgtaagttatactgttcttttaataatatactttttggggggataaatattaaactgcaaaaaaatatggtaaatacaaacccaagtaagtttgttttaaagctgatctattcaaataacatttaaaaatctcactcagtttacattttagtgtctcagaatgaaaactcatcttagttttagatctttaactggaataatataattagttactggttctcaaagagcatgtatttcatggatatgccacccagttttgttcaatatatagaacttaattttttctataatatgcgttgtaattattgatgactttttcatgttgctgtaagtctctttaactttgaagtgcagtgtctaaaattctagtatttgaaattatgccacattttgttccagtgatgaatgtcaaacagtatgttgatctatattgaggtgtttcatgggggtgaagcttgctacttagaaaaaggcattgtgtaaggacaatcagcacctcaaaaacatggctggttaaaggcaacatggcagaactttgcctcctgagtatacaaaaaagcatgttccaggcagctaacagttcttcccaaactctaacagagtgctggagggggctaaattctgctcaacgttgtcatcctatgagtgctcaggctgcaaatatggctggtgagcttcaggttcttctgagtcatttcatccttggaagcc

SEQ ID NO: 106787 - DNA, 1036 bp, Homo sapiens
gcctggccaacatggtgagaccctatctctactaaaaatacaaaaattggttgggagaggtggccactgcctctcatcccagctactcaggaggctgaggcaggagaattgcttgaaccagggaggtgaaggttgcagtgagctgagatcacgccactgcactccagcctgggtgacagagcaagactctgtctaaaacaaaatttacacgtgtaactgtcatttaccttctggtccaaagactggtttgctcctgtgtccatcagggcttttgtttcacactctgtcattactccatgaaagccatgctttgattagtttctaaattccttagcctgctatctaacacctgccacagtcaaatgaatcaaagtgcacgcaggttgtgttaatgaaataatacatttttacatctgtgttacttacctatcagcacttaacaaattaccccaaaatgtagcagcttaacaaaaagaacagttattatctcacagtttctgtggtcaggaatctgggtgtggcttaggtggatcctctcactcagggtctctcacaaggctgcaatcacagtgtcagccgagctgtagtgatctcaaggcttgactagggaagaatttgcttccaagatcccttatatggttcttggccagatgcacttcctccttggctattagacccagagcctcagttcctcatcagccgttggccagagtttgccctcagttccttgcccaggtgagtctctccagagggcagctcatagcagggtagtttgcttcatcagagtgaaaaaagagttaaagggagcaagactgaagccacaggcttttgtaacctagtctcagaagtgacactccatcacttttgccatgttcttatctattagaagtaaggctgtgggtccagatcatactcaagggggacggattctacaaagatgtgactaccaggaggcaagagtgattgatctttgaaaaccattttagaagctgccttccacagcatttacaaagtcatatgttagtcaaaataatgc

SEQ ID NO: 106788 - DNA, 1061 bp, Homo sapiens
cagttgttccctcaacaggaaggaggaagcaagtggtagttaacgacaagggcagggtcagtgggcagtagagctatgccttcaaggagaaaccaggttgaatgctgcaaagagatggtgccagcatcagggtaggggctggtgtggaaggcacttggcaaactcatttttttcctttactttctcttattctctacctgtcttttttcttatgtctgttcctttttgagctattccccatgactctgtctcttgtctctctcttcatttgtctctctctctatctccctctctctctctctacccccctttccccttctgtaacaagtttctacctggtcatgatggctctgcatatgacccatttctcataacagatgagcttcatatttgaatatgagaatcccttcaaaaactgcttagttctgagcatgcctagtatatgcttaataattaaggtggtaattaaagtgtaactgcaagtataattaaaattcacttttgtggatcctagaattatgaagcaattaggcattttcacatggcactgaaggagcagctgggaggagagaagggttgtggttttctgggaaactgctccgtcccctttcttccctggccctgtccaccagtgttagcctggagcaaggcctcacttgactggggcacttgaagctgctacaggttgggagaagtggtaacagcttggagtcctcactcagggcagtgagcacagccagctcttcctgggcccttcccagcaaaaggagccactcccaaaacccctaggtaactgtgagaggactccaaaaaaaaaaaaaaaatccctcctgattgcaccttgagcagtttgcggtatctatttcaaccctataggaaagggttgttaggacagcaaggagatctatcaaaaagtacccgcccactcctcttctcgtcaagcacactttgtatgtgggaatccatctggagttaccccgtcggtcagcacgtactgctagctaacggatattgggaggtatccagtaagcaagtctgacaaaggaaagtggatgtttaga

SEQ ID NO: 106789 - DNA, 1060 bp, Homo sapiens
tcataaaatgttaggggtacaaagcatttagatatgattcacattcaaggagaaatctaaagcctcaaagctgcagtaacttccccaggttgttcagctacttgggaacagaaccgggtttaaaatctcagcttcttcctctgcaaaatggaataaaaatagggcaactctataaggttgctgtaaggagcagatgagtttttaaataatttgcaatagtccttggctcagtaaatgttagctatccttattattatctaaacccttgtcagtatctcgactgaggccacatggatggccaatgctgttggctgccaagcacggtgctaggtattaggcacatatcatctcaaagaaataagagctgctgacatagcagaagttttgcctctgattctcaatgaattattctgtttctgacataaagtaacaaggcaaaagagacatgaaaagttatctaaatttacaggtcaccaagaaaatggacctcctctatctaattgccacttgaaaggagactaaggaaggaggtgcaagggtacaggagcagtggacatttgaggaggaatttgctgctttagagaatttggcttgtttccactgaattcccctctcccagtggggagaaaaaaactcagttacttccagcagaggggctgaaatactttaggctttcgaggccatgctgtctgtgccacagcgactgactcctcccattgcaaagcgcaaacagccactgatgaagcaaatcagtttggctatgttccacgaaaaagttatttatggatgctggaatttgaatttcatgtaactttcatgtatcataaaatgttcctgtgattttttcctcccagctatttgaaaatgtaaaccctattcttaacttgcaggtgatacaaaaagaggcagctggctcaattttgcccaaaaactagaacttgccagccctgactcagagcactagaccaagaatcagacctgtcagggttaactggttgtttgatccaagcaaattgtctgacatctctgggcctcattttcctctagtgaattccttcta

SEQ ID NO: 106790 - DNA, 1092 bp, Homo sapiens
tacaccatcaccactcccggatggagccagtgataggcaaagagaacaggaggggttacactaatgactgtccctctgcatggaaggaaacatcccccagtgcacatcacaggtcttatctgccccaggagtgggctgcctttggtcgggtagctgccccactctaggcagtggtcatcccttcaggaacaagagcctgaagttgcttccctgagcagcagctgtgggtgtggccatttttataaggagaggttttaaaactgggcaggtaccaggactcgcatatcctaagtgctgccttatagtgtcagaacaccactgcgtgctctcgggtatcttctgagtgactagtcagttcatttcttcctgactcaatttccacttgaaagtcatatttgatgagccatcaaaaagagcgagcgagcacattgctatcaggacgagacttacaggtgattcagtctgtagtgtcttatagacgctaagtgtgtcccgctgagactcttccagagagcgccaccttgaggctgtcctgaggcagaactacctatggggaaagacttcatgagaaatgtttcagatgagggaagacagctttcatctcatgccaccttctctttattggcagtggctgcctgagcagtgctgtgccaagaaagattctgaggctatatcccagctcagtggaaaaagagttctatgatctttccagccacacatgtgggaaggggtggagggagtggaaattcgagccaatatttgccattgtcaattcaaagagaccataggtgggtttttttctcctagatatatagctgcttaccactatatcaagtcagaagtagggactgcaagctgggaaacaccagatgaagatgattcttgtcttcacctgaccctttagccacaaggccagaaatttggattgtatagagcaaaggtctacaaactttttctgtaaagggcaggattttaggctttgtgtctgtatattccctgttgtgattactcagctctgccattgtagtgttgaagcagcagtagacaataggtagaggaatggacatggctgtgtcacagtaatcttttttt

SEQ ID NO: 106791 - DNA, 1768 bp, Homo sapiens
atcccaataaaagtaataaaaggaaaataagtgacaaagctacaatgaaaaaaaattgatcaaggagtcaatgagtgcatcagtattggtgtatttctgattaaaatgttgatgtcagactgttttcagggtcaaagtgatcagagaccctcagattttaagagtcaactcttctcctgttcttaaagggggaaaggtctctatcagccaattatattattgtttgtcactggaaataactagaaatgaatgcacactacgattgacccattctttctggggatcctttctgtgcctgagttgtcacagaggcccacaatttattagttattcatacatttcgagaaaagctagttaccctgccttaaatttttcccaaaagatttaaaggagtgcatcttttattttcatactctgcttagtattccagaagaattaagtgatttttataatacgcagatgatattcatgctgaaatatgcaaaataccacattcaagattattttccttaatattctctgctgattgcatcagaggtctatctgagatactaagaagaagatttgacatttctaaatttgttagatgatcagatttgaatcttttaactaaatgtacttccaaggtttatgcctgtggttttttaattagttaattagtatattagtaaataccatgtgcatgcaggtcaatgaactttaggcattaaggaggatcaagagagatgtaaaaaaaaatgtcagctactagatggctgggaaaataaaatggaaaaaactaacaacataagacaatatctataaaatggtaacaagtgttatctgctaataggacctgcttctatcttagtaaaagtagccatcaggggatcccagacagccaccagactggtttgctgaatcttcagaaatattgataacttcacaatgtccactgtatcatgaaggaattgaatgtgatagctcaggatgagatcaaagagggcactgccttccaaatttatgcaaagaaaaatatacatagtgacccttcttagccactaccctctttccactattatagctcctctcttaccgtaagaatctgggatctttatcaagagagaaaaagcaagagagctttggacatttctggagtcctagctggtgtccttttcttcctcttgtgggaattggcatcttgtgtgataaacgtcctcggatagatacagggtctcacactcaacatgaaactaccagggatactcactaatattcatatgtgtgatttctgtgaatggagcagacccatagcaagacaagacctatcccaacattgtattgaccatgcctaataaagggaagatgaagcattctgttataactgtattcttggcactgatcataggtgaaacaatgcagaaatttgaagaaggtattatccataaagggaactaaatgcaaatcaagccaatgctttttagactaaggaaatgcagactcctaataatgtgtccctttaagggacaaaagtcagtgcctagtgtagctctgctcactttcattggcataacccacttttatgcttattcaacatggactattatagttatagtagatttagagatgtgagttagcaaagaagtagtataaaaggagaatttccaagttgagtctggaggataggtaagaattgaatcattgcaaaggaagaaggaaggagtgggtagaggatcagaagtcagtcatcaagtaagtcatcatccatacctgagagttggtattgggg

SEQ ID NO: 106792 - DNA, 1060 bp, Homo sapiens
ttcctgagataacagaacgaaacactagattgtgtaagatgaaacaaacacagtacggcaggacttccctgggcctctagcaaactaatgtggcttttagctctccaagtatggcaggtgttatgattctccagattttgaaaaattaccccagagcaaaagcccttttatttatgaatcattttatgagattagtgtttggggaaaaacactctgagaaatgtttctctgagaatcatgcatcataactgaggatcccaaaaagctttggttttttggcttatatttgtcaatgtttattaattgatttaattgataaattaatttgataactgaaattacttggaatttaaaaaataactcttaaaaaataatttgtatattttatggtatattttatatatcatatgtattatatattttatagcaataaatattttaaaaaatttttagtaagaataatgacattgttttacaggtttgtaaataacttttcacatttagcatgtctgtttctgcataaaatgttataacatgttttagttgaagtatatgaagaaaatctggcctcacagacatatgtgtttttcaaaatgggagtagttttgtccgtttgtttgtttgttagtttgtttgttttgagacagggtttgtttgttgcccaggctggtcttgaactcctggcttcaagtgatcctcctgcctcagcctcccaaaatgttgggattataggcttaagctaccacacctagccagggggagtttttaatgctcttttcatatagttctgaatattctttggtactacactaaaagtctattggtaatagtttattgaaaattagtttccatgtggaatctggaactatctcgatgaacttttcatattccattaaaacccattggtctgtgttacacattaagggagttttatccatgcatggttcaaaatcattcactgatgatccagaaaatttgtgattatgcagatcttccaaaggttgtctcatttcaatgtacaatataaaaaaaatcacatttgttaatattaccaccatca

SEQ ID NO: 106793 - DNA, 1179 bp, Homo sapiens
tataagtaaagtgaagaatttaggaagaagagaatagacagaataaggacagattggagtctaattagacccatttccctaggttcccctgactgctttcagaggtcaacctgaatggaaacttgactctccatcaagttactgtccccagaggatctctccataagatgtcgtttccatgctatcagttcagagaagttggaataaaatggttggttcatctcaattgatgaatttaaaatgcccaaatcttgttttgtattaagggtgttgtataagacatttccttttgattctgagattttcaggcaggatcgtggactcactaaaattatttcttttttccttggaagaaattaaaagggcagagtgggagggtatctttcgaggaatgctgtttttcacatgtcagttttagctattttggaggtacatgagttgctttattccaaggatcctggcatttgaagtcacacaaaagaaaataatttcaaactccaagaatataccaaaggtagaaaagtgagcctgagcagcttgccataatttcagcagaaggcaaatctggtcccaatcgaaccaatctgttggtttatttgtattattacaacaaagcccaagattgaattcctcacctgaatcacttccttattgactgaatctatttagactcccctctaatttagcagagtattttttattaaatccaggcatacaaacatcaattatccaagctgcatctcatttccttcaccatttattttccttcgttggctgccagtggattagaagacatgattagaattcatcaggaaaataaaaacaacaaaaaagaaaaacagtttcacaaaaacagatgcttaaacaagagcaacaacattcagaattaaaataacctgtgatttttttaaaaaagtccttatcttggctaatataaacatgcttgcttgatttttatcaacctcatgcctgctacagtgggactaaattagcattcgtgattggaataggcacagacaaaacctaatagttgcacttactgtgcttcacgtatatgctacagtgtttttaaatacaatgcagtacttaactatttgcaataacctttgcaaagtagctggcttactctgaaagttttctattttttcacttccaaccaatgtcagggaggaaaaaaga

SEQ ID NO: 106794 - DNA, 2019 bp, Homo sapiens
aaggactcctacatgtgtctgtaagtcatgttgtaggatagttgtggattggatagtccccttgagattctccttgctcttcaatatcaaattaacagagaaagaacatagttttactttgtggtgtatggacttttgcaaatcagtaacaagaaaatagtctattatttcccacaccatcccacactcatacttaataatactcatcctactactttgtttttcattctttcccttacttctcttgaagtcagagatgaaaatataatttgccaatatacagccaaatttgtttttggaacacattctagattattatctttctcacttaccaccagtgtggtatactgcattgttataaaacaaaatcacaaacaattttcaggtcagtacattttagtaaagtcagtttattacgttgcctattttgtagatgagatacctgacttgtgacaaatggttggacttatatttgatagtaagtcacttcagactcaattcaatttcattttccttttttcacccaagtccattttccccatttttctcctgaatttaggatggcaagtatgtactttatgctttgcagataagttggtttctgtgtaaccataataataaatcaagccaactgggtgctgctgcccatatcaaagcctacagcttcctagtacattccaattaattatcttcatgaagcaatcaaaccatccctgccttccttgcagtgtcttttctgtttccctcaccttttcttaaacatcttaaagagaaacatgcctctgtgaaatgattgaatggttcagcagcttttgattttcagcttctcatttaatcatgcaacctgtcattctaaatatttttcacctcacaattatcctattttcttttcctgcttgtttattgtccactctgtgaatcatgtcaataacagtttttaaatcattgtaaatcataatagtttgacacttatttggagaagccttatttttgacaaggaggaggaaatttcatatcatactgtcataaattgggggtcaaatcaacatagatttctcttctcattaacatttcagacagaatgctcctaatataagactttaagaaaacagtcactaagatttgagtttaaattgtttcctctggccttactagctaatgaaagcacattcataaaagaccttcccagataaaggaccataattttttgttaatattatggttcatgattttagttacatttctcagagccagagtcagacaattagacattctgattcactgtagtttgtaagccaatttcttatgtaccttcctaatgaataggcagaactgtatcttgtaagttcaaaggagtagaaaatctatatcaggagagaccgagataacatctgacctggtgttctaagtggggtgtgataagcgtatctcttcagaaaattacagacatgatttagagttattttaatttgttcctctcaacaggccatcaacagaaagtcagtttctttgtaaatttagctgatgtaaatagaatgccagcatcctttcatcacaggactgagtgcttggtgatagaggacagagatgactgagcgtgcttttgtaatatcaggaagcaagcaacctggaagtactcttaagtgtcataccattgtattctgatcctaacattgtgcagaccttttttttttttaaatccatgacttggcatagagagcacacagctatttcaaaggtttcactgaatgcatttcttataacattcacctgtgtgtctttattcccgactagataattctctctcaatacttttttgttatccctgagttccaggagaggtccaggccgtttgtgattatcccatgaagaacagttaaaggtagtggaagccccacctctacagaggcagagattaaccaggatggtatgggctccaggaacagaggttggaacagcaggcaggatggctcactggaagcagggctcagggacttcaaagattcttccatctccagg

SEQ ID NO: 106795 - DNA, 1050 bp, Homo sapiens
acagttgtacacatattgtaagatcttagtaaaattgtgttgaatgttcttttttttttttttttttttttttttttttgagatggagtctcgctctgtcaccaggccggagtgcagtggcgcgatcttggctcactgcaacctccacttcccgggttcaagcgattctcctgcctcagcctccagagtagctggggctacaggcgcacaccaccatgcccagctaattttttttgtatttttagtagagacagggtttcaccatgttggccaggatggtctcaatctcttgaccttgtgatccgcctgcctcagcctccttaagtgctgggattacaggcatgagccactgtgcccagcctgaatgttctttttttaaacttccctgtcatactttattgctcatcagagctatttagggtgaaagaaaaacctcaagttttgaagcttagtctctgagactcaggtagggctgacagccattcagttctgttctgcatttacttgcctcatttgagtaaacttcttcctgccttgaaggactgtactatatacatgtggactgatgactgtgcaaatcttctttgcttttattcaaagaattgaaaacatttctcatcaaaatatcctgctcctcaacataaccgaaatagactttaaaaagccaattttaattatttttctagtccagtttatgtcaaggatgcaattcagttctcttgacagtctttatattctaattaaactcttccaatttgcaatttttgtcttcattcttcatttattaataaaagccaaatttgacctagatatgtaatagtagatgacaaaatgtggagttgctaagcccctttctcccaatgaatactatttatctttcatttttatagcagtaaaacatttatataaacataccatagtggaataaaagcaacagtctggtgctagtgatcttcactgtgattgacttctattacttgcctatacatttagtatgtttgtgcagaaatgtttctcaaggattttctaacaggtgatgttattgaggtc

SEQ ID NO: 106796 - DNA, 2451 bp, Homo sapiens
ccaccacacctggctaattttttgtatttttgtagagatggggtttcaccatgttggccaggatggtcttgatctcctgacctcgtgatctgcctgccttgggctcccaaagtgctgggattacaggtgtgagccactgcgcccagcatgccacctattttaattagcagaaaagagtgtcatgctattaaggaatcaagtatttataaatgagacatttcaatactggagaaaagtttattttcttgaatatggtaagtatgttctttacagtcttactgtaatatatatttttttactcagcaaatacttttccttaaatattgcaaaggtaaattgtggaagagtcctccatattcacattctgaacaaatggagtttgaaatgaagagttttaattgtttgtgcagagccattattagcattttgggtaatcagagctttctttttcacctaatatattctttcttatatgtctgttttacttgctttcaagtatgttttggttattgtacaaaccaaccttaatgacctcaggtgctaatatgacactgagttttataagtagtgaaataatcatgattatgggattttgttattgtttgcttgttttttttattcttttagctcaagaaaaagcaaacattttaaaatactaaagcttggcaatcttgtcttgtctaacctcctggaatagagacttagcattctctaatactctcagagtacagaatctttctcataggaattgtgtcatatattaagtgagacagttggtaattgagttatattctttattacagaaaagcaggatcttcctgagctggaattcctctctaactgtacattaaaatccttttgagcttatagtaatattttacaagtctctatttgaggctaaattttatttttgggtcattggaaacctcgacagctcgaatgtttatgcagtatcatggtgtccagtgaaaatttactacacctgttttagagttcaccaaacaggacaaataagagatataaagagatttattataaggtattggctcatacagtcatgaaggccaaggaatcccacaatctgctgtctgtaaggcagagacccaggaaggctggtggtatagtttgaaggcctgagagccagagagccaatggcttagcatccagtctaagtctaaaggcctgggaaccagggatggcaatggcagaaggaagatgccccagctaaataatcacacagagagagcaaatcctcccttcttccacctttttttttatgcttaggcccccaacagattggatggtgcccacccactttggtgagggtgggtattctctattcagtctatgaattcaaatgctaatctcttgtggaaacactctcagacaccctcagaaataatgttttaccagatatccggatatcccattttccagtcaagttgacatataaaattaattatcgtactttccaagcatcccaatattaattctagggataaataatacacttaggacagaggtgtgggtcagtccactgataatacccagatcttattctgtatgcctaaaatgatgctaagtacaagaaggcaataccaagtaaaaataggaaactctttgccctgtaattagaaaaacaaagtaaattcataagtcagttaggaagccataaatcatagtaatcttatatgacattgaatttaaaactagaagagcgcttaattcaaatgcaaaatgattctctggctaaaggtgtgggggaaggggaggcgattgtgggtggaagatgttgagtaggctcaatgagcagccttgatagcagaagagttggaagggtgtaagagaaggtaagggcttttaggctggatgattgagcaggagaatacagtaaagagattgttcagattggctaaaagtggaatgctaagcaacatattcagccagataaaatggggccaaatcttggagggcaaggaatgctgctgccacttctataatcatcgttgtcctgcagcagttcatttggggtcctccatcaagcagcagtagtgagaatggtggtggcagaagtgatgctggtggttttagtaacggccagcaattactgagctcttatgacttgccaggatcttgtacttcatgtggattattgtattttaagacatgattatctattttacagccaagaaaaggaggcatagaagagattcataactaaccagaggacacagagctagtatgggtatagctagtatgttgagcccgggcaattttacactatattccgtatttctaaacacatccctgtattaccactggacagtaagtagctacagagagcaacagttccaatgcatcatcctacattttaggagggatgttggtgactagagtccgtccagagaaggataactgggaaaataaagagtccttgaatctctgtgaatg

SEQ ID NO: 106797 - DNA, 1694 bp, Homo sapiens
gccgtattaccaagtgggatgtatcctgacacacaaagactgtttctatctggtacgttaaaaagctatcgtatcatttagccttgtagtccatgtctggtattttgtcttaagaaaataataccagcatttttgatgccagaagatgtttaacacaggattgtattttcaggcagcctttaaaatggcccctagtgattgatccttatctcttgttgttcaggctcttgtgtaatcacctccccttgcatgtgggctttacctgctgactcacatctaatgaatagaaatgaaataattcggttataaaaaagactgaagcttcagtcttgggggctgctgcttgctctctctgtttacacacagtattttttttaaccacacctggcataaaacttctccccactcccagaaacatactagaaggaaatatacaaaattaataatactcaatgtgtttaagtgttaggactctgtcatttgatctacttttttgtgtttttctatttcctatcttgatcatatattattttacaaaatggcaatatttaaaaggaaaacaataaataaaagaaaagaaaaagcaaagaaaaaggacaaagtacatgtaggtgtttaaacacaggtaacatttgaaaaacatttgattgtttagtgagaaaaaagttgaaatgtgtgcatttgtatttaaatacctacaaaaatgtataatttgtattcaagattatataatattgaaaatttgtgtggtggtcatacatcacttataatttttttaagcactaaatgagatgtttatacaaaaatactggtaaatttttacctaacacttgctgatgaaaagtatcatgtaaatttctagtaataatattgatgatgatatagtgacaacttagtaaaagtcctatagtaatccaggcaacagacttgactagcacatcgctgctagttggttcctcccaatccgaatccttcaaccagtgaagatttttgaatcgttggtcttgtttggctacaggatttttataaatgccattcaatgaagatttgccctctggccttcttgatgttggtttaccctccctcctccagtctattatttagcatggtgatgccttccataatgactgagcccatctccttgtgggctctctttggggtccactatgggtcactgtgatatgggtgtctggcaaagggctggaaagcaggaacattaaattacttcagtttcagaccacttactttttctcctgcaggaactgaagcagagcaagattttgttttcctgctcattcattattagcagtagccttgtctttagaaaaaagcaggttatttttctcacttttgagcctttggttcttaaaattacctgaagcactttgagacttgacttcatttcatatctttctgtgatgctcaaaactaatgtttgcccttaatttttttagaattgctcaaaccaaataaaatagtttcccaagtaccaaatttactgctataacgtatgcatctcttcggatagcaaatacaatttcaggaccgcttttgggagacactattcctcacatacttatattacaaacagtattaatagaacttcagtctaaaatatatgaagaaaagaacatctaactacatttaatggttagtggaaattccatttagctatgttcgtgtttgttcctaag

SEQ ID NO: 106798 - DNA, 1039 bp, Homo sapiens
ttagtttatcaaatgtacattttgaccttgcaaatatcgattcatttatttaattcttaaaatacttgagcatgtctcatggaggaggtggcatttgagttaggtctaaacagatgagtaaagtttggatgaaggaagtgtaggaaatgtattcaagcagccaaaactacagatttagaattgtgaaaggtgttagaagaaatgtacatgggctgagtggaggccactgcaaaaattggacagtgtgttgagttgttcagttataagacactgctatcacttggtcacctataaattgggaataataggaaggaagaccttcctcatagaactgttttaagggttttatgagataagcaagtgaaattcctaggacaaggcctagcacagagtaagcgctcaataaacgctacctgatggacataccatgaggccaaagaagtgaattagggccaggttgtgaatggcattttatggcaagcagagttagtttagttttgcacttatgtgttagggactagagataaggaagaaagatagccatgggccagatacagtagcaagccttctgggatgggccaaggcctgggaaatgatgttgttatcttttacaatagtctttccaaaattgtggattgggacctggtgattcttgagagaactccctctaggtagttaaataacaatattaaattaaatagccttgatttctccatagaggaatggatagaaagatgatgtctgaaaaaggaaatacagcaaatgccagatgatagtatctagatgatgggcatataggtgttcactgttcaatttttttcaacttctctgtatacttgaaaattttcacaatacagtattggggaaaattgagaaagtgtattccctctttagttctttttcaattccagaaaatctcaagaaagtctcttggtgccaatatggcttaaacactttgctttggctcagagccactggcagcctgtatctagttacaatttaataaaactattgtacattttcccaggtttggtagctt

SEQ ID NO: 106799 - DNA, 2947 bp, Homo sapiens
agagcagtcccttgtcatagagttttaaatcctgcatgtaattggaatgtctttcagcaggaaaggtacgactcatgaatgtcttgggtcagagagtacactgggcacttgggcagtgaacctgagtgctggctctgtagtgcagagacgttagacaaattatggaacctctgtctctccacttcccctccccttctttatatcttatcagataaaccccagagaatgctcactagaatgtttgcattgcctatattttctccaactggtagtgttgggaatgattttttactctcttctttactgtatagttttaatttttccttcccagtgggcctgtattgtttttactatcagatcaaaatcagtattaaagtatagagcgaggatgagaagctagatttcctaagtccttttctggccctgttaggatttttataataaaagtcctaccattgattcaatattacagtgaattaaagcactccgataatttggacctcagtttcctcagctgtaaaatgtgatattaatgacctcatcaggggaatgattaacaccagtgtgatcaagagggctttgatggaattgcagttctgtttccctcctgaagtgtatgaccttagaaaagtcacttcccatctctgaagtccatgtcttcataaaatggagttaatgaaaacctcacaaagttgatgtgaagattgatgagaataaggtattatagcactcagcacagaatttggtgtttaataaatgacagatactgctgttaatttctgctatcattattattgtcacttttattgtactatcatgtgattattgtgtgaaccagattgtaacttttacatagaagtttttcagatttaaggtgttattaccactgttattattcttagctacacttctactactggaaataataagacttcaatcagtagtgatttactaccaagaaattaattggtataaggcagggcctactgagatatccaatatcaatttttttttcttccttaatagtagaatctcaacaaaatgtcaattctatgatattgttccacctccctttcagctgggtggaatcacgtcactgctttctggccagtgatatgtaaacaaaagtgtaatgtgggacctctggcaaggctgtgtttaagaagctgaagcagctgggaagggagcccttttccctgctcctcactgttgcttggaatgactttacaatggcaggggctccagcagccctcttagactgagaaataaccttagaacggtaccattgcatggtagaggagacaaaccaaaggcatctgagttcctgatggactcctggtagcatcctaccatcccaggcctatctaccaccagtgttcctttatgtaagagaataaatccttgtatgtttaagtccttatatttatttctttgttcctagcatccaaatacaattctcaactaatttatttagtcttggtgcgaagagctttggcatactttctctcatttaccatggagtacttccaatagttctgttcttccctggtaaatttctttttcattatatcacaaataaacaaactgacccaaatttaaacttgacccttgagcaaatcaccaagcaaaagccttcataaaaagagtaaagaaagacacatggatgtttttcttgacatgcattttaggcttgttttgaagatggaatagttttagggaatggggtaattggcctgggaagtagatttgctgcctgcctggtgttttccttccaacagttggtgatagcatgaatcttgtgggttttctgtgtacattgactccagaaaggtcatagagaatgttgttatttcagaatacaaagagaactaagtgtgtttccctctacttaaatgtgcttcgtcaagcaggccacgttagcttaaatagttgagaatgaggaaaacgtaaaactgtgataacgaattcatattaaaacacacacacacaaaacagctgccctttgaatggttcactggtcaccaagatcagaggcaggttgaattaagagcatttggataattgaccttccatgtgaatgaattagaatagattagatttgattgaccacataacaatttaaatcataaaaaagccccttttctctttccaggctactttgttatattgggtctcaaaggtgattaaccatgtgtttttcttgttggaagactttcctgaacacaaattagcagactgaaaaagagatggtaatatttacatttgccatttcttttttaattgaaaaactcaaaggaccatatgacagactgagttgtttaacgatattccagaagggcagcatacttggagtgttttaatatgcattcagccgtctcttcctgactggtggggtggttcctgttactcagatggcctgggcagttgggatgggatgttctcaaggtgcttttttcccctccgacctttgctagtgtgtgtgatgtgatgtgttgaaaaccactgtataaacaataagcaccggctactcatttagagtcatggaatttcagagctgaaaagaatcttagacgttcagtgagttattgactctctttactttagagatgatgagacacagtcagtaataggaaatgccccaccctcagatgagaaatggaactgctgtgtgtttgataatatacagaattgttctcatgcagtaaagccctaccccctcgacttattataggaggcgttattcaaattggataaatgcttctgtagaaggatgatattattagtgcctatttcttagggttgttgtgagattaaaatgagtcaaatgtctataaagcactgttttggttattatttctgcatagcaaaccaccccaaaacttgatagaaccattttcttatgatttagcaatctggcctggggttaggtaggccattcttccactgt

SEQ ID NO: 106800 - DNA, 1086 bp, Homo sapiens
agtatatttttagtttctaaagcctgctgtgggaagaaaaaggagcaggtgaaaggaaggcaggagaatttcagagagagagagagagagattgttttttgaggtttgcttctgagacctaaagtgccccaacattataacaaaaggctgtaacaggagctgtgggagttatgagctaggaactgtggacaaaaacatacatatatatatgtaaaataataccacaatccccatttcctgcaaactaaattctgaatttctgagtcagagattcagaagcttgtatcatccggccccgcatgaccttacctccccttgctggcatgatctctaccatctgttccagagacccttctcccagaatgttcttcctctccctcctcactttgcctgcctgttatccctttctccttggaaatcttcccaggttctgtgaactggggcgggatggaccagatcagctgttctcagctgggggccatgctacctcccaggggacatttggcaatgtctagagacatttattattgtcattttggagtgggtatgctactagcatctggcaggaagaggtcagggatgctgttcaacagcacacaaacagctcaccataacaaggcattttccagcctaaaatgacactagtttccaggttggggacccctagatactagatgaaaattctagtactagtactagtactagatggaaggtcctccttttctgattgatctctgttttcccagtacctgatacataatatatgattccgaaaatattaaatgcacaaaccccttccccctcagaatgccatctttgtgcttcttccaataccgttatatggaattcgaattacattttatgtttttacttgccagaatacaagaatcacttaaatatataatctatactttcaagacttcaagcagatttatggagttggcaacagaaaatgagaaatgagttggcttcaatgcactgttaatgttgagaaccctgagtatcgtttggagcgttaaactcatgcatgctgtgggtaaattgttaatggtcgtatttcagttttctttatctcagagcttggaa

SEQ ID NO: 106801 - DNA, 1113 bp, Homo sapiens
cttgaagatacagtggctatcttcttatatcagggacataaccacaggtgccctgctttcttttgccctgtaatgtatttcaggcaatcgattgtcaagcccctcttccgattcgtcctggcagctctcactcatcatataacccatgtcactatgccatgccctctttgagttttagcaccatgctggcagctttcatagacttttaccatcaccttcaaaccagttgaagactgatccaccaatctcatttctacttctatatattgtctcagagattacaagcaactgatttctaaaagacaaagtaaagtagggcatctgttaatatatggaggtcacttttagagaaaaacaaataaatggaatttgcctaaatgtgattaataagaatattttctcgttgtgacagttcctatgcttccttttgcccacatttttctctcagaagagtagcatgtaagaaagtggaattataagttttgacttggagttgaaggagtgtagacatctgcttcttttctgaccactctggtctgccttgattgagggagatctttgagactggctttttgctgtgcattttgattgagttttcagcagcacagtgagtatgtaaaatcatagccatgatggttgaaatttggaattggggatgtcccatttgaaagaaatgccagatcaaaaagcgctattcccaggaaggatgcatacacacgcttgtaaaattgcacacccatgagggcttcttactttcttagagctgtgaatttttctgtttttgggcatgtgaggtgctcttgctgtccagaagaggttggtgcttatactttaagtaaagtgctgattgccctgtcagtcagagcatggaggaactgggaacttctgagattgatgcttgacagaataattagaaaaccgtcactttcagtaaccatttgaggactcctaaaaggaatgggcttgggccaggtctctgctgtccaaatccagaggttaaatgttcgggaacacaaaacatagtatgtcacaagagaaaattgcttcaaatgcacagaaagagatggccctccaactcctaaacaatgatgctcaattatctgggcattcaca

SEQ ID NO: 106802 - DNA, 1317 bp, Homo sapiens
taaactcttactccatttacttaaagcaagtggttttaattaaacacagtttatacctttatcgctgcacttggcaagttttgggaagttaaagactggtggtactgctactcggaagttatctgtagaaaacagccttaagtcttttccaaacaaaatatcattttaaaatgaagttgggtcaaaattcaaataaaactccctctaaaatgaagtgtgcaatatccactcttaatgtgtgttgtatcgtgtagtcaaaagactcttaatgattgcctgggaggttggtacagaagggatttttatttttaacagtctctaaaacacaccttttaatactcattctttttggaattctaagttaatttctattcttcatcactggtgcttttaaaaaaaaaatcacaaatttcagaattaagtgtctgagggatttatttcctaaataattgagctccataatgtaatcctttacaatagtcattacaaaggatttggaatacagaaaagtacacaaataaagtcatcaagctaggtgggagaaacaccttagtccgggaggtcaaggctgtagtgggctgagatcacaccagtgtactccagcctgggcaactggagtaagaccctgtctcaaaaaaaataaataaaaataaagtcatccataattccttagctcagaaataacaactattaaaatttgacttatctacttccagtattttcttttcatttctgtataaatgcatatttttaaaaattaaagtctagatcatactgttttttccacttaataacatactgaagtcattttatgacatcattaaatatttttctgaaacaagatttttagtggccattttattttccattatatgattacacccttatacttttagtcatttccccatgtttaagatacttagctgccttcctgtctttttgctgtcaccatcatcttagatacgtttagtagtatacatttataaatggaatttgaagtatatcattatccccactccagcccgccttggagacatgggactacattgaatgtttgtttttttaaccctacacctacaagttggaagaattttattttttgctatccttccctaaaatagtcctctggtgaccatttagttaattaagattgattggcttctgtcatctgctgaacaatgcattttgctaaatgatcccaaatattaaataaaaacctattaacaagtataatagatatttagacattaacagatggcttcagagggtctgcatataattaaagtaaataaatctaagtgtaatagtgacagttgg

SEQ ID NO: 106803 - DNA, 1039 bp, Homo sapiens
cttaaattagagttgattttcggtcactgacaacacagaaagtcctgtttcacataccatgagtactattcttaaccaaaccgagaatatgcctcagcacactcttgcgtcctatggtggcccagagctcacctctgttaacacttatttttatttccttccccatacgctttataaccccttatatttgaagatttttattctcttctatttctgtttcaaaatctgtccctgaaatgcagaggactgtatccattctaaagtgactttgttacccagatgagaattaaggataatcttccagataataggtagagttcatcaatgtggtttgtaaatgcatttttctaaagatcaactccctcatggaggacttttattttccttctctccaaaagtagactacatcaagttgtgtaatttttaagtgactttctataaactttatgaaattacctcatcttgagctcagtcatcgaggtagatctaattcatttttgtccccgttaagttaccatcaactgcttcttttcacaagagatttctttcctattactgctcttcgtgcatttaatcactcttagcgctttctttccgcctcttgatttataagtgttttgctgtgattcagtctcctgtctattcttgctacagagtacaaccttcatttgttatctgtgttccttgtgctgtctggggaaaaggacagtggtcagatctttcagtatttgacaaacatcgtgataatagagtgtttcaagatggagatgttgaatcaactttgatgtttggtcaagaaaattgattcataatgatatgtgacataaggtctttgctgagtttttcctcggtatgtatgaggaatgaaaaaaccactgctttttttaaaaatagaatttaatgttttcttttgttgttttttttttttactttgatggctctttgtacaagctccttttacagattactctgtggtcagagaatcagcatgtgactttttctagatattggataaatagtctttatgtcaactaccatt

SEQ ID NO: 106804 - DNA, 1213 bp, Homo sapiens
atttgtctgtgaaggcttactaatcagaatgtcagccatggactgtcagtgttgacaacaatttttaagctgttagaaatgcacagtctgtgttttcatgggatctccaggtgattgctgtgcacgttagagtttgaaaagccctggtctaaagtagggacagacaaactacagtccatggccaagtcctggccaatgcctgtttttgtaaataaagttgtaccggaatacagctgtgctcattcactttcttaaggagttaagaagttgtgaccaagaagtcctggtccacgtggtctagagcagtaatgctcgaaagtgtgtggttggacccatgccagtttatgtaccagtgcctgtttgtgagctgttttaggtttgtgataagtacagatactgagaataagcatttagaaacttgtattgctaattacccttgccatgacatgcaagaggaatatcaattttttagtaatttgcattattacattttataataatacaagtcaatgagttagggaattatttttaaaaattcattcatcatcacagattatgtaagaagcagcactctatgagtgtagatgatatgtttgtaaaaaaaacagtgtcataagtgaatgtgattgtacatcttgatgccaaagtgaacttccttatgggctgcggtaatcacattgtcctattctttgctcaccctgcttttccatgaatcttcctcttgtctctttggggatacttccttgaccttggtgatgctgtaaaatgtgatgccttctttctctctgtatgtcttcacttggatcctgtcttccctagctactgctcacagagtaagctttcgcccaggccaggccaattgctttactgcatccctgccattgtaggttactttcagggatggtctctggccacaagtccctcaagctagttagaaccttccccaggggttttctgtggaagctcatgaaagaggccacctacctctgggatcatgaaagaaaataatgtggcccaggaggctacattccctagtagctggtgaaagcctgtgtaagctccaggagcaaagctcctgccatgctatgatggaggctcctgccatcatagggcttagttcctctagcctaggtttccatgactccatggttttcaaaagtgtggttggactagcagcatcagcatcatctggtaatctgtgagaaatgcagat

SEQ ID NO: 106805 - DNA, 1034 bp, Homo sapiens
aaagggggcttgaaaatgccaggtgtttgttatttctgatagatttgtccaagcagacctctctgatagttgaccttagagaaagaaatgtcatcgccgttccatgatttggagttggagtttgtgggtaatgacatgaatgctatcaatgaaagaatctgcccctcggagttgtcctcctttctcttgtcttgacctaccaaagtgttctgagcaatgttgcttgctttattacagattttttttttttaagttttgtccacttaaatagtttacgcagcaactttaccctaatttgggtggcaactctctcgcaattagaggtcctttctgaatatcaatggatatttcatctgcatacccaggaacctctcctgagaatgcttcatttccacctttgaggtcttctgaaatggagcactgcaaacacacatattagcattcccaagggccatctggtacaaatccgagttaattatttttcttccagcttatctgtgggttttttcattaattgttatctctaagtattctggacacatccttttttctcaattagaactcaatagaaagtttttgagcaaacgtttaggtgtctgctctaatactgaaaggcctgaagatcgtaaacagcaagcagaaaatccatttggagctttaacccttgaccttctaggtttcacttgctcgttaatcccaagtagcacatttctctgagagggagacaaaagtgacttagaatcttccgtgtgtcattatgatccaagagtcttggcatttgggtagcaggtgtgagagaaaacaccaaaatcacctcatatttagatgatttctgatattttctgtgttttataacctgtgatcagtagttgcatttcatgagtggagccttcttctccattaagctgaacgaccaaatagttaatccaaatgctgacagtgctgaccaaattccaaagaatagatatttggtattcaaataagaagggtgaatgaagctaaagtaaaaaaatacaaaagtatagaaacatgaa

SEQ ID NO: 106806 - DNA, 1618 bp, Homo sapiens
ggtagataaaggtatgtgggagttattttatttttctcatgctatatcaggaaaatgaatgcacagctcatctcacagtactttttccaaatcttgaaatttcaaaaccagttaaaaaacatagaaatgtaatgagtattttcaatcctggcttcgtttcacaaaatttagagaacagaacctaaaaaatagtatagatgagttgatgtgattttgcaagcaaactggctgtagttttggcagtaattatttcgtgtccacctgcccaaaagtagaggttcctgagagcccaaagctaattatttcaaaggtgtcaattgtcttgttagatgtaaggattagttagttgaatacacagaaagtcaaaattacagaacaccagtttttgttaaacttttatcaactgatatttacaactgcttatttgcagtgtgtctaagataattctgtttagtaaacacgtcattcaataaaattattacaggttgacatatatttccactcatgatgtcagtcatagagctgaaaattttagttattttgcttgactgttaacccaaatgctgattttcacttggacctaacacaagtatctctacaactaatacgtttcttattattttatcatatatatgaaatgaagttcctctaccaagctgaataaaacaagagtctttttcaagataaactcacttactgaactgaattcatataaagtatatcattaaatattttataattctcttattttccagctgagcttgagatgagagaaaagtaatagagtttgttctgctggtggtcttcatcattttgatttaaagaattctaagcattagtattctttaaatcataaagagcaaaaatgtataaaataggaaatagaagtagggttttgtggttttctgttaagaatttaaagacatttaaaagaaaagcactatatagaatgttaaccttgggtttttgttttccaaattatactctggtttgtattttaattctgaacttagaattccaaaggtgtagcaaatgtaacatctggaatatgttgtgttcacttacacaaaacacctagtgttcacttacacgaaacatcttgtgaagtgaatacaaggaaaggacacttggcacgaatctctccatgaccccaactctgttggccaaagataagcaaatcttttgctctctggaggcctagttttgaaaagcaaaagtacacgattggcattagtaaaggcacctcattggatttgattgtacttcctggtttagatccaactttgaatcatattttctaagcccttgaaatatctaggaagaaatgtgctacctaagcaccaaagacaagttgaagaatggaagggactcttagtgggattcttatgccagactgcctgggttccagtcttgtctttaccagttactggttgtgggaccttgggcatgctatttaacttctgtgtgccttggtatcctcgtttataaagtggtaataatagcagtacttacctcagagggttgttttattacacatattgagacacacacgcacacttttcatttagagggaaaataatttcatatgacagtatcatttaaaaaatttaataaactt

SEQ ID NO: 106807 - DNA, 1035 bp, Homo sapiens
cacatttcaaattgttttaagattctgtgtaaaccatttttattttagttactccaaatttaattagtcacagtcataggcttttctagggaattggagggtcagaaaaatgaaaggtactttaccttgtgagtttctgctgtgttctggagttttttttttctctctcaaggaaagtaattttatataattaagcttaagaagcaaaataagtgcaattgatcaataaaacttagctctggaaaacaagacttttgatattaaaactctctacctactttcttaagaaaggctcctaagatgttggcacattttggttccagttttaacggttgggttgctggtgagcattgcttatattaatttgaaagaggaacaaggggataagaatattgtttttgtgcagtcatttgttcatttgtttctaagtttatccaggtaacattatgtaaacatgtatgactgtactaagtgtaaaaaagtataaaatcccactgaagttgggaagcctgtggttcaatcccacagatgccacattcaaaggaccatattctcagcaaacaaaacattgagaattccattctttactcctgtctcttaaagtatattaaaaagaatgtaattcataggtcctagcaacttccaatagcttgtttctctgcctcctgattctcttaagcttacactttgcagaacctaaaacttccttttttactactggcccaaatcggttacttacttaaacctttccttctttctgtttttcagattgatttaacttcccaatacatcctgttcctcattcctaagtcttttttgtttcattgtttgcatatacatgtcctgattctttatcctaaaagtctatgaactaatctggtttaatggaattccaaacaggatataaattggcctggcaatgacagagttctctcttggcaatatgggggagggaaaatgtttatggaccatttcatgttgctaaatgtagcctgtcttgtgtcccatttgcatttcacagtgaatggtgctggg

SEQ ID NO: 106808 - DNA, 1005 bp, Homo sapiens
tacctgggcatggtggcacatgcctgtagtcccagctgcttgggagactgaggcaggagaatcgcttgaacctgggaggtggaggttatagtgagccgagattgcgccactgcactccagcctgggcagcagagtgagactctgtctccgaaataaataaataaataaataaataaacaaacaaacaaacattatgatgacatggcatcacagaacactaatttctacactaagagagataataaaaggggtcagatacccagataccaataatgccaccctctccactgcagtctctccctgattgtatgtataggagatctgtaaatcaaggaaagtgccctgtagtctgtctcctattatggaatgagttttgctgggtccaggagatttccaccagctccagaaactagagacaattgtgctaataatgcctggcatcctggctttgtgactgaccagtcttggtcttttcgtgtcttataacttgaatctgaagcaccataagatggtcctgcacgaatcaagggcatggcccttgttttaaggattgttattgccattttttccaattaaaaaaccaaggcccagagaagaactaggttattttatcaaggttacagagttagtaatgtatgctggaaattgctaaaagtatatattttaagtgctctcccacaccaaaaagaaaaaccaaaaactatatgagaagatggatgtgttaatttgcttcagtgtagtaatcatttcactgtgtttaattatttcactgtgttatatgtatatcaaaacatgatgttgtatgctttaaatacacagttgtccctcaatatatgcagggaatcggttccaggaatctcagatataccaaacttcgttcatattgcacaattcctgcagttggccttgcagaacccatgtatgtgaaaagtcgaccctctggggctttacatcttgagaataaaaatccagctataagtggaccctcacagttcaaacccatgt

SEQ ID NO: 106809 - DNA, 1010 bp, Homo sapiens
atttgtacaacaagtgatgccgtgttgagtgaagaacaagggccttgataacatctatgctgctaagtcacccatagggaatttttgacacggagaaagaactgcagtccaagagctcttttttcctatgtgattaataatctgattcaaaaaatataatttgacactactaactgcaatgtagtttagtgactcttagctaggattataatggttgctaatgacagaaagttatattagctttgtttttgttaaaaagttatattcctgtaacagggaagtctaaggtgtggactggcttaaggcctgaagagaatcagggatttgctggttctccagccctgcttgcctccaaattggcttctttctcagccaggctctcagaagctggcagcaaagatggctcccagtgctccataactctccctcagcagccccataaatcccttcaaatgattctcattgaccctgcttgggtcacatgtctatgcccatgccagccactgagcaagaatcatatggtataggagacatacagtttcttaatggaagaagggacactgagtcaaaacatgcctaccagaaagatgcaaccttattgaaacaaaaataaactgttacttagtcaatagaaattaatcgttattttccttgtttgtccaaatgcagtgccaattcattcattaattctgcagccaagcaagaagcaatgttttatcattatttatttatttatctacctgcgcattcatgtattcattcattcattttgctagccactgtgaaatttcatgtcatatttcttctcaccttcagccagctctatctgtacacagactcctttttctgatgtctttaaagcaagttgtactccatgggaagggtgggcattttgtcccccagggaacatttttagtcatcacaacttggaggctatgctactggcgtggataatgctaaactacaacgcacaggatggtccctgttcacagagaacgacctcacccaat

SEQ ID NO: 106810 - DNA, 1144 bp, Homo sapiens
ggtcttttttttttttttcaatcttttcaatcaaataagtggtagaaatgatgtctagctcatagagtgttgtgaaaataagatgaaatcatatatgagtatgcatgcagtgtcagatacaaaataggctagtccctaacattcataaaatgaaattcctcttctcaggtagtctcagagtagcccaggaatagtatagatttcagacgagaacaagcaaagattttatgtttaggaagccattgaagataatatatttcatgatttatacagatgaccatccgatagaaatctgtgcttgctcatttataaacaagctacctttattcataaatattttttttaaagttgctatggctatcaaattgtgtgtattttataaagctaagaaaggaaggggaagaagctgtttcttgagcttatatgccagacactgtgataagcttatacctatattctttcatattgtttaccacaaccctgaaaaattaggagttgttatccccattttatagaggattgagaaaccattgtgactgtcccaggggctagtcagaagttacaaaagctgggatttgaacccatgtccctctgagtccagcgtgcatattgattctgatactccagactcaactgcagctacctgccttttctactttctcccatttaaactacttatttgctttcacgtacatgacctagaagtagtctccagtttggcagggaataccagtcagaattcatgttgacaattaaatccaagaaatgaaggagaaggtttaacaaaagttcttaaaggtcatatattgctttttcaactagtatacacaagcagcctggttgctttgcatgaagaaaaatggaaatgtagctgtagctatggagtgggataaaaatggctgcaatacattttttattcaaccctttgggaagcagtcacgagctgtgttctcgcttcagggaacaggggtatgggaaccttttcttagactgtgtttataaaacgtcatgagtctgaagtttgatttttaattattaagagaatggaagagtcttgagatttttttttaagggaatcatcataaaacattatatacagttcattaaaacataagtcttatgtgatatttttaagagcaaaatt

SEQ ID NO: 106811 - DNA, 1100 bp, Homo sapiens
gctcacaagataccagcttgctgtgtcataggcagtggagaaatgttggttgaaaagaatgaatgaatgaatgagtgaatttcaagcagaggtgagaaaaatgaagtcagggcataacagggcaaccttggatattcttgccctttgtggttaatgcctttgggacaagctattttcagtttgaacttgtgctgttcagtaactacactattaagcactttcatcttcctgttttgcaacaattttcattagacactcagtaattgttgtttcacagattatgggttggattgatgaatataataactgttttatttcagcacaataaggaaaacctagtcattataaactctcaaaatcatgtttaccttttacttaaatggagcttgtttgtattaatgattgtaatttatattgcagcataactctgctaatagagacatgataatttacaaaaagattaacaacgttttaggccgtactgaaaatattttcttttcttgataatggtctcttctggtgtctagaggagagctgagcaattccttttaatgaatagcagtggaaattaaaataattatgcttttctgtttttcccttcagaaaacctaactgaaaataaagacataacttgctatttttaaggtttcattaatccagcaaaataaattttcttttactgctttggtgtaattctatttcacttgatcacatttaggctgcagatcaaattacgaagctgtataatctcttcctgaaaattgatgctactcaggtggaagtgaatccctttggtgaaactccagaaggacaaggtaaaaaaaaaaaagaattgagaaaacaaatgaatgtattataattatttatgcaaactataaattgcacaaaagactgtagcagcagctttgcataaatttctttcagtaatttaatttctgccatagtttgaaatgctcccatgatgcagttgaacatttcagcacttaggtttgtttgtagccaaatgccaagcctctaaggaagctactgcttgttttacttaaaaacattcaggcttggtgtggtggctcatgcctgtaatcccagcactttgggaggac

SEQ ID NO: 106812 - DNA, 1081 bp, Homo sapiens
gactagcaaagagatgccaggaaagtgatctgttgaaaggaagatcctggaagattcctgaatatgtgctacagtggttggtttcacctcctgagaatgaggataccagctacattagccattcatttgatgtttattaaggggcttctcctgtagcagtggtggtcaccaagagcccgttttccatacagccactgtggtctagctgcactgtctggcagtcagctccagagttgcacagtgaccctgtctgcctcctccatatcactttggacatctgtatatttctcttatttatttgcagtcacctttgctagatcctaatctttaccacggcagggactttgtccatcctactcactgctgtgttgccagcagctggcaaagtgcttggcatctatttttattgcccaagaaacatttgtcatgtgcatgactaggtgaaacaacacttctaggtgtccactttgaagaagttcctagaggctcagcaataggtggcttttcatggcagataaataaatctggagtgggcaaaatctgctgaccacatatttaaaagctcaggaggtgaacataatagagagttctagagaagttaataacagtataatgtacatcacaagatactgccccctcactacatattatacgagaaaattaagagttatttacagctcttaaatggcttattcttgttttcctggtacctgaaacactctaggttttaaatgagttacctatggaaggaagacgaatatgtgagaactgagggataagtaagtggccatattgtcagtatacctttgaattaatttatcgaggaaaggaaataaaatgttttaatttgtttttttcttttttcactgctaactccatgaaaggctttaaatcttcattttctcagcagcttggaatgagcactgatagggtgctgctcagtctgctgtgccttggggaaaagagacaatgaaaaataaccattgttcctcaggggctcacagaccggtagatatctgcctgctggctgagaggatacaggaagagggacggataaaggaatgtgaaggagagagtgggg

SEQ ID NO: 106813 - DNA, 1001 bp, Homo sapiens
gcatgccaccatgaagaattatatagtttttggaagggcttttttatagatggtctgctaattaaaacataccctacaggcatctgcggtagccctgctcagagatctctggatagatgccacactttaattactcatttgcaaataaatactaagcattttcttttgaggttgtaaatcttctcagttgactgtctgaattttgtttatttgatttatttttactaggagcaaattgacatttttgaaggaataaaggacagccaagctcagcggatggccgaaaatctaggcttcgttgggcctttgaaaagccaggtatataagccattgggggatggtgtgtctgacttgtttcagaaaacatttgggaacttgcttcattgcctctagtgtttgtgattaccaggaaacaggattatttattgttttataattttttcctccagctgtttatgatgaagaaaaatatttccctgatgttttaaaagaggatgtttatgatgtgtctttgaatgtgttttggtatgtgtgtgcatgtgtattgcatgtggacacatacacttcatgatagatggtaatctctattttttctgtagcattgctggtacttagccacctggcaggcatgtgatacagctcattcgaactttagtttcatcatctataaaatgggaatgatgacaactcccgagaggcttattgtggggattcagtagaataatgtgtaaaagtccttattgtactgctccataaaggtctgttcttaatggtattaatattaataatacatgttatttagctaattgctattctttcatagctaatgggcatttgaaatgaatattgatggcataaacttgatattttattgagaacagcttaaaatatgccaattttgtaataatatcccttggcttcaaagaccaaaacattggcctcagagctgttgagggacagaatctgtcttagtatcgtcccctgctctgcctttgttccag

SEQ ID NO: 106814 - DNA, 1039 bp, Homo sapiens
tgatctttaccctcttcctttccctctcattgttcaatatctccccagttttccactgtcggatcttcagtcaacccttatctgaatctggtgtgcatttcagcattctctctttactatgactgtaacttttttgggtgaagaggtcacaaagcatcttttgtttcatttattcattcatgaactcacttttattttgctctcagtgagcctctagtacagtgctaaacacgcagcacataagcagaaagactcatggattttgtgagggtgaaggtgaaccctttgcagtgtagacatgaggctctgtgtaaggactctcatttaaatgattttcaacaaacattcattttctgcttgttttctctttctcttagccctaatgttgtgggacagctggctaaacagatgattgggtacaatctagcgacaaaacaaactccaaaagaaggtgtgaaagttaacaaggtaatatggatactttgggtcattttctatatatgtgttaaaaaatagaaaagaaaaccatccttcagtttttgacagaatctaatgaagtactgctctttggcagtgtgccattttattttttaaagctcatctaatctgtttagtaagtagtatgtcttggaggagaaataaaaagggctctatgatagtaatattatttattatcattagcatttagcaaaaagtgggtgagggtgagtgaccgagcaatggctttccctctgagaacacagatgcattctatttagttgagaagcgcttgctgtgacagccttatactcagtgagggacattcgctgctcccacacagtggccctcaaccccaggcgtgtctgtcagaattacctattgtggttgtttttctaaatgccccattccttattttaggatgactgtaattttgagccatttttattgctgggggtatattgcattaggaaggtcagctgaagtacccaagtatgtatagcatgtggacacacacccctcatccacacatagaaaataaagcccagaggaaagtggcctg

SEQ ID NO: 106815 - DNA, 1893 bp, Homo sapiens
ctacatgaaaagagcaagattgtatcttttactgagaatagtaagatgttacaactgaattgggtttttctagagataatttttatttacctttaaaaattttatcaccaacaaaatgtgtattaacggttatgaaagcagtaagtaagattagtgacaagatcagaggagtagcctaatttatattacagattttaatgtggcccataatatagtaataaatatacaatatttttaagcatatggcaaatatgaaaaaactgtgatttaataaactttaatttaggaatttttatagggactaaaattaaaattattccgtcgaaagcataaatacattttttgttaagatattatcatttttaaataatcaaactcttcaaaatggctttatcatgcccccacagtatccaaagaaaggattttttttcataatagggaatcatattcaaagggaagttttagatttaaaacttacatgaaagccttatcagtcaagaatttcttgatttgaaataatatctccctggataacttcctatttgtatcataaaatccttgtcctggagatggttctatttctgtcttgtacttatacttgaaagtggctgttttagacatacacgattcaaatctctgatgggcagcagtctactggagagccatgtatctccagtctcattcagtcaaatgatgtgaccaatggtgaaatggtttattctaatgtgctgtgtgtttgaaactctctgtcccaaatttgaaaagtccatgtcagacatgttgaaagctgaaataattatttcagtctcaaagatgccttttgacatatggagaattattacagtatcatcttattcccattgacccagttacaacttgaggaaatatgtgtcattctataggtgatatcatagtaatgattgaagattggtaactctctatttttatgtttgggttctgaagtcgtaacgcaaacatagaagtgagctcatttcctttgagaaattggcaccaaggcctctaacttatctctatataattgtatattctttattaaagttcatctttacacaataccttttgactcttctcttgccttccactttgccttctccttgccttctggtaataggtaaatctgaaattctgaaatacaatttaactttctcaattaggaattctatcaactctcagggaaggtgattgccatgctacatattacacgatgcagttgtgctgagaactggatattccaattttgctccagtcagtgaaccacagaaatcagtttctgcaagtccaatattattgactccaaatagatgatcattgtagtagtcatctcattgcagtatcagtgatacatttagcatttaggaaagtattataatttagaaaagagcaatgctgaataaaaaccagctcagtaacacaaatagttgactcatcactgaactgtttttaaaaaatagttgaaaataacttacttttgtcaatatatttgattaacatttcagacatttactatgattcctattatggctctgaaatatgtcttgtgagcattactttgtgtaaatatgttttcagaaagccatctctaagaaaattaagtgaaccacattttacaaagcttgcttaattaaaaatgtgtattctatttagattatgcttttcttaatgatttgatttttttccctttagacctactgcttccaagaatgtttattatctagcatgtgactattggggatctataaaaattgctataaaactgcattataattagaataacacttgtggtaaagaatgaaaagaaaatatttgtaaaagcattgttataattcagctgatagactaaaaaaagaccacagagtaaggttttgcttagac

SEQ ID NO: 106816 - DNA, 1118 bp, Homo sapiens
agatggcaagattagggattgtcagccttcagtacctgatctcgatgccctgggcagcaagataacattcatatccacttcttggttgggatgggagatgtcatagaaaaagcatgggctgtcttactgtctgttgaattctggtgtttttaacaattaattgatgacaataatttctaaattatgtgattagtgggtggattagaagtaatacacatacaaagcattcagtatatttcttatcacctaacaggtgttcagacaacagttgcattttttaaagaaagatgatgagactgctgaaatagcttacaaatgatttggggccaaatcagataatttaaggtataaaacacacagtagtttacatttatcagtcacttgaaatgttgccagacattgtgcaaagtctttacatagattgcatccttgaattctcccaataaaccatgagatatttattgttatactctgttttgcagatgaagaaactgaggtttatggaggttaagtgacttatccagttttacacagctaagtagaaagagttgaactggaatggcaatccacaaaatctaatgctagactactgaactcaaatccacgttctcgtattcctatgttatagacatccatgtctgcagtaacagtgttgcagagaagttaagaccagccagtattgcctttactttgcagaattgctctctgacttttgtacctcatcaattcagactactgtctttttttacatgcataataaaagtactacatgaatacaccaatagagtgggccttgttttattataatttggtatattaagtcacaaaaatgtttggttaaatagacagtaaaaggaattgtccttgaagccattaatacatgtgagatacgtgatgggcacagcctttcatatagcttgaaaggaaaggtttttgttttgctattattgggtcattgtgttttccccattttttcttttttcttttttttttttttttttttgagatggagttttgctctgttgcccaggctggagtgcaagtgttttctccattttaattgacagtcagtttccccagaagccatcatcaggagttctggtcatatttgatactgg
